United States Patent 10,724,096 (METHODS AND COMPOSITIONS FOR INHIBITING AND TREATING NEUROLOGICAL CONDITIONS) - sequence listing, part 127

SEQ ID NO: 2365 - DNA, 210091 bp, Homo sapiens
tcaggtatatagcatttataggcatttcaaaatagtcactttgaaatgttgagcagattcatgatagattttcaaggctttgaattatttacattttaaaaagtttatcagatattgcaatgttaaagataaattatttgaacttctagtaggtagtaatggtgtcagagaatgacaggtaattaagtcatacagtacatcttgtgtccacatttcatgcaatttttgcagaatgctgtactatgtaaactgctactgcaaaaaaaaaaaaaaaagcaattattgcactgaattttccataaaatccctccaagtaaatcttatcacccctttgcagatgagcatcttgtctttgggaagatgcaatagaaaaggaacttgccatagaaagcagtagtaagacttcttatatgagactaagattttcatttcattagctctctccttcaccttgtttattaattctacaagcatttattgccatctcctatgtgccaagcactggtccaggctctggggatacactatgaacaaaatacagtgaagtccctgccccatggagcttacattctagtagggggagacagacaaacacataaatacaaaatatcagagggttcaaaacagcttagaggtatcttgcctgaattctgtttactgcatatcctcattcttgggcaatgataaagtgaagagagaggccaacaatgggctgcagcaatgttgctagtcccagctctaccatctacacattgagtggatttaagtgagttctcatctgatctgagcctcagtttcctcatctataaaatggggagaaattggattaaattacttataagggaaagggtcctttcaggcttttttcatgagagtagggtgctgaaaatcaagagccagtttgttgactcctctaaggtttaaaaaatatttaaatataaaatctaagaaatccttagagatcccatacactcaatacttcaaatgccaatctgaacttctttcatcaatagcaaattcttatttacaatggctatagaatgaagtcattttaccatctttagccatatgaaaaataagttatttacttataaaaacattcatttttattattggttacaaaatctcaccttatttgtgaaatgttccctagctatgagatcctgcccttgatgtgacactatttctctcttctgctaacccctatccctgactttgtgctcctgtttaatttttccaactgaagtattagctttatgaaaacagggatcggctgcttgcttctttgaagaacaacccaaatgagagtatgtccaggtaatccatagacatgtataatcattacacctgcattttgttttacaggtacaggccttttggtaacccacattagctctttagactgtcagagttgttcagcttagtaaaatttagtttatcaaagggtactctaacatccgaaaaggaaaaacacgtttccagactaattcacagactagggcattgtaacttcactggaagccctggtgagaggcgttaatacatatttaataatgtaagtgaagtagcacatattttataatcaattaatttttctcaaagaagataatgtagcagaagacctgaatgtcaaacaaggttagactcatacttactaacttggtaggagttacgatgcctctgattctcttgaaagacaaactgtattcactagtttgattttgaaatgtagagatcaaatttcaatcaacccagcagctaaggatgacaggaaattttacaggactagaaggaatcatcttctcttatctggatctgatcctcctcgacaccttgggggtttccgaaggctgtgtgctctcagttttagctggttgttacgtaatcaaatatcccatgcatgtttttacatttgatcaggtgggcctaatcacaaggactcatgttgtcagtgcctttgggagcaaaatgaaataaatctctgtctcaatattggaatttattccttcctgttgcttagtggtgtcaagatacagtgtcaatgttaccagaagtgcctaacacagtctactgtgtaggctaaagtctgccgtgttcgtacagtgactgaaaaggaataatgactatatcctcatttgggtgaatgttactacttcaggaccagatgagcaggggcatcccatgtaaccatgaagaatcttgaagcagcattacaacatctaataataaacaatctctcaaacagtgcctgtatgaactgcaagatgagggcaggtccagctagacattggctgcataaatgaagatcagagaagaataaggagattcagacaacttttggcaacctagatcacagttactggtaaattcttgttacaaaggaaatggattttggtatacggaatttgaatatgtgttttactcaacagagtacatgctaccaacaagaatgcagccccctttttacaagttaggcagaaggaattataaagtcttgctgatgtttacagtccttacatcaatgtgactgcagccctccccagtcattccaaaaggtccttgggttggatacgagaatgcgtcaggcctggctttggctatgacatccccaggaagtcactgtgtgcagtgtggtctccagggtggaagtctttgagctgccaatgaatatctcttaagtccaaacctccatgggcactatggcctctttggtcccaacagaaggcagtaggctttcttcagacaagaaataaaaggggaattgcaccaaaaatccacggatcttcttcagttcctcctcagctcgaatgggatcttccttagctaatacgggcttgtttataaagtctctcagctgaattaaattgtgtacttcatcattgggaaggcaccggaaaacctgattagagcataaatagaaaaatgagtgaaaagtttaaaagcgagcacatggcctttatggaaaataattattccaacagacaagacctctgttgtatgaaacatattattagtcttatgttacagcacagacctgatttaagagttggttatcttataaccaacaatagatagatctgctacaaacagatagatctgcttccatttaaaaaatcatggttagtggcaagaaattacactaatgttaccccacattaaggttaattttttttggataataatcatccctgaatttcactggagcttctggtctaagaggaatattgcatattatattttccctaacttttcttgaaagaggctcatatctgtacctttacatagcattatcaattgttaatatgtaacacttactttgctggttgaaaatgagttttggatatcataacacttcacccctgaatacttctctgcaggtatgtcttaagaataaggacatgtgcctatataatcacagcactattctcacacctaagaaaattaattatataatgtcatttaagttatgcttcatattcagatttatcctgttatccccaaaatgtcttttatagatgttttcccccaaatccaggacccaaataaggctgtgcactgcatttgtaaaattacattttaatgactctatgcacatgacctatttgatcatggccttcggtccatgaaataaggatgaaataaggttatacaggggtcaggcgcattgggtcatgcctgtaatcctagcactttgagaggccaaggcaggcggatcacttgaggtcaggagttcaagaccagcctgtatcataatacaaaaattagctgggtgtgctggtgggcacctgtaggcccagctactcgggaggctgaggcaggggaatcacttgaacccaggaggtagaaattgcagtgagccgagatcatgccactgcactccagcctgggcaacagggtgagactccatgtcaattaaaaaaaaaaaaaaaaggaaagaaagaaaagaaacaaggttatacagacagtagacatgtttcattaagaataataagtttctctgctggaaggggctctaagagaaaaattgcgtattttccctaatttttttttttaaagaggttcacgtctgtccctggaagtcatgaagaagaacacagacttatccaacttctcacagatggtcaattagtctgggctagaacacagcttgaatagttttccctgatgggcaactagctacttttcgaagtaagctgttctactgttacgcaactcttaactcttttacattctttattataaccaaaggatagacttcacaggcaatgcatttggtatgcatcaaatggagccggttttaaaacacctttctaaaactagagctgtccaacaaatgacatgtcttgttattaatattaacaagattcatcataaggatgaatactgtttactatacactatgtgctaaaaccattcactagactattctttgtcctcataactacccttgtgaatattcctcccaatttataggagaggaaaaagaaactcagaaagttaagtcactatacacaaggttataacaccagcaacggggtgagctaggctggactcagctgtggcttgtttttttatgccatctgcccctcttctctttgtcactagacatgtacaaaggctgggtaaccaggtgctaaggatgctgctgatgggattcctgcatcacaggagagactggaatgctgctaaagcctcttctaaaccaaaatccacaatgctttttgcctttgtttttcagggtccacaaagaggtattttattacaacctggacatgtattagcttttttacgtttattaagaataccctgtaccaataatatgcagaaataacaatatgctttttgtgatgagattcagtgaaaagaaacggaggaggggaatacgtgaacttcaccttgtcataaattgtagcatttcgagctgctgttgaaacccacacctccttgaagaatttgtcactcactggatcctgaatgtcctcacttgggtcatcaagatagccaaggacaaccctgaaatacaagtgacctccacattgagtaactgagataaagcagtttgttgcaggatatatgtctattatatctatctctatatatgcaaatatatatatgcaaattatttgagagaccatgacctagctactctcatatcctcagagtgcctgacataaaagaaactattgtctgaattgaccacacataaacagcggactagacataacaaaaaattctcaagcaaacaagacaagttttagaagtgatatttgaaaattataataacccttgtacttagagaaggctttaggattaaaaagcacttccaccttaatcctgtgtggtaggcgggacagatgattctcattctgtagataggaaactaaagtctcgaggcacactagtaatggagttagaactcaaactgagggcaaagcccttttcccacatacttgataggctgaaataataccaagaagacctgtgctatttggaaagagcaataggaaaattggccttgtaaggctttggtttttatattaagtgaaatggagagtgtagacatcagtgcagaggagtgacagaatctgacttacatattaaaatacggctgctgtattgagaacacactctggggggcaagggttgaaacagggagcccatttaggagctactcccataatccaggtgaggtatgatggtggcttgggcctgggtggcagtggagatgaagatagagccaacaggttttactgatagagtgaatgtagggtgtgtcaaaaagtgaggcatcaaagatgactacaaggtttttgtcttgagcaactataataatgtacagctgtagtcgcctttagctgagatagggaattctgtgggtagagctggtttgtgggagatcaggaattcgattttgagcctgttgagacatctattaaagatgcaagtggcagtgctgagtaggcagtagataaatggaactggggtttgggagagaaggcttgtttagagatataaatctgagaattgtcctcatgcacatgctcataggctgaatgtttttttctgagttcaccaaataagtgagtatagacagagaagaggaccgggtgtatatcaacagtaagggagaggaggaggaaccagcgaggctggagaaaagccagaggatgtggaatcctgaaaccacacaaagaagtatgtcaaggagaactgtccaattcagataagaattgaccaccggctttaacaactggacatcattatattgttaccctccttgtatttaaataaatgtagatttgcatcatcattttaatggctgcagagtttcctatcacgtgaaatttattgaaccaattatttcattatggacttttgggtaatttccaatttttcattattataaacagtgttacaatgaacacagtttattcatcatatgtgattttgtacatttctgtgattatttcataagaagaaattttagaattagaattcctgggtcagagaatattcaaattactgcaagaaaggctgtaccaaaacatacactattaagcatgaatattttcccagttttctccaacattatcaactcacgaaaaagttcaagtctgtagatattaaaggacactcattttagttttagtctgcactttttccactgtataaaaatttttttaaaatggatctggcaccataggctttctaggattcttgacttttataacctcaaagttctgtttccacttcaaataatgtgcctccttcagactacacgagaataactttttttaaaaaaagatttaagagatgtttgcacatagacattggctgctaattgagacccaaagcacaattttactgcatcaaatgtgaatgacagtacaaatgatgacagtaagtcaattattataatacctttgatttgggccagatttaagaagctgaaaattgagcagaaagagtttttctgtaactttgcttttaaattagagcaagagataagccaatgtgtccaccaaactatcaggtaagggcttgtttgtagaaaaagtatttaaataagtctaaaataggcaatatattattttccctggcagtattttaattataagaaatttatattaaatgcagagtaaaaataatatgaagtactctggatgttcttttgaggactaaagtttgagagaaaactagtttaattttatgttgatgtatttaatgaaaattatttaatatttgcttattcatcaaaaaaagtgggacagtaggaaaaccacaaaaaattatttctgttctttccgttcctcatatctatcactttaaatgattctgagtcctaattgtgtggacaatggtttctcttgagtgatggttatatctgcaaagtttggataattttctaggacttgaactgttcagcttatagctgtgaaatttagtgcatgtttgattctgtctctatttagaattgatttcacattgaaataagtctctctatttctattttaaaataggccagatggaaaatggagtgaaactgcattttttaagtgaaaaaaatggttgtagtctaggccacaatatttatctttgggaatgtttcctaataaaaagaggctaaaattgacgcaatgtttttgtggtgcttttaaatatattatctgtgtttgccattggggcaaagtgaaaataattattgaagaacaactgcctctttaacacaatttgaaaaatgcgaagtaaaagaaagcacctagaaacaaagttagcataagatcagcattaaaaaaatgaattatttactgtagaataatcttcctccccaccaataataaaaacccaaagctttattgaagaacaataaaatattcatataaattgaagtccataccttgttcttcaacaagatgactcaatattataaaggtgtcagttcttttcttcatctataaatccgctataattccaattttataaaactagtaagaacttgagagaacgtgagtaaacaattctaaagtccatgtggaagaattaatgtttatgaataaccaagattattttgaaaaagaatactaatttgaagaagtggtatggcaaaaagtagtcttaaaatgcacagccacaataattacatggtatcacactggcatgcaagtaaacagactttcaatatggcataacagagagactagcgagaagccagaacagatagtgattcagtgtatcttaaaggtggactgcagataagagaggcgaagagtcctactacgtatcgtaaggttccagatcatctggttagttgagaaaaagagtcaggaccccgacctcacttcttacactaaaatacactgcagatgttaattgtaaaaagtaaaaccaaacaagcaccaggagaagacacaagtaaatgtttaatcttaggctgaggaagctattctaagcatacagaaaaaggcaggtggggaaaaaaaagaaaaaaacagattgatttgattaataagaattgaaaaatttcccccaaattctccaaagatgactaaaagccaacaggcaaacaaaatttgcaacacatatgacaaaggaataagcatcctacacatatttaaaatacttataaatcattaaaagaaagttaaacaacaaccccattaaaaagtgggcaaaagacaatggaaaagacatttttgaaaagaagacacacaagcagccaacaaacataaaaaaatgctgaacatcattaattatcagataaatgcaaattaaaaccacacaagataccatttcacaccaatcagaatgactattattaaaaagtcaaaaaacaacagctgttggtgaggatgtggagaaaagggaatgcatatacactgttggtgataacagaaattagtataacctctataggagacagtatggacacttctcaaagagctaaatatagaactatcattcaatacaacaatcccacaactgggtatctacctaagttgtcctaaaaatgacacctgcacttgtatgtttatcacagcactattcacaatagcacagtgttggaatcaacctaaatgtcctgagcagacaattacataaagaaaacacacacacacacacacacacacacacacacacacacacacacacaccagagaaaactactcagccataaataagaatgaaatcatgtattttgtagcaacatgcatggagttggaagccattatcctaaatgaaataacagaaagttaaatactgcgtgttctcacttataagtgggagcaaaacagtacatacacatggatgtacagagtggaataactgacgttggagactccaaaaggtgggtgggtagaggtggagtgaaggatgagaaatcacctaatgggtacaatgtacactatttgggtgacagttacactaaaagcccagacttcacccctacacaatgtatccaggtaacaaaactgtacctgtactccttaattgtataaaaataataaaaaaagaaagttaaaccttccatcgtaatgggcaaaggatacaaataaactaggcaatttatgaaaaaaattatacatggctaataaacatatttttaattctaaaaaatgtgaattaaaatggtgaaattccatgtgaaatctaacaaattggtgaagattaaataaactcagtcaagatagaaggaataagccctctaaaatattgccagtgatataataagagatcaaaggagacaataaagaaggtgaacaagaaggtatctacaaacatacccatttttttatatcagcaaaaatatctgccaaacaatgagggattaaaggaattatggcatacacatacaataaaatataatgtagccattaacatattgtagaagaatactcgatgacatggaaaatgtgtgtaacattgtttaaataataaaaaacatgtaggcctgcaaaattctaattttgttttaaaaagggaatacaatatattaatatctatgtatagaaaaaagtggaatgacatataccaaatgttaaaactgttatcacaaggtgatggtattacagatgaatttaattttcttactggttttctgtatttgccaaatttgtacataaaaatgtgctgtaatcaaaaacctctaccttctataattattacacatttaaaaagttataaagaaactcatgactttaaagagaattcttaagttcttacggaactgaaaagatataacatacattccagcttacaaaaggaagtatttgtcttttatgtatgccgcagtaggcaatcaatgggttaattagcagggtaccaatttttaaattctcctctgctaaacaaaacaaattaccattagaagctaattgaattatcaatggtttgaaaatcttcttactggcaaatcaagtagtaacaaaggcaataaatacagcaataaaagttgttagaaggtattgatagattttgagggatggattttttgagctacttagacagagacagcagaatgtctctacaactgaggcttatgttggtcttggaagccgaagtctggattggtaggaatgagcgaagtggcctctgcctttgccgggagttaagtgctcactaagcgcccatctgcaagtgagccagtttccaaaagggaccatttaacacaaagaaaacaacaggctgcagcgcagtgcccttcccgaaagggcataacgcactgatcttaactatatcggggccacctgctgcatcccactatacagtcctcaccaaaattgcattatggcaaatatagttctagaatcataaaactgtggacttcctacaaaggcctagagttgggagagtagtcagggtgttccacagccggtggggaaatgagtgtctgcagggagcaagggaaacagtgaaaggagacgagattatattacttgttccttgtgagataagaagccattggacagtagtgagcagagaagcaacatgatctagaaggttctagagggaccactgtgttgagaaaacacaacaggggacgtggacagttacagcgcagcccttgaaagttctaaataacactttattgaatggacttatttaggatcgcacagctgaaacgagcccagcttcctagcccagtattctctctgcttcaccacagattagtttaaaatttgcatcttcttgccaaagatcagggatcttcgacacctggagtcattttagacctgaaaacagaagtttccacatttaaattttacaccagcagtcactggcataccccttcaataatttttattatatccttgtattactggaattaatttgattttaaaaacttaaatggaagctggagggtttgacctggtctagtcctaattcagttaaggactagtatttaattggctcacgtctgtaatcccagtgctttgagaggccaaggcaggaggatcacttaaagccaggagtttgagaccagcctgggcagcacagcgagacacggtatctacaaaaaatttttaaaaattagctgggtgtggtgacacgggcctgtagtcccagctactcggaatgctgagccaggaggattgcttgagcctaggaattcaaggatgcaatgagctgtaactgcaccactgcagttttttctactgcacgtgacagtaataaaaagctattaaaataaaaaatattcatgtaccacctaaagtcatttcgcatactactggtggtacatatcctatattctgggacacactgttttagatgaagaagaacctaggatgacccatgtgctcagggctagcggggctgggtcccagcgactgctgcagtggaaatgcatcagagagacacactttggcggactgacctaaagcactgtagccgaagtcctcgggcaaaccggccagcttggtactcttttccatccattactgaaggaacagtctctgtatcttgcacaatgacagccatttcactgtcacgctttcccagcatgctgcggtcatttatgttggcagagcctgtaaggagaaacagtgaggctgaacaaccttcctgttgtggcagacactgttggttgccctcccaactcaattcatccttgcaaacaaaaccgtaattttgtccaggttttcaagggaagatgtgtttttagggaggtggggccctccctaacccaggggtgaatcttaatcagtctaagccagccatggtaatttcattatttttattagtgactggcttagaaatgggctcttgacatggtgctagccaatgtgacatgaaggaaagcttctgagaaagagtttcccctttgtataaacacacaaaaaatggattctgtctcttccatcctttggatatcttggcttgaagggttggaagaagacatgattccaggagctgctgcagccatttcacaaccactagagaacaaacaaaaaagcttaaagaaaatgctaagtagaaaaaagagccaggcatggtggctcatgtctgtaatcccagtgctttgagaggccaaggcaggaggatcgcttaaagccaggagtttgagaccagcctggacaacatagcgagacctggtctctacaaaaagtttttaaaaattagctgagtgtggtgacgcatgcctgtagtcccagctgctcggaatgctgaggcaggaggatcgcctgagcctaggatttcaaatttgcagtgggctgtaactgcaccactgcacttcagcctgggccaaagagcaagacttcatctctaaacaaaacataaaaataacaattaaaaaagaagaaagattctgggtctttaagtcattgaattagccaacctttgaatattcttaccttctgtcatgtgaaataatatattttccttattttctacattgttccttattgtttcacacacacttctagttgagttttctaccttgtggcacaaaagattctaactgttacaatcatcaagcacttgaaaaaaggcatgcctaccagttcagtaggaaagatggctttgcttttggagttaagaatcaggctctctgtaggctttaactcaaagtcacataactgtgaatgtcaaaactcaagagtaccttcataattaatagagtataatctcaaatacagattgtcatttgtggctttgggctttctgctttcttgcctccctcacttgtgtagcatgccaatagcttctgtagcaactttcctccattctattttttaaaattattaattctctttattagctcaatacctggttcattcaaggagtccatttttttttttaaatccaagtgagctgagaatgttgacttttacatgtgaagggcaaatattttgctattagttcaacctgtgctttctgcagtcctctgctgtgtattcaggaacctcatcacgtttttttgcattaatctctgcagattcatgcatttgaatccttgaggtgtcctgcaaactacagaaagggcctgactgactcttcttgttcctcttgctctagctgcaacaactccactgcttcttcagacgtggagcagaagggtcaggttgaacaggcaccctggcggccctctgactggagcagccagagctataaggtgacagcagccctaccagagctcaaatggtgagatgaatgagaaaagctgccctttcctgaagagactttactgcctgttgccagaatattgtcatgtggttaatatataaatctatgatgactatggatgtgagtgtttccccatggtggccctgggtaacagagaaaggatcgagcaccctacagaaatgtgagaatgctactggagtgctgctgaaaagtgggaacctttgaaacactttgttttgttagcaccaaatcatcctttatacatagacttacatcgtggttatgctataaaatttgcagctatatctttgagcttgacagttgccccaacattaatttgggcaattcacttaatctttctcagctttaatataatctttcataaattgagataataatatagaccttgtagggatattgtgggaattaagtaagaccatgtgaaagcacttaatgatttacaagctgctctacaaatgttaattattactggcattattatcagatccttgttaactctacaataactgcaccggagaatgctgccataggaaccgaccatttgatggaatgtagcatttgtttaaagaagcctcctctctggcttaatcgccccatgtgtgaactgtaggagctcaaagattgaagatcccatattgctactttaggacttttactgtgcccctggagccagcagaggccgctgtcaggcgggggctgctggattgaactgacatcactgctttgtttcgggtcaggagaacctgggatgtgagccagcctggaaagccccctccgcacacacattctcccacgcgcccccattcctctcccaccacagtgggccccgacactcccgaggtgaggaatacatttccagcattctgagctggaattattagacagagggtgtcgttcttgtattttaagggccaacatggaattacccagataactgactctccaccacattaaataagtgtgttggctgctatttaataggcatgtgaggaaagaaatgagaaaattttagatgaatgaataaattagatataataagatatgatggatgtaaatgctccctccatttgttcctgtattctgaaaatcaaattcagaagaacagttgtagtattaccctatttttatacaacatatgaggaagaagacagaacaagagatctagaaagatacacactgaactgttaacaatagtaggtgcttttcagtgaagagagagaagaaaataaggggaattttggtcttttactctataagcatccttcttgtttatatgacctgttctgagtgctattagaaaacattctaaaaattgtgaatatggcaaaatacaaaaggctatatgaaaatatgtgtgtaaaacttaagcaataataaaatagtcatcactgaatttattaccctggccaaaaacaatattaccacatcccagaaggctttgtgcaccttcccatgcatacccttccctccccaagaggaagacttgatgtttaactttgtgttcatcatgctctgaatgttttcctaaacaacaaaaaaagagtttacttctgacttgtttttaatttatataagtggaatcatatatcagatagtcctttgagatttgcttctttcattcagtcttatgtctttgagatttttctgtacataattgtaatgcatttcttttccttgaatgaacacactagggatttctttatttattctgctattgatggatgtttgggttgcttccagagttttgctgtgatgcacaattctgctctacatagctgagtatttgtttcttggtatagacatgtgtgagtttcttaggctctgtatgtaggcgtgggttgctaagctgcagggtgtatgactttactaggtaacaccagaatgttttccaacttacactcccaacagcagtggaggggagtctgtattgctccacagccatgccaatacttagattgcccaacttttaactgtttgccagtctggtatttttaaaaactcttatttgtctcatgttaatgagaagcaacattttttcacatgcttatgaggcttgggtatgttctttttgatgaagttcctatacaatttctttgcccatttttctttggacatttgttttttcttattgatttataggagttctttatgtgttctgtgtattaaatgggttgcaaatatttcagtttgtggtttatctttttattctctttacagtaccttttaatgaagaaatttctgaattttaatgcagttggatttatctttcctttgtggtttgtgcttattttgtgtgtctcacttagaaattgtgaatccttgtgtggtatgcagaatagcagctctccaaaatgtccgtgttcaaatctccgaaaactgtgaatatatgttcaatggcaaaggcgaactaaggctgtatatggaattaaggttgctaatcagctaactttaaaaatagagtgagtagcctggattatacaggtggacccaatacaatcataagatctgtaaaagtgaaagggagtcagactgagttatgattacagaagaatgggttgagacttttggggattttcagagatagaatgttgctgactttaaaggtggaagaaggggctgtgagccaaggaatgcaggcagcctctagaaacaaggaaatggactctccctaacggcctctaaaagaatgcaacagccctgctcacactctgattttagtcctgtgggactcacgctgaatttctaacctactgaagtgtcagataataaatttgtgttgttttaagctactaagtttgtggtcatttgttacagcagtaatgggaaacgaacgcacgaactctaccccgttttagtttgttttgaaggaaaactggttcttctattgagcacactgggctactctgtcttttctgcctacttgtatttcctttgcctccaggtcagaagttctcagctctgaccacatatgagcattacctaggaaagctaacaaggaagctttttaaaaaatactgatgccaaaaacaaaaccaaaaaaacccaaatgcctggccccaaaccagaccaactagatcataatttctagaaataagaaccaggcattggtataccactccatccctgtatccattgttaatttatatttttgttttgatccatttaaaagcaaattgcagacatgaggaaatatccccctctttactggggcagcccttcaactccagcctctcatctgccacagtgaagcctgctctttaaatcctgagactcatgagctcgacttagtttctcctcctacccacacttgttgattgcccctgaaccttcttgttctggtttggcaacatccatcctagtgtttctgctctcatatggaaggagtagctgcctctcctccagccagtgatctctgggagggcagtggcgctgttttactcacgtttcgcatctctctattgtgctttgcagtgggttagtgaacattaaaaacaaccgtttcacttagtcatcaggataggcttaaaatctacttgaaggggagcttggctttgttttggaaaccaaatatatgtgtgtctggttaaaggctaaaattaagataggtaagaaaactggatttggtcacagatttcatgaccagcagggttacccagggccacaggcaattaaagctatgcacaaaagagatcttcagtgtgagaaaacaaatatttcctcatgaggagtaaaatgaagataaatggtcatttttcttatgtcagctattcaatcattctggcataagtttgccatggaagaaaaattaatcatacattacttaaacctcctttaaatgtttaaatacttccttaacacctataaaatattctcaacctaacttctcaaactcgtctctgagaattttaaacactgttttctgtgttaggaacttaaatagggtgaatgtgttagaacagtaacaataaacctgcttattcttgagtttccaccgagataaaaagaacaaaagaaactctggattttttccttgggagaaatcgattctctaaggcacttggggaaggaaaaaaggaatccagcctccaaggactagcaagtaagacctctttagactcccagggccatatcctcagtttcaagagaatgtgtaagaattgtgtgcaaaattgatcaagtattgctaaacaaaataaattggagtctttgagtgtttagagacttttccagaaaataagtcaattaaaaacctcaacaaatttatttaactgttagctctgttaccaaaaactaatttgtatttatacttcatgtaaagtaaacgaggctgaaagtcaaaatgacctttcaaaaaaatatttacatctgtcagtttttacttcaaggcttctgaaatcttggtgaagaaatatgtggctttgtttatttttccatttcagcaaacatcaatagtttttatttcttactgtcattgtcaaatttaattccaaagtattctgagatttgcttttgaagagcaagtcagagtagctcaggagaaataaatgaaatcttgagtattagggcaaatgggggaataaataaactcctaaagagcttttatccctataggccaggagataaaagaacagtattttttaaatgtgctatacaaatattaaaagtgtgtatgtgtgtgtgtgtgtgtgtgtgtgtgtgtgtgtgtgtatctcaccatactgtggtttacacagtttctggctatagacgaggagataaaggaacaatattattttaatgtgctatacaaatattaaaagtgtgtgtgcgtgtgtgtgtgtgtgtgtgtatgtatctcaccacactgtggtttacacagtttctggcttcagaactatgtttcttttctattcaaatcatgttccagataagacagttttattcttctcagatatgagatatgttttcttttctcagtggagaatagaaagcatatttattgtccaaaattttcaaaacactccatgacatttagtttcttgaataataggaaagtatcttattatagctgataaactacatttcatttgaaacagatgagcagaattcccattagtaggacacatcatctctctaaataacatgacccacactggttacctcatttacctggttgattatttatactctatcatcctggacttccaatactcattttatataatattaatattagaagtcaaaataattcaatgatggaagaatgaagctttctatgtatataaaagaatgaagctgaacatctacctctcttgtcaagctaatctaatttgggtagaatgtacaagttatttaggagagtaactctcctgaatttgtcagtgggaagaggcctttggaaaagtctcctgtgtatccttgacaagaaatgactgcagaccttagtgcagggctacatcctatcattagtacacaattcccacttcatccatacacatcaacaaagttggactgctctacatcctaattaatgacatggaaaacatgcatgttaggaaaaatagtggtaatgcatagaggcagcaatattttaccatccttctgatttcgacttttgtacaacttcagatctgtggtaatggttaggtggatgtggtataaacacatacgaattaccacaaggtactcacttatgacacactttccctccccatttatcccccaccaatccctgaaatctgggcacttggattgtaaataaaaataaggggatagctgggtgtggtggctcgggcctgtaatcccagcacacgggagactgaggtagaagaatcatttgagaccagcctgggaaacacagcgagacccccatctcaaaaatagttttaaaaattaaaaaaaaaagggagtaataaagaattagtgaaatctggcacattattggactgctgggttaaacagctgcctctggattctgcaattttcacgaagtccatttaattgctctgtacctctgattcttcacagataaaaatagtttagttcacaaagagatgataaatgcttgaagtgataggtactgcaattgccctgatgtgattgttatacattgtatgactgtatcaaaacatcgtatgtaccccatgaatatatacacctattctgtacctataacaatttcaacaactgggttagaaaggatgtaagagaagaggatggcttcagaaatgttttagttatggtgttactgtctgtttcaaatgcaaaggatgcttaggaggaatagcagcaaacatttttgcatggggtaagtcaactggcaaggaatacaattatagaccatatactgtacttaccaataataacagtgttatcatcagcaattaacaacttgctgtggacatagataagctcagttactaggtttccttcgagctctgcatgtgttctaagaccacagaatgatatgtaatttatccactgattaccaactgcaaatttaaaaagaaattattaaaattaatatgaccaagctcaataaacgtacattaaatcttattgtttctcaaaacatactacttagactgttcagaatagattgtatattatatgtatatgttttctatttcagaattcatccaggatttatttttgatatctgaatttcatattgtcagtctgaatggctttctctctctctctctctctctctctatatatatatatatatatatatatattatatatattttttttttaattgaagtgttttctgtcttccctttgctaaggcaatccaaaaagctattcatatatgaacattttattttaatgatttgatgagttaactactgaagagtgatggttaaaactgagctggaatagattaaccaagacttcagtgtgacatttgcttctatcctgcttgacacttgctgcagtttgaatcagatgcaaggtgtgtgccaaaccacctgatgctacatcatttgtagcatattcagcgtgaagcatcagttaaattctgcagactttgggtaaataaaaatgttggcaatgaaaaaccactcctccctttagatcattaaaattaggaaacagaagaatccttactacattagacttagaattttcttcagagcaagcagcaccaggtttgtacttcaaaatattgccatccctctaatcacatgggggccattcacatgataagaagaaatacattccatactaagccaagtcataatcatgacccctgttgtgagtgttagtcacaggatttttatggtctttctcccacacagcagttgtcttggataagcaagtctgataccaagaataaatggagtggaaccaaactatcacaaattctcatagaaagagagcatacatttttttttgtctttaagagaatttgaagcatactaatagaagggtggcagttcatctcccatttactgaagtttccatttattactgatggtttctattttgctactgatgttattcagtgtttctattaagtttgggtatcttggaaagaaattcattcataggttatgtatagagatgcctccatttagagatagctctcccctcatatatatatgagtgatgttgtatagctgtgtttgatgagagttgaaatgttggtatactagtacaccatgtgtaagagatgcatttctaaaacgtttcatgtaaatgaggtttttgcaatttattcccccatttgttaatgttatattggaaagacacttcatctgaagaatcacctccttttttaagtcttttctgatccatttccttttttaagcccctcagacctataaaattcctggaaaacatttctaaataatgcctagtatcttacaaacatttatataatcttcaagttattctactgttgtacaggaactgggtcttacacatttttgtttctcatcctttcacagtgctaaaaaaagctaaataaatgtatgagtggataaatgaatattcaggtatcagctgaaactaaaaaatattttaccttttaatttctctgtatcatctactctcctacagctggatcatgatctagaatttataagtttaagatacaaagcagcttttcaaaggaatcatggagcaggacctttgctaaagtaaatatttttttacagtaatttccattaaaattcacattgaacaatatagtagaccagtggttctcagcatgcacaaagaccacctctatggaatttgttaaaagcagattcctgtgactcttcacagaattctgattcagcggaaatcaattcagtaagtccccgaggggatattgtttctgaatgacactgccatagagctttgataattatttaagattagtatacactaagaaaataatacaccatgaccaagtgagatgcattccaggatgcaagtctgctcatatgaggaaatccattattagacattatattgatcaatctagggagaaaaataatataattattttaacagatgctggaaagcttttgacacaattcagtatccactcctgataaaagcaatgaagaaagtaggaaatgatgaatactttcttaacatgctgaaaatatatataatatatgtattatatatttatatgcatatgtgggtataatattttcaatactatttaatattgccttggaagtatcagccaatatagttgtataagagaaatcatataaaaagtaaagtcatcttcacttgcagatactgtgaaaacatacctgaagaatcagtaataaaattatatcaaataataaaaatattaaatataataacaggatataaattaacatatagaaatcaatagcctttatatacacaaaacaataaccacttagagaatataatcacagacaaagcctcatttagaatgacaacaaagaaaataaaagagataaacttaatggttcacgtgcaaaacttttataaagaaaaagttaaaaaactatcaagacacaagagtagacttgaacaaatggaaagattgctcttgttctgggatagaacaattcaccattagaaatatgtcaactcttcccaggttaatttataaatttaatgtgatctcattacattacatgagatcgcattaatgtaatgtaatataaggtaatgtaatggtaaaaatgccaacaagttctcatggagttagataacctgtagtttgtatggaaaaataaacatgcaagaataaattgagaaaaatggaagagaaaagctatgagtcattagccctatcagactttttttttttttttttttgagatggagtctcgctctgtcacccaggctggagtgcagtggcgtgatctcgactcactgcaagctccgcctcccgggttcacgccattctcctgcttcagcctcccaagtagctgggactacaggcgcccaccaccacgccttgctaattttttttttttttgcatttttaatagagacagggtttcaccatgttagccaggatggtctcgacctcctgacctcgtgatccgcccacctcggcctcccaaagtgctgggattacaggcatgagccaccgtgccaggccagccctatcagatattaacacatactataaagtctgtataattaaaacagtgcagatctagcagataaatagacagatacaccagtgaatgggatagaaagtccaaaaagagatgcaaatacataaggaaaatttgtatatgataaaggaaacagctcaaatgataaggacaaggccttttcaataaaaaggtgctagtacagttccatagccacctgaaaaagataaaactccaaattttttttaacaagaataaactccaaatggatcagagataaaaatgtaagcaaatgaaaccagacaagtgttagaagaaagcaagggtgaattcctctatacttcaaatgtaagaaagattttgtaagtatccagaggcaaaaaaaaaaaaaaaaagatttgtaaattggttagattaaaaaaataacaacacgtttgcatgacacaaaacacgacaagcaaaaaacaaaaggcagaagacaaactgggagaaagtattttcagtacatgtcacagataaagaggtgataatcctaacatataaagaactctaaataattgaagggaaaagaaaatcaaaatcttaatagaaaaatgggcaaaacacatgaatagacaattcacacacacaaaagatacatttgaaaagatatccatcttgactcataattataggaatgcaaataaaaatgacgttgagaaaccatttgttatctataagattggcaaaaaataaaaagtacgacaacatattctgttagtgagaatgggttgaagacagactctctcatatattggtgatgaaaatgcaaattcatacaaattttttgaagggtcatttagcaatatctaacaaagctacctatgtgtttacctcctgactcagcaatcccactctagaaatttatgctaaatatataccttcaacaaataagaatatatgtatatatattaatatatacacagttacccattgtatgtagttccgttagaagcatataatggttgttgaagacaatctaattgcccattcataacacagtgattgaataaacgcaaatccacatatggaagactatgcagtgttacgagaaatgaagatctctgtgaattaatagggagtgatttccaggatattctgttaaatggaaaaggcaaggtgaacaagagaatatgcagtatatttttttgtgaaagagatcaggagaaataagaaaatatacaactatctgagcatttttccaagaagaaacacaacaagattaacctagaaactgatgaaattggttaccaataggggatggataagtacagggtgaaaaagatggttggggtagaaactgaaagtatagaggaatggcatttatttaaatatgttttttgtatagttctggctattggaagcatagttcatgcattcaaaaaaataatcaagagagatttaaaaaaaaaacaaaaccctgagagttccccttcctagtcaaagaaaggggtgacagatggcacctggaaaatcgggtcactcccaccctaatactgcgcttttccaacaggcttaaaaaatggcgcaccaggagattatatcccgcacatggcttggaggctcccacgcccacggagtctcgctgattgctagcacagcagtctgagatcaaactgcaaggtggcagcgaggctgggggaggggcgcctgccattgcccaggcttgcttaggtaaacaaagcagccaggaagcttgaactgggtggagcccaccacagctcaaggaggcctgcctgcctctgtaggccccacctctgggggcagggcacagacaaacaaaaagacagcagtaacctctgcagacttaaatgtccctgtctgatagctttgaagagagcagtggttctcccagcacgcagctggagatctgagaacgggcagactgcctcaagtgggtccctgacccctgatccctgagaagctaactgggaggcacccccccgtaggtgcagactgacacctcacacggccgggtactcctctgagacaaaacttccagagaaatgttcagacagcagtattcgcggttcacaaaaatccactgttctgcagccaccgctgctggtacccaggcaaacagggtctggagtggacctctagcaaactccaacagaactgcagctgagagtcctgtctgttagaaggaaaactaacaaacagaaaggacatccacaccaaaaacccatctgtacatcaccatcatcaaagaccaaaagtacataaaaccacaaagatggggaaaaaacagagcagaaaaaccggaaactctaaaaagcagagcgcctctcctcctccaaaggaatgcagctcctcaccagcaacggaacaaagctggacggagaatgactttgacgagttgagagaagaagacttcagacgatcaaactactccgagctacaggaggaaattcaaaccaaaggcaaagaagttgaaaactttgaaaaaaattcagacgaatgtataactggaataaccaatacagagaagtgcttaaaggagctgacggagctgaaagccaaggctcgagaactacatgaagaacgcagaagcctcaagagccgatgcgatcaactggaagaaagggtatcagtgatggaagacaaaatgaatgaaatgaagcgagaagggaagtttagagaaaaaagaataaaaagaaacaaacaaagcctccaagaaatatgggactatgtgaaaagaccaaatctacgtctgattagtgtacctgaaagtgacagggagaatggaaccaagttggaaaacactctgcaggatattatccaggagaacttccccaatctagcaaggcaggccaacattcagattcaggaaatacagagaacgccacaaagatactcctcgagaagagcaactccaaggcacataattgtcagattcagcaaagttgaaatgaaggaaaaaatgttaagggcagccagagagaaaggtcgggttacccacaaagggaagcccatcagactaacagcggatctctcagcagaaactctacaagccagaagagagtgggggccaatattcaacattcttaaagaaaagaattttcaacccagaatttcatatccagccaaactaagcttcataagtgaaggaaaaataaaatactttacagacaagcaaatgctgagacattttgtcacctccaggcctgccctaaaagagctcctgaaggaagcactaaacatggataggaacagctggtaccagccactgcaaaatcatgccaatgccaaattataaagaccactgaggctaggaagtaactacatcaactaacgagcaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggaggcaggaagatctaccaagcaaatggaaaacaaaaaaaaggcaggggttgcaatcctagtctctgataaaacagactgtaaactaacaaagatcaaaagagacaaagaaggccattacataatggtaaagggatcaattcaacaagaagagctaactatcctaaatatatatgcacccaatacaggagcacccagattcataaagcaagtcctgagtgacctgcaaagagacttagactcccacacaataataatgggagactttaacaccccctgtcaacattagacagatcaacgagatagaaagttaacaaggatacccaggaattgaactcagctctgcaccaagcggacctaatagacatctacagaactctccaccccaaatcaacagaatatacattttttttcagcatcacaccacacctattccaaaattgaccacatagttggaagtaaagctctcctcagcaaatgtaaaagataagaaattataacaaactatctctcagaccatagtgcaatcaaagtagaactcaggattaagaaactcactcaaaactgctcaactacatggaaactgaacaacctgctcctgaatgactactgggtacataacgaaatgaaggcagaaataaaaatgttctttgaaaccaatgagaacaaagacacaacataccagaatctctgggacacattcaaagcagtgtgtagagggaaatttatagcactaaatgcccacaagagaaagcaggaaagatccaaaattgataccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaagaaaagagagaagaattaaatagacgcaataaaaaatgataaaggggatatcaccatcgatcccacagaaatacaaactaacatcagagaatactacaaacaccgctacgcaaataaactagaaaatctagaagaaatggataaattcctcaacatatacacccttcgaagactaaaccaggaagaagttgaatctctgaacagaccaataagaggctctgaaattgtggcaataatcaatagtttaccaaccaaaaagagtccaggaccagatggattcacagccgaatactaccagaggtataaggaggaactggtaccattccttctgaaactattccaatcaatagaaaaagagggaatcctccctaactcattttatgaggccagcatcatcctgataccaaagccgggcagagacacaaccaaaaaagagaattttagaacaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaaaccacgtgattatctcaatagatgcagaaaaggcctttgacaaaattcaacaactcttcttgctaaaaactctcaataaattaggtattgatgggacatatctcaaaataaaaagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagaaacccaaatcatgagtgaactcccattcacaattgcttcaaagagaataaaatacctaggaatccaacttacaagggacgtgaaggacctcttcaaggagaactacaaaccactgctcaatgaaataaaagaggatacaaagaaatggaagaatattccatgctcatgggtaggaagaatcaatatcatgaaaatggccatactgcacaaggtaatttatagattcaatgccatccccatcaagctaccaatgactttcttcacagaattggaaaaaactactttaaagttcacatggaaccaaaaaagagcccgcattgccaagtcaatcctaagccaaaagaacaaagctggaggcatcatgctacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctattcaataaatggtgctgggaaaactggctagccatatggagaaagctgaaactggatcccttctttacaccttatacaaaaattaattcaagatggattaaagacttaaacgttagacctaaaaccataaaaaccctagaagaaaacctaggcattaccattcaggacataggtatgggcaaggacttcatgtctaaaacaccaaaagcaatagcaacaaaagccaaaattgacaaattggatctaattaaactaaagagcttctgcacagcaaaagaaactaccatcagagtgaacaggcaacctacagaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactggctatcagagaaatgcaaatcaaaaacacaatgagataccatctcacaccacttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcaccattctcagtaaactatcgcaagaacaaaaaaccaaacaccacatattctcactcataggtgggaactgaacaatgagaacacacggacacaggaaggggaacatcacactctggggactgttgtggggtggggggaggggggagggatagccgtgggagatatacctaatgctaaatgacgagttaatgggtgcagcacaccagcatggcacatgtatacatatgtaactaacctgcacattgtgcacatgtaccctaaaacttaaagtataataataatgaaataaaataaaataaaggctgaataattaaaaaaaactctgaaatgtaatataaaccaaagtaaatgaaccaaacctaatgaagttaataacataatccaagcaaatcaagttaacaatgtaatcaaactacttttgattacagacatttgagtgtatacccttaggctaaaggcaaaacactataagcaagtgttaaactctagtaagtagattcatttttcatggtggtatgggccagcaatcccaaacctattttctgtgtattaaaaggttgaggatatacataaatatgctgcggataatgggagccgtgtttctcactgtgaaagaaaggagctataaacataaaaagagggatagctagaaggaatcctatgctgtgggattggaattggagatatccacatgacaagaaagagagagaataggtttgtgtgtgtgtacaaaggcccaaagtagtgatattctagtagcaatgatcacatctagcacccagattttgctttataaataccatttttcgctaaaataacctaggttccttgaagaaatggctgattgcagggctagtgttgggaatatatgagtctgggacaccttgttgtgccagtaaaagaagatgattagcggggacatgtccaaaaatcatcaagccacctttaaaaggccctcattggccaaatctgggcaagctgaactccaagatcttaactcactaaataagagaagcagctgtaagtccatactaatataaatacataaatggggaaaaagggaaaactttccttacagtagaattccaactaattaatttaaaagaaactaataaatatagaaaaaaatgatggaatcacaaagtcagcatttggtaactatcatgataattgattcacagaataattaacgcatgctaaaaccaggaggtcaatggttgataagaagcaggatacttatatacacctaaagtgttttcctacaaaatactattaattatgaagggaaaaatagtggagaattctggcagacaccaccttcactaagtgatcaaagttaatataaccagtaaggttgttcctgctatgttaccgtaagaacacaacctcacttctgtgatactgctccaaaaaagcataagctaaatctaatcatgagaaaataatggacatacccaaattgagggacagtctatagagcaactggcctgtactattcaaaaacatcaagatcatgaaagctctgccaccccccaaaatcaaaatgattgaaagataatttcagattaaaggaaaataaagacatgtgacaatgtcacaaattattgtgagctgaattctagcctaggaaaaagccttttttcctcttttgctatgaagtacattcctaagacaactggcaatatttcaataaggtctataaactggataatagtattatatcaatgttcatttattttgatatttgaactatacttgattaagagaatgtccttgttttctcagaaaccacatacatatttagggggaaattggtatcatggctgcaacttattccaaaatgactcagggtaaaaaaaaaaatccctacatctatatatgaatgtatctttctattgagagagaatgataaagcaaagaaagtaaaattattataacatctgtgaaattaggatgaaggatatatggcagtcctggaagctgttctataaatttgagattatttcaaaattaatttttttaagattaatgatactgactagcttttagcagcttgaaggtttaggacatgtcatattcgtaattttctaaagcacatctatgtgccatgccaaagcaggcctacagagtatcagcaaaacatcaattagtaagacatcctgtcagcccacagtccatacctacttcccactcatccttgactatgcaataactcttacgaagtaattaaatctttatttctttgtgaaaaatggccttgggaagagacctaacagttggttccagtaacatgatctaaaagaaagataatggttcctagccagaaagtagacattttggacaaatgcgagtgtggcctgtcaaatgctatggggacacccatttatgatgtgaataaattcaccatgaactctatacggaaagaagaaaaaacaaatagagaaaatatttcagccagtactttattctgtgaaaaaaactgccttgacatgtaataggtacaaaggttggtgatgttaatttatgttatgaggatatactagagaaacatatgctttttgaagaaaatatgagcaagccaggagcatacataagcattaatgtgaagaaatagatgaacaagtataagaaagagtcccaaattacataatgccatggaggtatctgagaacctggagatttattcagatcccaggacatacctgttgtgaacattggtgtgtgcatcacacaccggggcctgttgcggggatgggaggctaggggagggatagcattaggaaaaatctctaatgtaagtgatgggttgatgggtgcagcaaaccaccatggcatgtgtatacctatgtaacaaaactgcacgttctgcacatgtaccccagaacttaaagtataattaaaaaaagaagagaaattcaatacaatagactcaatatttataaggaaatttcgtgaaaggacatcaagaattgttacaggctttcgttccttgtagcacttagtatatgtacgtatctaatcctgattgaaaacttctggcccttatcttaaattatactaaattggctgctaaaataccaaaattaacaaaaattataaaaacaacaaagaaatgctttaaattaaacattaaatctctgaagactggtatatcagataattatatactaatagctgctggttttcttttcaggaattttaacatattcatagcagcagttttgttattctaaataattaaaacagtagagaactatatttctctatccaattagagattagctagttcatgtatttaaaaccactacatatacaaaaacaaagccaacaatacaaccttgtactttagaaacaggcattatgtaattaatctttgctctctgtctagcatatgaacattttccccactgagatgccttattttgactgttcccaaggtacttggaaatcttttcataaacaggcttagcattgaaattaattcttgtgttaaaaaccaatttgcacccttgaataggcaaaggcaagaaaagggtccagagccaaaggaaatactttataataagctcaggacatttttactgttgagaaactcaataataagctgttttgccctatatcctcacctgcgcatttttacaagccactgccagcgctgaatgattttcccgattttattttatcgatatatcttttataaatttactaattcactatcatcttcattttaggccattagaaaatagagacagagataatactctggcaaatctctgtcctagatacaatgagatgcaacttttggaagtattcattattggtgatgtacatatcttttgtctaaagttgcttacaaaagttttgtaggttgagcagaccatcagtgaaaaattactgaacacacaacaccaatatatgtacatatgcctattttgaaattatatacatgtactaaaaacttgtcactattttaacttgtcaatattttaaatttgtatttaaagtttccaaatcatttaaaaattcttacaatttataaattttatactacaaaattctcgtctttaaagtgtacaaatcagtatgttttataagtagtacattcacaaggccgtacaaccatcaccaccacctaattttaagacatttttatcactcccccaaaaaaaccccacactcattaacagttacaccccattccactctcctctacaccctattattctaccaactggctctatggatttgcctattgaagacattttataaaaatgaaaccagacaatatgtggccttttgtgcctggcttctttcacttagtgtaaggtcttcgaggttcatctgtgatgtagtatatgtcagttcatgcctttttacatctaaataatactccactgtatggatacaccccattttgtttatacattcatcagttaatggacattgggttgtttccactttttggctattctgaataatgctgctataaacattcatgtacagatttttgtgtggacatttgtttttaatatttgggtaaatgttaaggagtagaactgctgggttataggctaactatatttaacttttgcagaaatgccaaactggctttccaaagaagcagtaccatttttcattcccaacagtaatgtgttagggttccactatttacacatccttgccaatactttattattattattattattatggccatcctagtgaatgtgaagctgtgaggttgtattgtgggtttgagttgaatttctagtgactagtgatattgagttttcttttatgtacttatcatccagttgaatatcttctttagaaaaatacctgtttagctgctttgcccattttttattttttgagttatttttatttttattactgaattgtaggaattctttacatattctgtacactagtaccttatacatatgatttgcaaatggttttctctcattctgtggggtgttttcacttccttgataatgttcattggagcacaaaggctttcaagctttcatgtttgatgaaatctaaattatctatttttatatgtttgcttgtgcttttggtgtaaaatccaagaagccattgtcacaatgatttatgcctattattttcttccgggaaatgtatagttttagtttttacatttaggcctttgatccatattgagtgaatttttgtatatggtatgaggtaggggttcaacttcttttttttttttttttttttttttttttttttgcaagtggatatctagtttttctagcaccatttgctgaaaagactattctttctccattgaattgttttggcaccaccttgctgaaatttaattgaccataatcataagaattatttttagattctcgactctattcagttgacctgtaagtctaactttatgtcagtagcacactattattgtgggtttactgcaagttttgaaatcacgtatgtgacacctccaatttgttcttattcaagattgttttggcaatgctaaatgccttgaaatttcacatgaactttcagattagcttgtcaattttttcaaaaaggtagttggggttttggtagggattgtgttgaatgtataggtaaatttggagagtactgccatcttaacaatgctaagtctttcaatccattaacacagagtatttatttatttatatcttccttaatctctttcaaggttttattattttcagcgtaggtatcttccactacctttattaaatttattcctaaatatttaattcttttgatgctattttaaatcgaattgttttcttaatttcattttcagtttactcattgctagagtataaaagtgaattgatttttgtatactcatcttgtatcttgaaacactgctagactaatttattatctgtaatagtatgtgtgaatttcttagaatttcctgcatacaagatcatgtcatctataaaaagaggtagttttactcttcctgttcctttccctttaaaaaatgtatatttttcttgctcaactgttgtggctaaaacctccagtacgatgttgacaaaagtgaactttctcatctcatcactgatcatagaggggaaagctttcagtctttcaccattaagtatgatgtcagcttatatgtgacatctacacataccatttacatggctgaggaagttcctgtgtattccaagtttgttgaggtttttttgttttgttttaattatgaaagtgtttgggattttgccaaataatttttctgtgtcaatgagatgattatgtgtggtttttgtcctttgttctattaacatgatgcattacactgactgattttcagatgttaaaaccaaccatgcattcctgggaaaaatcccatttggtcatgatgtataatcctttttatattgttggattcagtttagtagtatttcactgaggaattctgtggtacattcacaaggaatattgatctgattgatctgtggctttcttttcttttcttttgagacggagtctcactctgtcaccaggctggagtgcagtggtgcaatcttggctcactgcaacctcagcctcccgggttcaagcgattctcgtgcctcagcctcccgagtagctgggactacaggtgcatgccaccacgcccagctaatttttgcatttttagtagagatgggtttcaccatgttggccaggatggtctcgatctcttgacctcgtgatccacctgcctcagcctcccaaagtgctggaattacaggtgtgagccaccatgcctggtccttttcttttcttataatgaccttggtattggtatcaggataatactggactcttagaatgtgttgggaagtatagtaatacattgcttaatgagaatgtgagagaaatgtgtcattgggtgattttgtcattgtttgaacatcataaagtgtaattacacaaacctactacacaaatcatatagtctactacatacccaggctatatggtatagattattgctcctaggctacaaacctgtacagcatgatactatactgaatactgtaggcaagtgtaacttaatggcaagtatttgtgaatctaagcatagaaaaagcatggtaaaaacatggtataagagatcaaaaatgatacacttaaccagctgggcacggtggctcacgcctgtaatcccagcactttgggaggccgaggtgggtggatcacgaggtcaggagatagagaccatcctgactaacacagtgaaaccccatctccactaaaaaaatacaaaaaaaaattagccaggtgcggcgatgggcgcctgcagtcccagctactcgggaggctgaggcaggagaatggcatgaacctgggaggcggagcttgcagtgagccaagattgcgccactgcactccagcctgggcgacagagcgagactccgtctcaaaaaaaaaaaaaaaaaaaaaaagatacacttacatagagcacttaccatgaatgaagttgctctgggtgtgagtggtgaataaatgtgaaggtctaaactattactgtacactactgtggactttataaacactgcgcacttaggctacattaaatttttaaatttatttaaaaataaaataattgtaccatgccatgggtatgactgtgacatcatttggtgataggaatttttcagctccattataatcttacgggaccaccatcatgctgcaatctgttgttgactgaaatgtcattatgcaacacataactgtattcctttctcctatctatttttggggaaaagtatgtgaagaattggtgttaattctattgcggatggtagaactaattagcaaagccactgggccagggcttttctttgtgggaagattattgattgctaaattaatctctttacttgttattgctctatttagaatttcagctctttctagaagcagttttgggagtttgtgtctttaatacaataccattaatcgtatgtatcaatctgactgggccaagaggtgcccagtttaatattgtttctgagtgtgtctgtgaggggttttctggatgagattagcatttgaattcgtggattcactaaagtagattgccctccccaatgttgctgggcatcatctaatccattgagggccagaggagatcaagagacagatggaaaaagaattcatgccttttgattcttgcttttctgcttctgttggaatctcggtctgctcttacccttttactaccattaacaccattggctcctctgattctgaggccttcagacttggatgggaattacatagccagctttcctgggtatccagcttgcagattgtggaaattctcagcctccgtaattacttgagtcaattcctcataataaatcttttcatatatatatatgaaagatagatatataaatatataatatataatatacaattttatatattatttatatatagcacataaaatatatatctatacatatatttataatatataacatataagtaatatataaatatatcatatattatctatatataaatatatcatatattatctatatataaatattttcatataaataaaagatatatatgaatatatattatatagatggatatataaatatacatgtaaattatatatttatatataatttttaatttatattttatatattatataaaattatataaattagatataatatattcatttttaatagataaatattttatttaatacataataaataatatatattcatataatatatattatataaatatatattcatataatatatattatatataatatatattcatataatatatattcatataatatatattatatataatatatattctatataatatatattatatataatatatattcatataatatatattatatataatacctattcatataatatatattatataaatatataaacatatattcatacatatatctttcatatatatgaaaagatttattatgaggaattggctcaggtaattatggaggctgagaagttatatttacataatttctctctctctctctctctctctctctctatatatatatatatatctcctattggttctgtttcttgagggaaccctgactaatacaatgtctttaaaggaatttgtccatctatctgggctaatttgttggcatacaactgttcatagtattctacactccattttatttccgtaaagtcagtagtaatgtcccctcttagtttctgattttggtactttgaatcttctctatttgttacttagtcagtccacctaaagtttgtcaactttgttgatcttttcaaaaagctaacttttggtttcactaattttctctatttttttctattatctcatttatttcccctccaatctctgttatttattttattctgcttgctttaggtttagttttctcttctttttctactttcctaaaatgtaaggttaggttattgatttgagatttcttattttctattaaataatataaatgtttatagttataaatttccctgtaagcattgctatagctgcctctcataagtttggatatgctgttttcattttcattcatctcaaaatattttctactctcctttgaagtatcttctttgattctttggttatttagaagtatattgtataatttccacctatctgtgaattcccaacatttccttttgttatttataatttcattccattgtggtcagagaacatactttatacaattccttaaatgcctgtaccaaatgagtttcttatactttactgaggggctctgtgtatgtgtgtgagggccacaggccttacatgctcaggcatgcagtttataactctgccttaggcttcactttctgcttccacagagcctcaaggtcagccagaggtgagagcttagggccttctcaatcctttcctgagcacgtgcattgccctgggccgttgcacacagccctacacagacccatgacctttcagattcccagggatatgttggaagtttctagtgcccactaggggatctccttcctcagcttatcctcttaagatttttagtcagcttcttgctcactcaactgttactgcctcttcagtcagctgtgatgctaaataaatgttgctgattgtttttgataaataccaggttttttaaaaagtctacttgcactgagcaaggtctgagtcaggtgaaataaatataagtacttagaatgggagtttaaagggaagtgccagacaggtcaaataatgacaatgtgagaactgtgggacatgggagccttaaccctgatctgctccctccaatggctgctaggctgctggttttcaccctgatttgagcagctgttggcttttaagattatcatggagctgagaagagggagatgggtatatggcaagttaaaatgccacaaagcttgctattcttaccaagattcagctgtttttcttgattaaacactccttggattgttacaagcctttagttaatttccccatccaaagaagttgattgtgacaacttttgtcagtatttttgttgcttttatgtaggactatatttttggagatccttcctctgccattcctgctgatgtcctaatttcttacttttaagctaaaaatatacagacttggaaagtctattattttctacccacattccagtacatcatccagtgcaccccatttgggaggctaccagtataaaataaaaacttccttcaaaatactcaattcaggtttatattctatctgaaggtcatatcatgaccttcacatgattaggatgagtccttctgccttttccagacctcctgcagcagctccattctcttggtccattggattgaaactcagaattagctgacacttcccttcctctcctgcttccacatcccctcaagtcatccctcataatcttacccacacatgatcctccttttccattaccagtgcacctttgtctcttgcttgccaccatctctaccctgtttaccaacagtaaatgaatcttcatataaacgtcagtttgatgaatttgctccaggggctcagagggtttccaccaacctcttcttgccttctggataaaacctagccttcttagtgtggctgtccacgttttcacaatctggacccaacttgaactagaagtcatacaacttgggttctgattccagcttagtttgtaatgatacacaaagatatagagcaaagatatagagcacagagatatagagcaatattgagtgcccactatatgctgaacccatagttcagggagctatagataggtaaacccctagttacaatatattgtagccaagaactaggtagaagaatcaattaagaacacatctgaggctgcacatggtggctcacacttgtaatcccagcactttgggaggctgtggcgggtggatcacctgaggtcaggagttctagacaggcctggccaacacggtgaaacctcgtctctactaaaaatacaaaaaaattagttgggcatggtggcgcacacctgtaatcccagctactcgggaggctgaggcaaaagaactgcttgaacccaggaggcggaggttgcagtgagctgggaccacaccattgcactccagcctgggcaacaagaatgaaacccagtctcaaaaaaaaaaaaaaaaaaaaaaaagacgtctgcgaaagtgtctttgaaaagtataaaaaattgtatccagtagataaagaagaacaaacaactataatacctcataaagatgattgttattattaaaacaactatatataaataaaaataaatagaaattacaaagatgctcggtttttattacctatttagtcttggtgtcttcatttgaataatggtttgggcaacttaatgagaataaatactttattacaggtgaacattttgtggggtaccttttataaacagagttctataatcacactgtgaaaacattaatgattactgatacctcaccttcataataaaaaacaatgatatgagaaaaaaagcagttacttacgctctgcttttaactgtccaaggatggaattttctcctctgcacatggttctgaaaatatgtaaaggagaaaataattacagaggtttcaaaacaaccaatcccatgcagtatctgtaggtttaatcctaacacaagtaaaaacagaacaagtgcttctatgagaagatgctacatatatatctaaatgctaaaaacagttacatgaatatcacttttgtaatgctactaatagggacatgatagttgttttgaggtaggtaaatggaaaagttataaaattcgtgttagatttcagaaagagaggctattaaaaaaagaagggtcatgaatgaactttccctcttacaaaactgggtaacagcaaagataaatttagaatgcatcagtagataagaatacttagagaatcacattgctctcagaggtgaaaagggcaagcacttagcagaataatttacaaattaaactattagaatggactgtctttaaattcagcaaaaccactaaaaacgaaaaatatagtctcaaataaaggactctgctaatgattttgtttcttaagactctgataatcactgatgaattataaaatctgacaaaaccaaaaattctatgcttcatctgcttgctctatgagagtaataaagagtatacttatgcctgagaaatgctattattaaagatgatgccagcaaatagagatgtttttgcataataaaaggttatagtttttgtttctgaacaaaagccaaatgtgttatttcattcagctggttcgaaggcaagaaaatagtcatagaaaacaattacaattaacaatattacaaaaataatattagaatggcgaatgaaattgataaaattcaattaaacattatgtcagagccttaaatacttgaaaagctttatcattttataaatcagataatattagaaatgtgcaaatcttcagtccaagtatataggccaaagcacagttaaagctctcttgtactgtaactaggcagaagcaccctggaggaaacaaacaaacaaaaatctttccttgaaatcctggcagataaacagatacaagcttgaaacatcagtaagaaaaaagaggattaaaaaaaaatttccactacaatggtgcactcgaactgtgcacagatcctccagcaggagcatctggcgagggggcccaagcaggagggcatctaagtctccacccccgatttgaccaaggccctgacccctaatctgctttacttaccaaaggttctatgtaaagtatcattcgtcctctcccacctttcagaagggtttgattagaaaggtgagaaactacaggtggttcagaaaaataagagattttggttaagtgaccctgagagaaggtcagaggtgcatttccatccccatctatgcaggctttctagcctgtgctcccccaacccaccagctagcactttccagcccttttcacaatgctccactggccaaatctgaagcctcaagaggaacccaagtgtgcccttttaaataaatataaaaactcagcttttaaaaatatcaagcacaaaactttccctaaaattttaacaaagatgtggtagagaaaacaaaattccgggaatttatttactaacagaggctatcattatcaaccttgttgaaggacttgctacctaaagaatcataaccaaacacaagcaaatcttaccatttcaggcatttaattttttctctatttactgcaaagtacatgtaaagctcaatagctatttacccacttaaagataagttttaatcaacattatacatatatagaaatagacagtaactatacaagaaggactaatattttagttcttttatgtttgccatgtgtcttaggccaatcatttatcattgtaggctccatttgaattttatcaactagcaaacgggccaagatttgaaagtaaaataaagtgttcatttgttccccactccaccgaatggatgtggagaaacactgccattcccttcatcagcttacatgatgcatgaccgaaagctcaaaatagaccatttagagttttggcacctgtagttgaagtgcatgattgcctgtagagcatttcctccgccggttgaaatgtctccttcgaaccctggcagaagtggtatcacgacatatacccggtatttctggttttccctgcaaaggtcagatgcagagaaattcacccaaaaaataaaaggtagtatcaattttagatgacagccaagcagttcacatggtttttgagattgagtgaatggcttcctacaacacgttctgtcacatttcaggacttgggagggtgtgctgttggactggaagacagaagctgtcatccaggctatcgcttcatagcctgaataacaagctaaacttggcagtaaagtagaaattgtacccattgtctctctacagcataatcgcttgtaggacaaaatgcagtgtaagaaatccttgcttggatcccatggaaagaggcgggtaggggaggctataacaaagttttggaaaaagaacttaatagttaacacagtacctagctagagccgtggaaatagtagacattcagttaataattgttgagtaaatcagttctcatagcctagatcgcaggggcaaaaagacacactggacccattacattttccaaaacagaagtcatcattatctacttagaaactctgagttttcagctgtaaaatgttaccctaggccctttaagaattctgagtggccggccgggcgtggtggctcatgtctgtaatcccagcactttgggagtccgtggcaggtggaccacgaggtcaagaaattgagaccatcctggctaacacggtgaaaccccgtctctactaaatatacaaaaaattagccgggcgtggtggcgggcgcctgtagtcccagctactcgggaggctgaggcaggagaatggcgtgaacccgggtggcggagcttgcagtcagcagagatcgcgctactgcactccagcctgggtgacagagcgagactccatctcaaaaaaaaaaaaaaaaaaaaaaagaattctgagtggccagtatgtatatttaagtcccctgcacatacaacacaatatttcatgtcccattctctcaagtgattaatgacaacctttgaaagaaaatgaattctactcaatgatataacaatagaagaagaaagtgtagctttctctctttgacgggcattcagaaaatcagaaatttgaagtatgctccaaataggtaccatttattcagaatcaaaagctattaacgttcttgtctctatttataggatatacagggagaagaaaaagcctcgaaaggaatgtgacatacactgtgatcaatgaatctcgctgggatatccgggaggactatattcacacaaaggtgttgtcattggttaattttcaagtccgatcctacttaaacttctcatttctaaagtgcattttcttctaaacaactaaatttttctttcatgtgaatattatcagtactctttgggggatcagattttattactgatgtctctaaagtcgatgtcagggcaagtggaaagagaagttcagggcagaaatgactaccaacaatgaaatttggaggcctgtgagtttggctgccatgctaagaaacaaggatcttgagtaggttgttgtaatggcatggattattcactagatggcaaacatagtttgagttggaaagaagacattaaaaaatgtaaactgttcaagtttgctgcttggtaagaataaaaggctcacatccctaaatggtgagcaggatagcgaaaaagaacagacaaaaaaaaaaaaaaagaaaagaaaacctaagctattaagctatttccccacagccaacatttaaaagtcaaaaaattaaactggacagttaaaaatggatgtcatttggcctcaactgccttttcagaattcaggattatactgccttacagtataatcctcccatcaccacagcccagtgacaggagactaccaccctttgttcagaggtacaccttcctactaataaagcttggctcatcagccttctgggcctccagtgaatcccacttcttctaggtcaccttattggctatttcctctgccaagccacttggctcttccagtcagagttgttttattcttgcctcggcactcatagcacatggccaggatgtctgttctgcactctttctgctttacacgatagtgatacacacatctgctctctaggctatgtgataagctcctttgaaacacaggatgcctgcccacatatctttctggttttggtagtacccaatcaaagacccttgcacatgctatgcactcggtattatttgctttaggaggatgggatcaggttggaaaaatgtttctggggaagtttctggtagagaagaggttaagctgaacaggaattttttcctttaaattaaattacattttgtttgtaaagtgtatataatatattacatacatttttttctttaaataaaattatattttatgtctttaaattaaattacattttattgtggtaaaatacatgtaatataaaatttgccattttacccttttttttttattttgagatagagtttcgctcttgttgcccaggctggagtgcaatggtgcgatctcggctcactgcaacctccgcctcccaggttcaagcaattctcctgcctcagcctcttgagtagctgggattacaggtgtgcaccaccacgcccaggtaattttgtacttttagtagagacggggtttctccatgttggtcaggctggtctcgaactcctgacctcaggtgatccgcctcggcctcccaaagtgctgggcttacaggagtgagccaccgcgcccagcccccatttttaagtgtacagttcagtggcatcaattacatatacaatgttgtacaactatcataatgatctattcccaaaccttttcaacatcccagacagaaactcggtgactatccagtcataactaccctgtttttccctgcctgcaccccttggaaacctctaatctgcttgtctctatgaatctgctggttctggattttgcatataattagaatcatacaatacttgtcctttatgtctgacttgtttcgcttagcataacatcttcaaggttcacccatgttgtagcatgcgtcagaattccctcctttttaagactgaataatattccatggtatgtacatatcacattcatctgttaatggacacttatgttgtttccaccttttggctattgtgaataatactgctataatactagcatacagtatctgtgagtccctgttttcagttctttggggtttatattcaggaatggaactgctgggtcatgtggtcattctatgtttagcattttgaggaactaccaaacaggttactttcaaatgagtaacatatgctcatagtacaaaatgtaagaggtagatgattatacagtgaaaaaaaatctctctcactccttcatcctgagggcaactcctgttaacagtttcctccatgttcttttagaaatagtgtaagaatttataagaatatatgtattttttccttctacacaaatattagaatactataaacacttttctgaacatgatttttatcatttaacagggtatcttggaaatccttccacataagaacatagttactttttttttttttttgagacccagtctcgctctgtcgcctaggctggagtgccgtggtgcgatctcggctcactgcaagctccacctcccaggttcatgccattctcctgcctcagcttcccgagtagctggcgctacaatcgtctgccaccacgcccggctaattttttgtatttttagcagagacggggtttcaccgtgttagccaggatggtctcgatatcctgacctcgtgatccacccgcctcggcctcccaaagtgctggtattacaggcgtgagccaccgcacctggccagaacatagttactttttaagaacagggaggtaatattctaccatgcatctatactttaatatttaaaccagttctttactgataggcatttaaattgcttctaattttttttctatttcaaagtaactattttgatatttacgctgactaacaaaagtaatttttcacatttgttggaaaaatcttacaagtggtattgctggtctttgacacaaatgtttgtgatgatgtttgtaagagacagttctattttatctttttttttaagcaaaaatgattttacaagggagatctcatatgtatgatattgagaaatgtcctataaaaatattataaaacattcttgcaaattttagtttgtaggaatcagaatattcacattttcttgtttttaggactctcttagctccataacaagccctttgctattttacaatatggtagctcataaatttcctgaatgatgaaaattttaaactgcgttcagcaaactagtggaaactatttagattttcactgctgtagaaaaaagggctctggaatttcaaacgcaaaattgtggttgaatgtaagccaaagcacagaagattccatgggacactgtgtccaatctgcctccttgatccaatccacagaggacaagagttccagctgctgaggaatccaacgtccttcggaaatactgaatcctcacaacatgggggttgtggaaatgatagcattcagcttagggtaagaatctgagcccctagtgtataaaatatttatgatcttaaaagcaatcttgcttttggggctagtgggcactaagccccggataactacccatcatgccagcaatcacttcatccacattagttcaaagcaatttctaccaaacagcattctcaggcttcttgttaaaagtttttcttcaaaattcactaactcttatggcagtgctacgtataatagctaaaaattggaaataaatgtccaataataaaggaatggttaaattatgttgagccagtcaatggaatgatcaccttgtagccactaaaaatgaccgctatgaaggctcagtagcacaatacttctggtactgtgttaaaatggccccaatgcaatgttataagagaataaaaatgtggcaggccaatgctataaaacattaaatcatttttccctttaaatgtgttaacttcccccactctgtgaccggagaaacgaagcaggcattgctcccggggtggcactctcacaagggaagcaggacacaaaaacatcaacttcttttagatttggggaactggagagattctctaagctgaggcaggagtgtagagaaataagagcaagactcagggcaaggaatcagtcctttggcctcaagctgagttcggggaaaaacaggatagaccccactctcttttcaatgtgaggatatgagagccaggaggatctgtgccttgctttcaggtgaactccagagaaatgtggagcatgtcgttcagcagctatgcgatgtggcaggagcagaggagaagtggtagagaggcaggcctgaaaggtgaaggctgacgtccccaagctacgttaagcagatgccagaacaggccggagggagatcaacatcagtgtctggaagcccctttccaaagatccagggccccatagcattaagatcaaggacgggatgtggagggagaggaggcaggagtagaaccctgatgctgaatatagaagggaaataatgagaaatcactgaatttggccacatttatcaggaagtgccaaaactaaaactaaaacccctcctattgtgtggaaatgcgcttgagctagaaattcagatgaactctaggaaaagaaaataaattacaattcaacagaaaatagtagtgtgtgtgtattagccaggcgtggtggcgggcgcctgtagtcccagctactcgggaggctgaggcaggagaatggcgtgaacccgggaggcggagcttggcagtgagccaaaatcgcggcactgcactccagcagcccgggcgacagagcgagaatccgtctcaaaaaaaaaaaaattaattttaaaatttttgtgattgctataaagctgtttgtacctttaaaagcagagtacgaatgtaccatgtagatgggtcacagcagtgatgtacctctactttccttttcttgtttttctctgctgcataagcccctcctccttcacccacagtccctcctcagcatgaaggacagttaggagaagcttgatctgctcacaactgggtctcagggtctggcaagaaggccccgaggaagcttgatatgcttcgctagtgacaagacactttatttttttgagaatttgagatttatagtttgtatttcattactgtaaacttcaagagctgctataaatcgtctcgttgtagattttgcagcagtgaatactgtcagaaataggaagaattgtggttagggcttagggtgtgtgtgtgtgtgtgtgtgtgtgtaaagagaattttatactatggtggtatcaattatgttggaattggatctgtagcttcttggtcgtttgggacataaccccttttattttgtgcttggcaaatcctttaaaaggagaagatccttctgggcttcagtttcctcatctgcacatgaaagaactggctaaaatcatgactagtccactagaaatgctggccctatttagcactgactttacctatcctctatgtgacttcatagattatgaactattatatattgtgcacaaacacacatcagttttctcattggttatcttttgaaaatggcaagctttcaaacataagaatgctgagggattccccagcatgtttgacttagacttcaccctgggcttgatagtctttggcaagcctagccctgagtggcccccaaatgaggttatatagaaccttatactaaactgttcccactatggcccagacggttttcattgtcatttttaagtctccttcttccttcctctcttttccagggcacatgctcaggctcaaaatgagtgctggcccctgccctgtgctaatctttacatttctctatctgctgaggttaccattttatacaatttttagaatagaataaaagcatttacatgacctaaatcaaaaggtctcctgccacgatctgttgtcatctgtgtcccaaggtaacctcttctccagaaatcgtacagagcttgggagttatcccacaagaaaaaatgtgaaaccaatgattggcatacttagataaaatgtgttttggccaggcgcggtggctcatgcctgtaatcccagcactttggcaggccaaggcgggcggaccacgaggtcagcagatcgagaccatcctggataacacagtgaaaccccgtctctactaaaaatacaaaaaaatagccaggcgtggtggcaggcacctgtagtcccagctactcgggaggctgaggcaggagaatggcgtgaacccaggaggtggagtttgcagtgagccaagatcgcgccactgcactccagcctcggcgacagagtgagactccttctcaaaaaaaaaaaaaaaaaaaggtactgcagttgaattttctttaagacaaggcttctgaaacaagcccaacatgtcttttcagtttggtacaaaattataggatatggtaattatggacatagatttttctttaaacccaagaacttttaatctatcaaacattgcttttaaaaaataaaacattcatctgattttttttttctttttgtgacagggtcttgctctgttacccaggctggagtgcagtggtgcaatcatggcgcactgcagccttcacctcccaggctaagagatcctcccacctcagcttcccggatggctgggaccacaggcatgtaccagcacactcagctatttttttttttttttttttttttttttttgtagagactaggtctcactatgttgcacagactggtcttgaactcctgaactcaagtgatcttcctgcctcggcctcccaaagtgctagaatcaaaggcataagccacagtgcccagctcattcaattttttatatttcaaaataaagtatttttcatagatttctgggaggcttaccattcgaaaatttctacatcccttgaaatgggggaagctttgtagcttactggtaaaaagcacaagttgaggtcctacagacatggtttgagtcctactcctatccaaccatagctgtatgacttggctaagttatctaatttcactaggcctcagctgcctcatctgtagaatgggagtaattacacaaccaatcccataaagttgatacaaagactgaatgaggtaacacaggtatagcactgattatgtggaaagactcagaaactatttggtaacatttttattcaattatatcaattgctgatttcaattagaaggcttgcatatcttcaaataacaacaaagtaaatagcatctaaaattaaaacaatactaaactaaacacatattatgcttcagaatacattttgttttactttatattttggggagagtgttatcagatcaataacagggaaatcaaaaattgattcccaggaagagtcagctataggtttctggcagcaaacctctagacagagtgttgtaatcgtgtgcctaaacaagtcacatgatgaacaacagccagtcgtgagaaaccaaaacaaatttttcttatccagaagtagccgtccaataatttaaaatacggaacatttaagcatcttttaaattaaaacatttctttttctagcataaatactaattttgaaacagctgatttgaatatgatgcctctttatccttgcttcaatttacagtgaacaacatatttccagatgatgaatatcatggaaatgctataataagttcttacatgaactggtgctttacagcttacaaactactttcacatatattcatataagctacgtagaacagataatattattcgtggttggtgaagaaacagcgtgtcagaaggacaaactgacgtactcagaaggtcacatacctgtggataacagagctggagagaatccaggtctccagacatctggtcccccaataatttcagatttcccagtgtggtatttcccataccacccacttacaggcaagcagtagctcttctacagttataagaagcatgaggggcactttgggaggccgaggtgggcggatcacttgaggttaggagttcaaagctagcctggccgacatggtgaaaccccgtctccaccaaaaatacaaaaaaattagctgagtgtggtggcgggtgcctgtaatcccagatactcgggaggctgaggcaggagaattgcttgaacccgggagatggaggttgcagtaagccaagatcacaccactgcacttcagcttgggtgacagagcaagactgtctcaaaaaaaaaaaaaaaaaaaagaacatggtaagtttgaacaatgttcaaaattgttgttttaatgtagtttaatagcatatttttaatgcagtttaatattaaaacatagaagcattaagtcaactgactattttcattgtgtgtgtcaactgtttgttgctaacactataaaatgcactttctcacttcctgactttctaccaaagcagaaaaattatgcatgtcaagtttccatgtgcaaagatctgagaatctcctcagaaaccattcattcatggcacacagtgtttaaaaatgtgtctacctggatcagttggtcctatcttttggcttagtcaaacatggcataaaacagtaaattttagactgtggattatgattttttttctctctgatcgccaatcacatttgagctgtcaaagaaaggtttcaagtgggttgggcagctggcttcaactctgagacagttttacttattagagtgaagatttgttttttgttttttttttattctgattcccccggctgttctgaggtcagcatggggtaaacatgagtctgaggctctaggtcatgtcagaacatgaaggctttgcaaaacttatttctataaagaattatggctgttgagaaggaaccagaggaagtgagaggaactgagaaattgcttaggggaattgttgtgaggctggattccaacgctggcagaaaaatacttagaccagtccagggagttggcaatttgaagactcagatttctccagggtaggagggacctggcagagggcctgtattctttggtgaggcctggctgactgcggactgtcatttccctccatctgctttgggctgcattctattctttttcaaatagccaaaattatacttgttgctaagaatgtgactttggcagggaagttctgagtctcagaaaagtagagaccagagaagtctatggagagagaggggtaagtttgggatggcacatcatggcacctaattagtgaaaaggggtcaccccagggtggcaacctgcaaaatatgttgtttctttcattttttatttatttatttttttagagatgaggcctcattctatctcctaagctggagtgtagtggtgagattatagttcactgcagcctcatactctcaggcttaaggaatcctcttgcctcagcctccaagtagctagaactacaggcacaccaaaacatctggataattttttatttttttgtaaagacaggtggtctcaaatttctagcctttagaaatcctcccgcctccgcctcccaaagtgctgggattacaggtgtgagccaccacacctgcccaagataagctttttaattctgcctttaccttgcctaacacaagctcacagaacacaagctcacagatttgaaattaagtgaaaatatattttacagttgcaattaacatagggagattaacaagaatgcagagacgccaggggtgaggggaacataaaatatgttttgagaatgtgtgtgtgtatccactgaaagtctaaatgtgtgacatatgtaccattttgaaaatgtgtctgtcaaaaaaatgagactattgagagatcagagctaaatgacacaggtttatttgaaatttgatgaactaatttcccatttttcacaaagcaaacttgaaattgccagtctttaatgtgctctgtcaaactccaagtgtaagatacaatctgcaacaggtgctactttaccataatttttaaagtcacagatcccttttcctttcaggagcagctcataagatcactaggaaatgttctatcagaaaatatcttgaagtttcttgtagccctaaaatactataattttatttatttatttatttatttatttattttgagacagagtcttggtctgtcacccaggctggagtgcaatggcatgatctcagctcactgcaatctccacctcctgggttcaagcagttctcctaccgcagccacctgaacagctgggactacagtcatgcaccaccaagcccagctaatttttgtactattagtagagacagagtttcaccacactggtcagactggtctcaaactcctgacctcaggtgatccacccgcctcagcctcccaaagtgctgggattacaggcgtgagccaccatgcccagcctaattttattattttagaagtccagatttttaaagacaaattactacagtaaagaaaaatattctttcaggcttccaaacacttaaaaacacatctttggaacagtataaaataccggggccaggccccgatccaggaaattatgatccagtaagcctggaggtgagtcaagctctctgtaatcttgcaaaagtcagtggtgattttgatgtgtagtcacaggtgagatccactgtacacactgcaggatatgatggatgctgtagtgtgctgcctagatcccctcaccatgggatcaagacatccatcccatcagctactgagcatgtaggccacggaatactcacagtgaagtcctccaggtatgaaaagtatggagtcctccataggtgaaagggacttgcctcactcaaggtcatccccactccctagggtcagcctgcatccaatggctggtcaataggggaagggaactacaggcccaacacatttgcctcagcttggggaagccctgaatgggtttttaatcctaaccatcaatgcactagagtcatgtggtgtgaggggaagcattgggttgaaagtccaaagatttaggctcaaagctgttttttgcctattgtggttagtggcctagacaagtcacataacctcttgaatctcagtttttaatcctaaaaatgggaacagcaacaacagcaataataacaacaataacaacaacaaatacatgacctactctcaagtgtagttgtgaagattcagtgagataatgtagttataaactgtgaatcacataaaatgctgatagttactgttataatatgtccttaagtataaaagtccccaaatattatgtgaaaaaagatatcaaagtaccacatgacactggaagtaaaaagtgttttaattcccaaatgcatatgcacttattcttcactgcgtgcattcaatgacttaaagtaatgaaatataatggttttgcttatgtgtttgttctgctacttttaaatggagctgaaatcagccataagaagaaattgtccctggtgccaagacaattcaatgtggaaagaatagtctttttaacaaatggtgctagggcaactctatatccatcaacaaaagaataaaaagttgggcccctaactcaccccatatataaaaagtaacaaaatgagtcaaatatctaaatgtaggagctaacactataaaattcccaggagaaaacaggcataaatcttcatgatcctagatcaggcagtgatttcttagatatcactatctatattccttagataccaaaaggacaagcgatacaaggaaaaaaatagataagttagcttttatcaaaataaaaaaaatttctgtttcaaatgacaccagcaagaaagtaaaaagacaagccatcgaatgggagaaactaggaatcatatatctgatatgagacttgtatctagaatgtataaagaattcttacaactcaaaaataaaaagtcaaataccccagtgaacaaatgggcaagggatttcagtagacatttctccatagataatacacaaatggccaataagcacacacaaagatgctcagtatcattagtcattagagaaattcaaatgaaaatcacaatgaaataccatttcttaaatggtatttcacacctactagaatgactataatcaaagagagagataataataagtattggcaaatacagagaaactggacctctcatatactatgggaatataaaatggcagagccgctttggaagacagtctggcagttcctcaaaatgttaaacatagagttagctataacctgacaattctacccctagagaaatgaaaatatatatctgcacaaaaactagtaaaggatgtttatagcagcattatttataataggcaaaaagtagaaacaacccaaatgtccatcaactaatgaatggataaatacaatgtggtatatccacatcatggaatattatctggcaataaaaagaaatgaaatactgatacatgctataataatagataagcttcaagaacattatgctaagacaaatcagtcataaaagaccccatattgtgtgactccatttatacaaaatgcccagattaggcaaatctatagaaaaagaaaaatcagtggtagccagaggctaaaaatagaaggaatgggtaatgactgctaatggggtttctttctgagtggatgaaaatgttctaaaattgattaggtggtggttgtgcaactctgtgaatacactaaaaatcactgaattgtatagtttaagtggctggattatacagtatgtaaattctatctcagcaaaccaattattaaaaaaaaaatcccatgagctgaataaatatgacatacggtaacaagaatttaaatataacccatagcaaaatattatgtctgttttgcttttttaagcgaacacagctcatagtctgctattaaataaaacaaatcacaaacctcatgtgtgggaaacagactggccaggaagaaatttttgtgccttggaagaattcaaattccctagaaagggcagtcaaaaatctttagcaactgactcagactaaaggcatcaataacctattgctggctgaaccaaatttaagctgctaggaaatgacagtactttaaaaatgggctttgcaaagtcattttagtaataaatacaagaacatctgcagcgagaactctcagccaaaggctgttacctgtgagctttcaggatcctctgggcaatggcatcgcctatcttgttgaacacaactttgtcatcagcacagcttatgaaaaactggttctatgagaaataaacaagacaatcatgttagtctttattttcttagcaatatacgtaagaacaatactgtaatatattttttaaaatgtttcacacagcagatgtgttctgatcactgaaatcacatcaagaaagtcaacgacacagaaaaaaagccgcctcatctcactcagggtctcatctgattccaggtcatatcacctgtaacacttaatcaagtggaaagttacactatattatttcaccatgagaattccttataggtgattttctaaattacattctcagaatacttaggaacactgcaaatttaatcaatggggaaactagtttttttcagattcacatgttgtataaatgcttatgattaaaaattctatattggcaaacattctatctcatgctaagcttgcttttttaacagagtagatggtaaagcctggtctagttttctccaccctttctccattatttcctggtatctgctttcaccttgtcttgtttgtctgggtctcttattatctctgaacttctattttaagtagcctcaactctcttttgtatgttgcatatatataagccagttaataaaataaaaaatgtttttttcctctaagtacttctgctatttatatatctacaaaatagtctttaaaactgttactagaaaacaagttacaacattatcataacaatgcaaaatattttgttgctgcataaaggaatgtgaaaaatttggtgcaaatattactaatgttatgtgttcaaatagaatagattgttataacacatctgtaatttataaggacaattatcacaaagtaatatttgctaatcatctcaaggtaaagagatatatatgtaacaactcgtaattatcatccctttgtggcattatcatttttatgactatataagcttttatacttaagtgcataaatctgtaaaatgcctccagaagacaaacttacaggaagacacggtgcagaaagtcttttgagaatgtgattccccttagggcatcagacaatcaaaatctcattggcaaccaaaccatgtttctttttctgaattcatattataaagaagcttagcatgcctcagcagctgtaaacacagactggctacatgtcatgtcctttacttctccttttttggaagagtcggatgaatgctgactgcttatcttgactagaggagtgtcaaccaggtctatgtcccaactatgtatacctacatggcgttactgacatcatttaatactactgtcacattaaaaagaaaagctgattattttattttttattttttttatttttttgagatggagtctcacttttgtcaccaaggcttgagtgcaatggcatgatctcggctcactgcaaccttcgcctcccaggttcaagtgattctcctgcctcagcctcccaagtagttgggattacaggtgcccgccaccatgcccggctaatttttttgtatttttagtagagacggggtttcaccatgttggccaggctggtctcgagctgctgacctcaggtgatccacccgccttggccccctcaaagtgctgggattacaggcatgagccaccgtgcccggccagaaaagctgatgttaatgctactaaaaagagatgaagcaaaatgattctgggcaatagatgagccagccttcacatctttccatctctatggtataattgtttaaattaataatactaatagcattactaagctccagactttatgcagagttcgctcattttccactaatgtcctatatctattccatgatgccattcaggataccacactgcatttagccagctaatatattatatttaacttaggtttctctagccaggctcatgaaacaaataaagctccaattcttccctgcttgtctctaatgaattgttgctgtgcagagcgggagagggccaggacccaaggggaagaaaaacagggctagaatggttttcctcagttaacccattcccctatctacctttaaaaaattcaatgggaaagaaaagactcaaataaggaaggaaattatgctatgatttattttttccattattgtgactttttattttctcagggtttttcaagttctctgaactatttttatattcactttgaagagtaatttaagttcccaaactaaactcagtgtccccagattttctcatatgctctaaaaattctgggatgaaaaaaagcttcctaatcaatagtagttcacacaggattgaagaaggtggtacctgctcttaatgttctcacatcttccttttccacgttcttttccctgcactctccctactccgccatgcccaaaccagtggcatccagtggtctctattttagcaactcacccctgtgtgtgctctcctgaaatagaacttgcttcacacttaaaccctccaacccaagcgaaaacaaaacttacctatccatgttggggtatttctgtctaatactattacaatgagttgatgatgcattttaacagcaaagatttgtgagactcccaatagaatcttgagttaatgacaatgcagagccagttccaggtatgcttgggaggtcaaaattcaggtgatatgaaccagagcttctccagcacttttcacgcctcaaaatatacttattaatatgaggggtcctaagtttggggaccctgaaatctctgcatgatatttaagggaaggcagtttctcacacgaatttacatgagcaagacttacttcgatatagatatagtgcctgctgttctctatcacatggacgtaagcggcgtggatggactcttcatggtactttataccagcagaccaatcagcagcagagcggagcaactacaaggcagcaatcagaaatgaacaagtattagcaatggagaggacatcagatatattaatacaatgaagtcactcctttttcttccagacgactgaatgattacagtggcttgagtgtcatgtgtgaaccaaaggagagtagtggggtggggaatgctgctaaggaagaggggagaaagggggcaactggtccttggatgtagtccataaggaaggtcctcagctggaaatcacatcctgaatataccctctttcatccaggattattttcattcaaaactggaaaccacaaattgtggtttctacaaagactatttcagaagtacctcttctgatggctgtgagtatggtaaccatttgtattcctttcctatgacagtccctcaattataccagaatccctgttgttctggtgcatttattcagagcacccatctttactcttaaaagggtactggtttggaccatatggtatggccatcctagctctgacttaacaatgtgattattccttttcccctaaatagatattgttcagattaatacattctaaaaggtaggtcatttggcatgtgatcttcattctacctttaatagctgtctgttccatggcacgccactttagtctaaactttctaatggcataataaaggaaattaatcacaggaaagagaactggggctcagagaagcaaagaaacttgcatggtgtcacagaggtactagcatcagcatcacagcttgaacttgctttttgtcattccatatccgaagtttttctactatgccacactgttttgccacttcatcacatgtgtgtggcatgccagtcaatttgggattgatcccatcacctcagattaaacccatcgaagtggagctcctgacttttttctctaaaccatttcccatttcaaataccccactggccaggggcataccatcattctattagtctttggcatgcctcttctccttagcgtctatattcaatctcacatctacttcagtttattctttggaggatttctcagatttgcctctttctcatcgctcacattgcctcgctctacgcagacactcacctgtccaggctgtattactcgagcttcttctcgctcagacacctgaatataggttatatacactgatgcagagcaggactgtctaggttcaaagtctggctcaactatttactggctgttgatcgtgtttcttaacctctttgtgcctcagatttttgttctataaaatggagttctactttatagggtcatagagaggattaagtgaattaccgtgaaatgtgtagcaggaggcctggtatctattaagtggttataagtgttatattaatgagcattagaagatgtgtttgagctgtggcaggtcatgtcagggatgctgcagagcagactgtggctgtgcacagaagaaaggatgagagaacatggaaagaaggtgttctcaacactcagcaaccattggtcatcacttttttccaacattctaactagcattgcagtatgatgttggcatatagtaggtgcttaaacaatagcatgacacacagaagaattagtataaaaataatacttgctatttctggtttgaaatgaatattaaaactgtcccttataaggtcaactgatattgaaaataaaaagaatgctcccatactcattaggaatatacaaagcgatccaatacataatcagttctatgtctgctgtatataaaaggcctggaaaaattcttgttcaaatcaataactttaaaattgcaactatacggccattaaatccaaaactcacacttactaaaaatcgctgactgtgccatcctcagtagtgttatttctttatccaatatgaggtatttattacaaaatatcgccaatcaaagcattaaaaaaattatcagatgaatatgtgcaacaaaatttcaaaatttaattgtcaacatgaatatattaaatatcatagaagagaactcataaggaaaatttagataaatattatccacactggaaaaatatcatgattttacatcatctccaaggagctgcattattattcatcaggtagaaaaaacaaaggttgaagaaatagaagttttaattcttagtccactcaaattaatgtttaattttgttactaaggaacatagcactgaaaatgcaggctactttgagaagattctcatgctatcctgatgtaattctatacaactctggaggcaacgtatacaattgcagattacactggaaagaagggaacctccaggattttttttttttttttgagacggagtcttgttctgttgcccaggctggagtgcagtggcatgatctcagctcactgaaacctctgtctcctgggatcaagtgattctcctgcctcagcgtcccaagtagctgggattacaggtgtgtgccaccatgcccagctatttttttttatttttagtagagacggggttttgccatgttggccaggctggtcttgaactcctgacctcaagtgatccacctgtctcagcctcccaaagtgctgggattacaggcgtgagccaccacgcccggccggaatctccatgatgtttaaatgacttgtccaaggtgtaagagaatttacatataatttaaatatcatggaggttcagtttcctccactgtacaactgagacctctccccatcccctaaagctgctgtgaagaaaaaaatggcataacaaacacaaagtgataataatggtatgtggcacttagtactagatattctatatacagtatgtccacctctgtaaaaagttataggcaaagtttataacccacccttgctggtaacatctgagtttttccctcgaatccaaaaaccttatactttctttcctttctcactctcaaaatttgctctgactcaatgaactcattcacataagattcaataaattcattcacataagatacacatgaggagaattacatcaatgtcagcttgcatatgaagtctaatagattcagagtggcttcctggacagctgggttaagaggcgattcttgaaagcaggtgcactggggaagaattctgagattgatcctcaatggctttcatggaaggggacgcctgaaggtcacatatttgccattttttctgtgaaggataatggtaaatgtttctctatctgtaggcatttaagtatttaaaatattaaagcttcaagccaaaagaagaccattttatggccaggggcggtggctcacacctgtaatcccagcactttcggaggccgaggtgggcagatcaactgaggtcagcagttcaagaccagcctggccaacatggcgaaaccccgtctctattaaaaatacaaaaattagccgggcttggtggtgcatgcctgtaatcccagctactcgggaggctgaggatggcgaatcgcttgaacccaggaggcggaggttgcagtgagccgaaatcatagcattgcactccagcctgggcaccaatagtgaaactgcgtctcaaaagaaaaaaaaaaaagaccattttatatatcagcctgtgggagagcataataagaaaaagcggagggggctccctgatacctgcaaaaccatcaagtatgaggggtttcctacctcctgaggggcttcagcatcatctatcccattgcctgagtccaagccccgtatcctttacttacaataaaaactcattaattaaaaaatgtcatcatttgtggctaaacttgaaacatatctttcaagcaacacatgaagaaaatcacttgggattgttattcatttactactattctaattagttaaaatctccctatcaccacaagaaaaatggaaaatacgaatttccttcttgctctgcctagaccattgaactacaggcagggaaccctgaggttatataaaaatcaacttaactgctttaaatgcttgatggcctaggaagttttatcaacagtcaaataagtcaaacccattgtattcgtctgttctcatgctgctaataaagacctaccagagactggataatttataaaggaaagagttttaatggactcacagttccacatggctggggaggcctcacaatcatggcagaacacaaaggaagagaaaagggacatcttacatggcagcagggaagagggcatgtgcgggggaactgccctttataaaaccatcagatctcatgagacttattcactatcacaagaacagcacgggaaagacctactctcatgattcagttacctcccactgggtccctcccatgacatgtgggggattattacaactcaaggtgagatttgtgtggaaacacagagccaaaccattatcacccattttgattgatttccttttgttttattttttcacctttttccattgccactgagatttccttttgttttaatatttactctcttcattttcttcactgacttcaccaacttgtcttgcatttctgttttaaaccaatgtaactgagataaccctcaaactgttccctcacatgcaaaaatatagcttatcttaccgtcccaaatgtgctgggaatcaaatctaatctatacttttcaaaccacgagtttgaatacataattttaaaatatataaaaaatggcatatttctgattttatggtttaacctcaaagctgtaacttggactagtcattttcttcgtgctacgtcttattttttaacctaaaatatagccttctctttaaccacaatccctaatcaccttccatcctatgggcccaagtcaaatgtatggattaaataacagaaatttctttctgaaggaaaacctttggatctttcttagtatttgtcccaaattcccttcctttctctcatcataatgcttttattccctataaattcagcacatatatgaattcctttttatttccctgagattccaagtcaatcatggaacaaagactatttaggacaaaagcactttttatatgtttcacaagcagaggccaactgtgtagaagctcacaagtggtatgcattggggagagaagggaagcctctgattgtcgggcctttttcttccagactgtactgagaacagcaggcaaggagcatcaagaaattgacctagttcaagaacctgtctcatcttatcaagctctttcttttcatagccacttttctagttgagtgtcagccattcatatcacagtgtgcagttattcacataggatgattcctttcctgaacaaaagagaaaagttaattttgaggctgaaggacagaaagaaaagataattattgaagaataggacttaaggtgaaagaagtcctaggaaacacagtattagttgggtgttcttgggagccagaaagaagcaaaaggagagttagggatggatttggggctgtggcaacagaaggtgatacccaaaggcaaacaggacatgaaactttgctctgctagagccccagcagttacaaccatcctggtcttactggaaacagtatccatagctaattaacctcaggcactgaagccaaactgcttagaagcaagtcatccccaccacttactgtttgtggttttgagatggagtctctgatgcccaggatggagtacaatggcgtgatctctgctcactgtaacttctgcctcccgggttcaagcaattctcctgcctcagcctcctgagtagctgggactacaggcccatgccaccatgctgaactaatttttatatttttagtggagacagggtttcaatacattggccacgctggtttcgaactcctgacgtcaggtgatctgcccaccttggcctcccaaagtgctaggattacaggcatgagccaccgcactagacccccactagttaccgttattttaacctctcaaagtctcagtttcctcatctgtagaaacaggctgcacaggagtttagcttacagactgctgaatgtatatgagataatgcacaaagggttagcacagtgccaagcacacagcaaatgccctgttcatatcagctcttctagccaagacccacagtaacactcacaaacgtgttagtccatgaaggcctggcccatacatggaaaacaactcccatggtaaataacttccatggaaatggacaaggtggattccttttacccccacctgctcactttatttttcacctatctactttattctctcacaccattctgggatacaaaacattttgctgtcctttcagatctaacagatccttgggaatatcctttggacatttattccaagcgtgaaaacaattttttttcagtggtataatttggatgttatttatactttcttgaaaattttctttttttttccttcctctctccctctctcctttttccctttcctcctttctcattctttcttccttcctttctttgttcctccctcccttccttctttccttcttttcccataagtaggactgaagacattattccagtagagttatttccatataggcaggaattctcagcatgactgtccaaggaatggtttctactatgagctttaaaaaggattgttcccatgtgttgaccccatgttgatgctgacacggcattcagcattttctttcagcttaatagacatgtcaaatatcctctgtctttataatatatcttaaatgccattaagaccattctggaactgagtttattctagttccttcaccttctctgtgtagaagcagtttcaggaccatctctcccacttcctcctgctacccatgccttttcctgccatgtcttctctgagtgctcttggcaggcttctgagaaggcccagcactgaggggaaacatccaagattcttttaaaagtacagtggaagctgctgaagtcagctgtcaggtctagataactttttcaggagcagcaattcgtgctggtgggcaggcatccatactgcctgccgtagctcccctctccctggctggctgtgtctccccctctggaattgccagtggcgtgtgaccaatgtttctgtattaaaaaaattaataactaggtgcccttctccagaagaaagaataacttgaattttatctattatttactttattatgtcaaatactctttctccccattccaatagatttatggcataaaaatttctatctagaacaagcttggtgacctacccagagaaatgttaacttctttgttgcaaactttttttgtttttgttttttagacgagttttgctctgttgcctaggctggagtgcagtggtgtaatctcggctcactgcaacctctgcctcctgggttcaagcgattctcctgcctcagcctctcaagtagctgtgattacaggcatgcgccataacgcccagctaatttttgtatttttagtaggacggggttttgccatattggccaggctggtctcgaactcctgacctcaagtaatccacctgccttggcctccgtaagtgctgggattacaggcctgagccactgcgcccagcctgttgcaaacttttgaaacactagcgaaagcttgaaggctgtttttgatggaactcaaactggtatactcttctaaatgctttgcatggattaatttaaccatcaccacaatcctgtgagacagatactgtcatttatgttttttaaatgaatgaaacatactgcagagtgaagtaattttcccgaggttacacagctcatatgtcacagagctgagatgttaacacagtctggctctagaatctatcccttaattgctaccttatatttttcttcacaattaaataagcttgtggcttctaagttacattatgaacagtcaactatgttaaaatcttgttctcactcatatgtggaagcttaaaaagtcaatctcatgcaagtagatagtagaatgatagaaactagaagctgggaagggtttgtgtaggcgggtacagggaatagggtggagataaagagaggatggttaatgggtacaaacatagaaggaataagttctagtattcaatagcagagcaggttgactatagttaacaacagtgtattggtatttcaaaagagctggacgagaggacatgaaatgttccaaacacatagaaataacagaagacttgagatcatgacactccaaataccctgaggcctctttaataaaatcaatgcaaatttacaaatataaagctgagaacaggtctagaaaaggcctgggtggctgagggtcctaaagctaagcaagggcctgaagctgcaaggaacatgagttcctgaagggagcaattcattccctacttacagccttaactccagccagtctgtaggagattttactttaggcactgagatggcaaaaagctaattatagaaatagcaggttttcaggaccagaggaataaaataaattataatcttataatcttggaatttaagagttcatcagtgatgtcctagtttcttaactcttatccttccttttaatttttgtcctatttatcactgccatgtggctaaatgtacctatgatgttttaatttacttagatattttccttttctctcaaagatccatagaaacaagtttaatgatcaaggtaaaaattctgagcaatggcttctatttctatttagtgataagtgtcattctaactactttaaaaattaagaagtgtatctgtggtggccatttgagttttattttgtgagggatcataactatagcaggaggattaaatagaaagtcattaacacctgtactttgaatgatacctcttgtatgaaagacaatgaatgaaaattttccctttaaatgtctgaagggactcagatcagattcataccaaacataagtctttcagatgacaaaactgggctcagggaggggtaatggcatgctgaggccacatgctgctatacaatcttcataccacaccaccttgtgtgcttttatgatttgttagcgtgaaaatgcatgttattatatttagctggatatttccagcagcactgcctagcgacacttttatatacccattttatatatccattatcatgctgcaaaatttatattaccaagaactagatgtactacaggagctacctgagtcctttggtgatctcaattagtgccctggcccatcagtcatgacacagttcctatggttctttggagactttgtgacactaaactatctttaactttttcctctgtcccaaattttcagttagttcctagtcgtgatgtccctttgtctctttcctcaaaaatacctcctatttgttccttctcttcatttctagtttaggacttaattatatgtcagaattactgtaatagcctcttcacttgtccccttgctctcattatctctctagtctaataagttcttcatgtgtataaacatttggtctcaaggtatttgtttggaaagatggaaacagataagaatgcataaaacaagagattctctgtcaaataagcttgggaaatgcgcacatcatattccttcttggtggttttataatacactgtagcataaaaaaggtgctaaggagtcctgtattaaagaattctgcaaaaccttatctgtccatggaaatctttgtggaatagttatcagcatctcacaggtaaattcagtttggaaaactctctcctccattaatcttcattgaacattcctgcatcatgcttcttgcccaatcgaaaaaaaaaaacatccaaagttcactagcacttctaggaccaggtccaaattcactaggacagcactccaggtgtagcccccaccccgcccccgccctggccttatgctgtctaacttcatcagtgcctctctaagagcgaatgggttactgcagtcagtccttttgtcttctgagcaagcaggactattccttagagtggacacccagttctgtccctctggatttccaaactcttacagcatgctggtccttactgtcacaccagcatttactcagagaccataccttgcactgtaactgaattattcatctcagctatctctccccagctaactaagtttccagaggcaaagaactcctttgctgtctgccctctcgacacccaagtgtgctttgatgacttcaccatgcaaacggacaacacttagtaaacatatgttggctgaataaatgaatgaatgagtgagtaagtcttgttaaatatccttggctttgtagattcttgagtccaggccacctgaacatgtgagggattaacatatgagcttatcagatctagtctcatttcttttcttttagtttttatttttattttttttttttgagtcagtctcgctctgttgcccaggctggaatgcaggggtgcaattatggctcactgcagtctccacctcctgggctcaagcaatcctcctgcttcagcctcctaagtggctgggaccgcaagcatgtgccaccatgcctggctaattttttaagaactttttgtagagatggggtctcactatgttgcccaggctggtcttggactcctaggctctcctcctgccttggcctcccaaagtgctgggattccaagcgtgagccaccacacccactctagtgtcatttctcacacaacatcagtgatgcggaaaaagcgaacgaagagaagcattttatagagtctctattgacctcaccaggcagcaggatgagactatgtgagtcagggctttaccaacagtgaagtggaaaatatatgcatatgcaacgctatgctaaaacttccttcattgattacaaaaatacttaattcccagcaatccattttcaacagatacttattaacatcagctaactttgaaaaattgaccaccacgtcaataataatgcaagttcaaatcttaaattcttattttcctaataacaagtttcttattttatattctagcattggtaattttttctcctctacgtagaataaaattaaacaggttcataaaatattcatcaacttacatataaatcatagctatctctatgcctctgagtttaaattagttttctttttagcctgggatgactaatatttgctgccgatatttctctcaagcagcttatctttttttttttgagatggactcttactctgtcacccaggctggactgcagtggtgtagtctcggctcactgcaaactctgcctcctgggtttaagcgattctcctgcctcagcctcccgagtagctaggattacaggcgcacgctaccacgcccagctaatttcttatttttagtagagacagggttggccaggctggtctcgaactcctgacctcaggtgatccacccgcctcggcctcccaaagtgctaggactacaggtgggagccaccacacctggccttttttaaaaaaagttctattatttgatctacagtctgaaatgtcttatttcttatatacacatacctccaattgcacacgatgcaaaataactgatttaggcacttcatttatataatcacattccctaggatccatgtctgcattatataagtccctactgatggtccctactgatgatatgtagcagtagcagactgctggactttacttaaacaattcttctgatgcccatattgatgacttcaaacaaaaggcaatgccaaaggtggcccatcctacttctgtccccacatgatctcaagatatttgagctgtagttggtaaaggaagcagattgggtaacactggaccagactaggatttcaagctccacctctgttgataactagctggccggccctagataggcctcagagccccactaggtctgaattttcttatttgtagtttgagatggttaaactggatgtggtaaactgttgtgactctattaagcaaattccttattccattaaaagggcctctagaagacatttggttaatcaggaactaaaattagactgaactacaactagcttcctagctgctaagtttcagccacattcctggtgcttaggcagtatcaggtccaggtttactgggtatcatgttgctagggtcacttcagaaggaattacaggaatagccttggctgtggccttttctaaggacatgcatttattatatttataagagttttaaaaagagactgaattgaatccatttaacataggaaatataataacaagtattaaaagatccatttagttttgctttagaaaagcagtcattgaaaaatctgaagccaatgtaataggcccttggtccaataacagtaattttactcagtagcattttgtcaaaaagaaaagccagaacttacttacctgtacgttagcatggacagacccaggcacttgatatctcaactcatgggctgttgtttgagactttggaagcagaaaaggataagaaagggaccgatattttgatttcataatctaaaataaagaaaaaggataaaatattcaaatgagaaaaaagattcattctccctactttgtgattataaaagaaattcatgcccaggtgcagtggctcacgcctgtaatcccagcactttgggaggccaagaagcggggatcacttgaggtcaggagttcgagatcagcctggccaacacggtgaaacccccatctctactaaaaatacaaaaattagccaagcatggtggcgggcgcctgtaatcccagctactcgggaggctgaggcaggagaatcacttgaacctcggaggcagaggttgcagtgagtcgagatttcatcattgcactacagcctgggtgacaagagtgaatctccatctcaaaaaaaaaaaaaaaaaaaagaaaaagaaaagaaaagaaattcaggttaatttgaaaaagaaaaagaaaaatgttaatggtggacatttctaagtgaagggctacagattatttgtgtttgttttctacttctcacagtcctgtttttaccttttgtaggggaaatattgttttatatttgtaaagacaggttaaatataatctgtagttacagaactttataattgcaaaaatgagactattgttttataaactaattttttactgattatgttctagatatcttgtcacagcaatatagtgggatatcattatttttaataacttcatagtaaaatggtataaaagaatcatttgtttaataaattcctattagtaaggatttctgttatttctaattttatttgaattattagaagccatatcaaaataaattaccttattggattatggctttagtttgaatacccggaaatagtttttctggatcaaagattgcatactttaaaaaagacttattggtgttgtacaaatttatcctccctggggtagcatgtatgagcacaccacaaaaaccaccccaaacctaactacaggtatcagcagagacttttatctttgccagtatagcaggttaaaagtaacaccccatttgtttattcatccatctcccctaaatttttgttaaaaaatttcaattagaatgtccactaaatttttataatcattatgtgaatgaaaaacaaagttagactctaagtggttgataaaactaaattctttttccaaacgaccaaggggaatcatgactcattatcccttcaagtaaataaagtgaaactttaataacacctgaatatgtactttttttttttttttttgagacagagtctcgctctgttgcctaggctggagtacaatggagtcctctcagctcactgcaaactccgcctcctggattcaagtgattttcctgcctcagcctccagagcagttgagattacaggcacccaccaccatgcccagctaatttttgtattttagtagagacaggttttcaccatgttggtcaggctggtctcgaactcctgacctcaggtgatccaccagcctaggcctcccaaagtgccaggattacagtcgtgggccaccgtgcctggcctgaatgatacgtacttaacttatgaatgttaggtttgaatgttatgtcaagttcttacaagtaatgaggacacaatctggataaaaggaaaatggccccaccttcttaatacttcttggtttgctcagaaccagctctcagaatcctgtaccaatataaacccagtgcaattccagtcccatccaactggatgggactttaaagctcaagccctctcatctaaaccaggctcctatccccctataacagccctgcaaatgactaccgagcccaggctactaaatgcttagtcaacactgtgtccaagatgttaacaaggttaaaatcaggacccacacagcagcacctgtccctaggcactctgaattgtctatggtgtggacattcgggaatgtttccctttttttttgcccagatgcccaggcacccggacatcaatgcagccaacagcagagcagtgacacagttgtggccacaacagtctcttcttgctaccagcctcctctaaacctcttctctagttaggcctgcctctcttcatgtggataaatcatgatagcaacatccaagtacttttgtgaagttccagcgctggatgaagtgacgtgccacatcacgagccgccttcccgtggactgcagaggcaatgtcatgccagggcatccggggcgtggagtacctgtcaatgaaatctgcccgggtgcaccaggcaaggatcagtcattaacttcagtgttggggcaaagtctctctgactccaactatgaaactaaaaggaaacgtgggttagtgcccactaggtatatatttcttggcttgcatagaacaacatttttataatcaagggaaacagatttcacattcagggacatagtctcccaggcacttccccacatatgtttccgtttcacttaggattagataatcactagacatggcaagatgtgagttggtacaaattatctaaggctgtgtatttgatattatattttttattttttatcctgttgaaacaatggcaggcaatgccatctctatctcctcttaaacatataaacccagtgataacctgaaaatatgccattctaacgctggaaatgcaggaaataagcagaatagaagatgatcaaagggagcctaccatttcctgaaaaattactgattattgcccccaaaatatgcctataaaaatctggatttttcagacagttcagctctatttcatgttcttttcttattataactgaaaaaaaagtccttaagcacatgctaatgactaaatctagtctccaaagttttaaaaaattttcaaaaatcaacggaagcaaaacaaaaggcatttagatcatgcacatgtatacttgctgagatgttcaaaggtaaaagacaaaatataaccagcaccccaccattatgatactcaccagcaaaaggtttatcaagttgaacccagtctttgaagacgaaattgcagtagtcctttccatgccagaatctggtttccccatgcagctctcccacacctgtctgtaaactacggatggacccggtatctgtgaatgcagcaagaccccctcagagactgtggttcaggtgagtcccagaaagggaggctcaactctcatttattaaacacctaaaagcttcttaatttcttaagacacaactagggtggcatctgtccattctattacaggctgtgggctaacaaggttttacagtccttacaagtttacttttagtgggcagttagggctacaacaagattcatcattaaacaatgaaatttgaccttctcaggcagttgagtaacttatttccaccacctaccagatcactggaagaactatcacagaattaactgtgaataaagaactcacaaggtggcactatgagagcagtaaagctggtggggggctttcaggggcagagtgggaagggcggggaggggagaggtggagaaacctgagacgcaggggcaataaagacaccatgccacttctttttcctcaaccaacatggtgcacacctgatgcataattcttttgcattaaagcaagaacctcaaatttacagatagcccatgttccagccctggaattaattagctaagtgacactgagcttcagttttttagatcataaatccattatgcgtaaaatgaagaatttggcctagataacagctaaaatctgttgcgctttaacatttatatacttcaaatcatagatggcatttataaaaaatatggtaacaacagatgaaagcttatgatataggtgcaaaagcagcaatctactatagcatttcacaaataactgtgccgagaccattgacttacggctaaatacaaagacaatgaagtaaaaagatgcagaattacaaatcacaaacgcagcacttggcacaaaagaggcatttaacaaatagacactgaatgcaaaaatatgtgttgaatgaataaatggtactgcttgcagtagccagtgagaggactacactggtcctgccaccaacacactgtcccagaactgtctttgtaaaatgcactctttgcttaaaaccctggaaggttcacatactgcctataggaagctcaagtcctaagggcttagtgtgcatagaagactcttcccaaactggtgccaatctatctttctagtccttgtttttccccacccaaccccaggccccatgcaaatcacgtgtttcactgtattataacaggtgtggactgccatgtctccatgcagttggcacattattacttctacctgaaatgctcctttctccctcttggcctgatatcctaatcatccttcaagagccacattagctatcacctgccatctccccataaggaagaggcagtcactagcactgctgtcatcccactaacaactgccccaacacctctgactctgtgacgcaattgtatcaggatgctcccctgcccgcatcaatgcctcaccagtctataaactctttgggagtgggaaccaaatcttctcactgccagtagctccaagcacccaggcaatcaataaatatttgcagaacaaatgtttttatgtaatcaccacacacaatgctaatattctatctcaaactgaatcattaacctttcaaaggctattaaagttttctacagaagaaaaatgatttaaaatgccatagattagcaaaatgaaatcatgttaaaaatagacttctattgacttctcccagtgatttattttcctgctttatgagactgaaaggccaaagtacgggtaggtctgtttgctcatctataggctctttattgtttacatagcactttgttaaaagaagaaaagagggtgagaaaagaaacaaaagggatgaaaaatgagataaacaatatttcaaatttcaaatataaaatacacatatacaatttgctttcatcaactgcaaaactctaagctaaggctttacataaacacatatacactcatttaaaaattatctttcacctaacaaccagttatgataaggaaaataaaggaaattcttagtctcaggaaattatcttggtactaattgaattcaacctgctcataattcaaatttgtttttgtttttagccatggcctaaaaactattccacataaattagggttcctcctcagtacaaatgaactattaaggcaatagagccaaatactagttcctgtgaaaacagtagctcagaattacatgagtgtggtcgagaggacttatggcatcaacaatgctgatccaagggggtctcgttaggctgctatctggctcccaaatgatttcataattgcacctgccttgtcttttggcacagatttgtcaggccaattttctgcatcctcctctgtcagtggctcagattctggctactaaagtttatgagaagggggacttcttgttccttgcctggtgtcctctggtcgtgccacatcctcctccttctattctcatctctcggcttccaggtctccatttttctaccatttctccagcctatccttgttcttctttcctagctcctcctcactaacaaggtttccccctttctcctgtctttttgttttctttttcttcctcttttttttttttttttttttttttttgagactggagtgcagtggcacgatctcggctcactgcaacctctgcctcccagggccaagtgttcaagcaattctcctgcctcagcctcccgagtagctgggattacaggcgcacaccaccatgccctgctaatttttgtatttgatagtagagacagggtttcaccatgttggccaggctcatctcgaactcctgacctcgtgatctgcctgcctcggcctcccaaagtgctgggattacaggcgtgagccaccacacccggcctctcctgtctttttctatacaatttctaaaatgtgcacctgcaaggatggcttctgttttggactccaaatctaaggtcacttccagtgcctcacttgacattgtttacctagttccctccagaactttaaaattatgtctaacactaaaatcatcatcattccataaaatcaagtctttccttgagatttctgctgtctgtgtgtagtaactcaagctcaaacctcggaatcacctttggctcctttattcttcgctgacttctccacccacctccccacggcttcccagatcatgatgaaaatctgctgattctgcttttggaaaaagtttctcccatttacttcgttcttgaactcactgacacaaccttgtcagactccctgtgtctctactataaacgctataaagcctcacccttaattgctccctgcccctagggattttccaacatttaatggaagaggtgcaatgtctcagtctgattttcaaagtcctccgtaaactgctacagatatatcccaccagctcaatctgcacaaatcagcccttaaccacaattccaaaactccaaaagttctaacaattcaaatgttttttcatagctgattttcacagctcatttcataactcacaggtcagcaaaatctgacctgaactgacaagaggttatttattatctttattgatcccacttggtgttgcacaaacataaatggtttgcctacattccaggtatttcctggatcctgctgggagtgtaatatagtagagggtataggtattgtattacctttctaaaatccagaactttctgatttctgaaatctgattccaaggattttgtatgagagattatagacctatatgtatttaccacattctacactcagtctgagatgccgaaataaatacttttgcatttcctatatctgggtcttaagatgtagtatctacctaaaatgcctgtttttctacctttttagtctctacctaccgaatttctacatatgttcaaggccagttccaatacaggcactgaacaagttatattttaaaaaatattttggttttcaaaattttttggaatttagaatcgtggttaagggtttgtagacctgtatttcgtctgtggatcaatgatgactcttgcagtaggagtatcttccctcaatgaattactaaaatattaggtttgtaaaatatttaaaactcatgctcacctattagataacaagctatttaacagcactagatgaatcttacacatcctatccattgcattcctaagaacagtttagaaacagcttaatattatcccttgtgacgagacattcaaatttgaaaagcctgtctcaactaaattgcaaaaataatttttccctcacttacctatttaatattgcttaaaaggaaaagatcagcacatagttgctgaatagcattaggagaaacacttaatgtagatgacaggttgatgggtgcagcaaaccactgtggcacttgtatacctatgtaacaaacctgcatgttctgcacgtgtatcccagaacttaaagtataatacagaaagaaaaagaaagaaagaaagaaagaaagaaagaaagaaagaaagaaagaaagaaagaaagaaaaagaaagaaagaaagaaagaaagggaataaaattcaacactttaaaaatagtatcaagcaaaattctccctcttagaacataattctgaatgaaaaaaaatcttgaaaatgactgagtgattttgaaaaacatatatttcagatatgattcctaaccacgtttttagtgcagtttttctatataaaaacccatagtgatgttcactccacactgatttctgtatgacaccaggaggtttaattcaacaaggagcccaattcaacatggtcatatgcggtcaagtgaaattgatattgcagagaggctaactctctttgcattctcaggaaaaggaagtcattaactcaagttcatattcagttttaaatttctaacgaagagtcactccatgcttaatttgggtttcaagttttataaggcaacctgagtttttaaggtattacatgatttaaatctagagccttgctctttaaacttccttcatttttttagtagaacttttcttttttgaaaacaagttcagaaggaactccaataattaaaacagatacaagtgggattgttctggttgaagaggtaccaatagctgtgggagggtcctggggttcacctacttcaatgttctcctcaaagccttttaaaaactccaggatccaaggaatcgactttggaaagcactgctctagaaggaccccatgatcctttggcttttctttttaggtaaactgttttcattttaaaaaattaaatttgtatttatatttgactataaaagtaaaatgaaaacagtaccaacaatgtgggaaaaaaataaatcacctcacgctccatcttcctaacaaagatagcatcattgaatgtcctttgtcagctgccttcacgaacatattttgatacagtggcaattgtcctcaaattttccttgctcttcccatagccacctcatttcagttcatggaaattccatctttccagtggggccaaagatttggagtcctctccatctctcacatcttgtatctagttcatcggcaaatgctgtcagctcgaccctcaaaatatattcacaacctgcagagtcaccatttgccaccctggtctgctctgaagaatgatccttggaaaatgtaagtcagccctcgcctacccttcgctcaagaccatccgatgacttcctatctcactcagggtcaaaatcttacagtggtctgcaagacctcacataacccaccccagcccacctctctgattttgttcttatcatcctctcctagcccacttcactacagccgtattcctggaacacacccaacccctctacctcatggcctttcatacttgctattccttctgtcggaaacaccctctctcagtttcttatcctcattcttctctttctttcgatgtcagctgaaaactaacctcatgagagatgtattctccgatgagcctttacaaaatagtaactcttctcctatgctcttcctcccggatcatgctcaactattctccgtgataattatcaccacctgaaatgtgtttgactctctatttgtatacacagttcccatccttaccctccaactagttaattgcacttcatctgttttattcaccacatctctagcacccagaatagtgattggcatataacagaaactcaataaacacttatttaattaaataaataaatcttctatgtttatttttgtatccccaactacagttgtaatcattgcccaattccataaaagagatgaaccatttgttaccattcattatgttcttcaccatttccctactctttgacgtttaggttgttctctctctctatctctctctctgtctctcaacaatgctacactagacatatattcagtttatcagtgaggggttgtaaacagatgtcaagggtacttttcatcagcaacaccatacacatgtatgatcagtgtctcagatcaccactgtggatatcacctctgtcaacctggggtaggcgtgagttacttactggactcagcacctcactcacatcttttccacttgctgtcaatcctattgccagcaacactatcagtcataattcagatccataatcttcatgggttggcaacctcctttcctccacttcatttttaacttcagtaataaagcagcaaagttacacattgaaacgataaggcactacctggagctgtttccaaccctttacctctaatatcggccactgcatgcactcttgacctggcttcctagatttcccagaggcctcctacttcccaggactttgaagctttgtcatgcacaggaattactgggagttgtccctgaatccacacatacacccagtactaggtgtatgctaaataaatatatgtctccccatatttgttcttctccatttttatttttcaaaaatttaaaaattgtttttgtgtgtgtgagagagggtctccctctgtcacccaggctggactgcagtggcatgatctcagctcactgcaacctctgccttccaggctccagcaattctcccacctcagctgccagaaaagctgggacaacagatgcatgccaccacactcagctaatttttgtagagagggggtttcactgcgttgccgaagatggtcttgaattcctgggctcaagcaatcctcctgcttcagcctcccaaattgctgggattacaggtgtgagtcactgcacctggcctcttctccattcttaaatatatatcgatgctgttatgatttatagacacaaatttatttaacagttacactgaagttttagttcattgtgtgtagttgattattgcattttttaaaatgcagcgtagctggaccaagcttgtccaacccacagcctgtgggccacatgcggcccgggatggctttgaatgtggcccaacacgaattcacaaactttcttaaacattgtaatttttttttgcaactttttttagctcatcagctatcattagtgttagtatattttatgtgtggcccaagacaattcttcttccaatgtggtccacggaagccaaaagattggacacccctgccctagatgaaagaatgctgggaatcattactcaaagtctagcataatttttcaggttcattagcacctgcaagccacaggtgactcacattcaggcatgtgagctagactgtaactctcatctgctaaacaggacatgagagccctggccttaggttctagccaaaaaagcataacatagtaatctttatttctgctaaatcacaggtcttaattatgggcactgggaggatgataaattggaactccattgggcaggtcatgtatcatctctaaccctgagtttcttcatctgtaaaaaggagatgacaatatcactaccaagcactgcaactactcagggcagtgatggatagagtctgtgcaaaataaatgttagcttatgatcttactagtgtcatttattatgatgattacttatccccatatctgaccagcggccaaatccttctttattcccaccacaagttaaacttattagtcattcattaattcctcgagtatctggagtatcttcttaccaaaggctatcagattgtaatttctgaaaattcacacagcatgacacatccacccaaaggccttcaagatttttaactggccaggagcggtggctcacacctgtaatcccagcactttcggaggccaaggcagacggatcacttgaggtcaggggttcaacacaagcctggccaacatggcaaaaccccatttctactaaaagtacaaaaattagccaggcacggtcatgcacgcctataatcccagctactcaggaggctgagctgaggcaggagaatcgctaaaacctgggaggcggagggtgcagtgagccaagacggccctactgcactgcagcctgggtgacagagcaagactctatctcaaaaaaaaaaaaaaaaaaagatttttaaccaaataaaattccagctcccaaatgtgaatgtcatatatcttcttagtcttatatcaaaaactgcattttagctaaataatgcattttacacaatttgaaagcagttggtgctttcccattccagcacctttgctcaactcacctccctcacttgcaatgacttcctatcacctaccccaattaaattacttccaggcctaacccaaatgtcccctcctcaaaaagtctttctgcatcatcagagaggaattcctccctccttccatagaacttccatgacactattgaattgcatgtgccatgcattttctcttattaggtctgttttgtctttgctgctataagttcttagggagtagggatcttggatactacagaatgctttgcacagagcaggctctcaataatatacgtagcataaaaattgcaaacagaaagccaatctggaaacacattcactatgcccatgcagcagacaacacaaccaaagctcaagcctaagggagttctgccacttcacaaattacttaccagcatgaggtctagtgagtccttgctcagactcactggacgggtgaaagagtttgaagtggggttttaaaccatggattaaattgtgatgacttctatagtgattaaaataacctagagaaattaagaatttttttacaaaaaaatacaaatatcaaattttctaaactggaaagcaaagctgatcatttttaaaaccaggcagggctataacatcagtcttaagattctgtgcaacagaaaattgtagggctttaagatggatttcaaaggaatagtaaatttacaagatgtagaaagtctgatgtttgacgaaataagcttgatatatttctggataggaagataaatgtaatttcttctaagaaaagtttataaagtacatctaatacctttttcttttatggcttggcatattttagaaaccctttgtcattctgctaccattagaagtggtaatcgtggtcgttatgacttttgtgtggataaaacaataaatctgttctaaaatgaggcaaacaaagccaccaaatggcatgaggttgaatagaatgatatagcgacctctcaacattgctcattctactccattacagaaagacagattttaaaaacaggtatgtagtgtctggctatggaagaacagtgggtagttaagataaattctagtcaaggccatgacttactggaggtgctgtcaatgctgctgatgctatctgcgtcgtgcaggtggtgcctgtggagctgcttgtagagactaaatttggagaactttcttggctttcctattcctttcagttttgaatccacatcatcaatactcttctggatgggtaggttttgaacaggctcatttttatctttgagtcttaaggattccatagactccattgcggcaggctgagaaaaatttttttttaaaaaaagacactgcataagacatgctgcagtgtggttctttaattcaagtagagctgaagtataaagtttacaaatgatggaggttctataacagacatgcaataatgtctgaggtcagccacagggtagtggtggattcttgtgaactgtttaaaaactaccaaaggaatatgaggagttctgctatggtcttttttcagtaggccaaattcttgaaatttcactccaattaaacttttaatctcaaatacaattacatgggttacattcagtgttgagctcctgaacttgttcctctaataaacattaagtaagcaaggcttcctctgtcaatcattttccctgttccttatgcactaaattgctatttttgcataagttttgcactattttccagcagtaaataagatgaagcccatcaaattttttaataagtgtattcatattctggcagccatttagttgaaatagcaagcagattgatatacactttttttaataagtgtattcatattctggcagccatttagttgaaatagcaagcagattgatatacacatacagatattttggcagctctatttaaaaggcactttgggaagttattcacttctggctcaaattccctctaaatgaccccagactgacctatcctgtttttgtatatctttaagtaggaactttccaaaaactgtggcagatacttaaggctttttactacctaaatctcaattgccacatatttttgtttatgaatcttatttctgaataaaaaataaatcttaattaaaatggaaaacaaagctgaatatgggacagccaaaattccactgaatctgttttcttttcttacaagagaagaacagactcagcaatgctaagttacagctagctaggtggggaagctggtgtttgaaaccaggtctgtctcatgattgacttaaaatgttcttttcccctccaaggagacaccatctcttattcaatgaatcaatcagtcatgctactaatacaaacttatacaaattatgttcgtgttatacatttccataaaggttaaatatacttactgggagggaacccagagacggtcctgaagtgacccgcttcacactgcccacgtctgtgagtctgtgctcattgtcgtcccaccttccataggccaggtcaatccctcccacaaaggccaccgattggtcaatgatgacaagcttctcatggtgagcccacaaatagacggtggatgacacatgatccgggtgtctcatcaccttgagagggaataatccccactgataatatgcttttgaaatgtccttcctgtcataatgaaataggtctgtgttctccctgaaaagcattttctataattcaaataccaaactgtacaacgtatacaccaaagaaaataattttattctcagcatttagcaaaaagaaaaagaaaaaaaaaagactcctatttactcttcaagctcccacgcccatatactatattttggggcagccgccatttagcttgaggtctggcaatacattagaaaacagtcagctcaatttgaaagctggttcccttccccctgtaaggattatgttaaatctggtactaaaaaaaaagctaaaaatatttaactactatttatctctggaaaaatgtgtaatgaattatattgatattttatcagtcattgaattgaaatattaagcatatgaatataggcatatagatattttggcagctctttatttaaaaggtaccttgagaagttagtaacctcttgctttcaaaattatcccagtctgacctatcttattttcatttacctttaggtaaaaagattacaaaagctttggcaactactttcctcttttccttccttccctccttccttccttccttccttcctttctttctttctcagagactcactctcactgaggctggagtgtagacacgtgatcatagctcactgcagccttgaattcctgagctcaaacgatccttctgcctcagcctcctgagtagctgggactataggcgtgtaccaccatgcctggctaatctttttgttttttgtagatatgggtgtcttgctatgttgctaatgctggttttgaactcctggcttccagccaccctcccacttcagcttcccaaagcgctgggactacatgcatgagccaccatacctggccttactgttttcttaataacacattttttaaaaattgtagtaaagtaagcataacataaaatttaccatcttaaccatttttaagtgtacaattcagtggtatcagggtaatgagttagagagtcttctcttctcctcaatttttgaaaaagattgagaaagattggtggtaattcctcattaaatgtttggtagaattcaccaggtccctggcttttcatctgggggagatttttaattactgatcaatctccttaccagttaaaggtctatttaggttttctatttcttcatgatttagtcttggtagttttcttatttctaggaacttgtacatttcctctaggttatcgaattgcttacagtaatatcttagaatcatttttatttctgtagaattggtagtaatgtctctactttcatttctgattttagtaacttgagtctttttttttcttagcccaccaagctaaaggtttgttgattttatcttttcaaaaaaccaacttggtttcattgattttctgtattatttttctatcctctggttttatttcccactgctccaatctttatttccttccttctggtagttttaggttgagtttgttcttctttttctagttcctcaaactgtaaagttaggttgttattttgagatctttcttcttcttgcaagtatagctgtaaatttccccctttgcactgctttctctgtgtcccataattttggtatgttgtttcattttcatttgtctctaagtattttctctttcccttgtgaatttttgttttatcattgcttgtttaacagtgtgttatttaatttccacaaatttgtgaactttctagttgtccttctgttattaatttctaacattatcttgtggtcagacagatgtttgtatatctaccttttaaaatctattaggacttacttagcagcctaacagatggtcctggaaaatgccccaagtgcacttgagaagaatgtgtatcctgctgttgttgggtagaatgttctgtatgcccattggatccagttggtttactgtacgttcaagtcctctgttttcttacttatcttctgtctggttgctctaaccattactgagagtgagatgttgaagtctccaactattatcatagactgtctttttctcctttcaatcatatatttcgattatctgttattaggtacataaatatgtataatttttatatcttgctgtattgaaccttttattaatatataatgtccttctttgtctcttgtaagcatgttttgatttaaagtctattttgtctgatactagtttagccactcttgctcttttttggttactatttgtgtgaaataccctttccatcctttcattttcaacctatttgtgtctttgcagctagagtgagtctcttgtagataccatatagttggatcatggtttcttaaaatccagtctaccaatctctgttttttgattagaggggtcaatacatttacatttaaagtaattatttgtaagatacttctgtaattttgctactattttctactacatgtcttatagcttttttgtctctcatttcctgcattactgtcttgttttgtttggttgattttttgtagtgacatgtttaaattcctttctcatttctttttgttaaatagctatatatttgattgctattttctttgcagttaaatgtaacatcttaaagttgtaacattctaatttgtatttataccagtttaacttcagtaacatacaaatctctgctcctttaacagctcttccctcacagttgttggtgttgcaaaattacatctttagtgggtacttgatagaaatttggtgaatgaataaataatatatataaattacgcaacctaataaatcattctttgggagaaaacactttcattttttctaaccaagtgaaacatacaattgttacatattttaagcctgctggaggtttgttaattcattatgtcttgatgtacctcaatgactgggttatatttattgataggttttagatattggcaaaatatcaaagaactttttcaaattgcttttcatgtttatttactttattagtattttatactaggtgccattgattttttaaggcattttaaatcctagaggagatctctttgctgctatcagtgatcaggggatgtcacagggagatcacatctaagaggttccaggataatgagaagtgtgagaacttgatagagctcgtgaatatcaaaacaactgcaggaaacatgttcttgtctaaactctcactttcaattatcagagtcagagaagcagaaatgtgagatctgcttacccccatcaatgtagggaagataagaaagtacagtattttgctttatttctgaggacacaatgctatttgatcaaatatacatttgggcattctatagattattactgcccagaacaaaacatacctgaaaaaatcctatagaataataaagaaacattggttatcaagatgaacctgaatacctttatgttgggatgtagacgcatcaaagtcctcttggtgtattcactattgatgccaagagcgagttccacctctttgtagagcattatgaagatcctcactccttgttgctgtcacaggagaaaaccgatggaggaatgagtatctctggagggaagttacaattcattttctttttcctttgcactgtactttctttcttttttttttcagagtctcactctgtcacccagcctggagtgcagtggcgcaatctcggctcactgcaacctccacctctcgggttcaagcaattctcatgcctcagcctcctgagtagctgggattacagtcgcatgccaccacgcccagttaatttttgtatttctagtagagacaggatttcgccatgttggccaggctggtctcaaattcctgacctcaagtgatccacccgcctcagccgctcaaagtgctgggattacaggcatgagccactgcacctggcctgcactgtactttctaacttcttttataaacaagtaagataaaattttaatgaaaaaggcaatacaaggaagtgacacataagtgcgtatattgagacacaaatattaaaaataaaaatctatctcccttccattcttacaactggtcatatcaagaaagaatcaataactgattaaagatccaaaacattgaaaactttagtataaaatggacacccaaattcaattgattcatccttccttagaccttggatctaaaagaaaatagacaaggtcaccgtggcctatttaatcgagtcaaattaaatcaaaagtgccttgtagatgctaacatgctatacaaataatacaattatttaacaatattaataatcaaaaagacaatgtccaatccttttgtagttcatgagcatgatgattgtgtgttcacacacaagcgtgagatgtgccacactcgaaccttcttacgacgtctgcacattacccatctcatctgaaaaaaagatttaaacaaaaaccaaaagaccaggtccaatagctaatagtatagaaaaacactggtattttccattctagttctggttggtgacaggctttcaggctaggctaaactgccccttactggaatgctcctctccttctgcttgcccactcatggatccccctccaatgtatagttcagaatgtattacctccaggaaactgtggcttattcacccccaccttgtggattgctttttttactttttaggcttgaatcctccttatttttgtatagtttgcaccattttaatttgcattgtttgcacccagcagctctgaaagcattctgaaacattttgcatatatactggattatgtatctaaatgacacctggcatttaatatcgtagagattaaaggtaaaaattttccataatactttctagaatattacagatgcaggtgtatttaataaaccataataaaaaataattttgttacagtttatattaagattccatggtgattagtcattgtttataagggaaatttgaataaaaatctttaagatatcttactgggttgaacacacctactttacaagaactaaaactttttgtaatgctatacgatctaacataacataggagttaatgtttttagattctagatcacatcacaagatacaaaatcttagagcaaaccaaacacataaacatttctgtaatattgttctgccaatactaaaaagcacgttttggaccctaaattccttataataacacaacacttcaaaatactaacactctatttttcatggtgttagtaatatcttaaaggtgtatgtatttctggaggtgcacactagatttacattctggtgtgcattaacaagatttgagtactaggagaagactcattcttgctctaaaaaaagcaggatcaagaagaatatatatgtcatactatttctctggttaacagctggcttttagtacttgctaattatttattataattatgcaagtactattacaatcaagaatataaatacatatttcagtaaagaagtaaaagcataggcagaaagtgaacagattaattttaatggtctggccagagagtgctctgtaattaaccactgatgaagggctctaaaggaaaattacaatattattttatttttctcctctactgttcagttctatttttggtatttgaatattttagaattcagcactgaataatggttacaaaaaaaaaaaagcctttcactaaaagatataatacaaagggtaaaacccaaaatttcaacctaaatagtagaacattacacctgacattcttcatcatgacccatttattttaagcagatgaaattctgcttcttaggcttaagacattattactcatgaagagtagtagttgcaaattaggaacttggcctgaatcctacagttttctactcacctgcataactaatggatttttgaaataatagagatattaacactaatggaatacattactactctccatttattaatacctgacatttcttctatactgtcttttctcattgaaataattctaaaggaaatagggtagagactttgtctttttagcttaaagacaaatgaccaatgaggaagcaattaaagatagaaagttcatttgtatgtggtttataattatttacctacacctatagccacaataaacagttaattagtgacaagattcctgtgataataaagcaatgcattcttcttcttttggtcaaggtattgactattataaactctagccataaagggcaaaggcgaatgaatcattccttggggatgaaggcattttccaggttgttatagtgtaggcttatacaaaatgtgggaaatatttctgcaaaatgaaagccaaaggaaaaaaaaacctgatgatgttaattctgcaatttaaaaaatacactttcaaaacatcccatgctttagtgcctagtgcctttaaatacccttggggaaattactttttgcttaaagaaagggacggaaattattaataggagaagtagaaaaacagatggcctggagttgcctatgcaatgcagtgtttcttatctctggtgaactcagctgacccaaagtttccatagaataaatttcataaaacatgacttttaaaagatgaaagttctgtcctcttttctaattagttttttgtcaagtagagcagacataacactataaacagtagaaatctttaggagctttagatattcaaactacatgggaagacaatgaaaagaaaatttttatagtggaaatcagtgactttgtttcttagccaacttttcctccgattgctcaagggagcatagtgaaaatattttctaaatgcagccaagtttgtccactgcctgaagacagtttagcccaccccacccccccaacccaggatgctcactaatgtttttgtcacttgccaaggacttccccaatacaatatattaagaaaatgtaaagatgtaaagtaaaggatataaagaaatcacttcctcaccgtttaaaagcaggcagcattgggatataagagcacaaaagctcatgtgcctttttttaaaatccaattttgtttgaagcacatttttgaagctgaagataccttccctgcaagccactgttgcccaccactttgataagactcatttgattttctgtgtagagatgtgattattcctgtcatttctcagttctggacaactttcccttttattggtcactgactgcaactctacattgtgccttgtgatccaggacagaaaatcaacctgaagacaaattctcccattagtctaagtttcataggaaatatcacaagcttctaaggttgagatacacaaaattgcgtgtggggatttggctgccataagtatgatgcagcttatctcacctcttagcatagcaagtgcagaactgtggaaagccctgagatgctgatttctttgagttgtgaacagtctgcctctgaagattggcttttattattttaaatgatggcattgcagatcagaaggccaaagaaataggagaagttcaacttggttattaatcagatacataaaatattctattttttcttaagaaacagccatcataagagatgtttgccatacgttggctataaggcagagacagttcctaaattcctctcagaatatctgcacaatcagatagaagaaaataaaacattcattttaataaaccttgtggacctctgggacctgttaatgcaaaaaacaaatattatgtttcaacctcatactttgcaaagctagtgtgtggctttcagaaactaaattatttatgtgaagccatatttatgtgcatataaaatgtcaatttggagtgatccgagtgttaaaaaatttatgaacaaagtaataatatggtggaatgagattaaggaagagcaactccgctaaatgtaccaccaagaaatcaatctttaattgtattactatttctttaggaaattttaaatatcgctacccacagtttaaaaattaccagctccaagaagtggatgaaatggaaatgaagcactgttatcaggcaataacgtttatttggccatggtgttcacgagggacctcgccagggttcaagggccaaaaaagtaaagagaagtcacactagacacagaaaaggtaaccagacaggtatgccaagggcagtaaacaagcgcatgccagcaaacaagaggtggaagccaggcctgcaggatcttcctcctgagccctaccgaggcatttactagctttctcaagttaacttagatgtcttgtagacactgtatcttcaagtgatctaaactttagctttctgaatcagctcttcccagtttcttccactatcagagtcaccttccggacacctttttttttttttttttttttttttgaaacagagtcttgctctgttgcccaggctggagtgcagtggcacaatctcgactcactgcaagctccgcctcccgggttcacgccattctcctgcctcagcctcccgggtagctgggactataggcgcccgccaccatgcccggctaattgttttgtatttttagtagagacggggtccgacacattattttgatcagaccacccctgcttccccacaccgccctgccccgcacagtactgccccactgtctcccataaagtcaaaccactagcttggctcacaaagcctctgcatcccagctgcaactagcagttccagcttaatcccccatccggctatgctaacactcagatgtgatgaaccaccctaccgtgcctgacaaagtctttggcactgctgtttacatctactacacctagaaagttcttctttcccttttaaaaatgtttgtccatcctaaatgccccacatccttcatgttgtgtggagctccccaactggaccttttccattgggaaagcccaatgctttccctcttgccattaaatcggggcattgtttctgcatgcaactgacacttctgcagattttataagctccttcaacttaagaatcatggcttttatttatgtacatcctcatatgattagccaaatgccctgcacatagaaaacattcaataaatacatattgattgaaacctaaaacagtgaggtgctgattaaatattataagcaaaaatttactagtattagtacagattgctacgcaaggctggaaaaatgtactaaaatagaatcttgagggaaaatggaaaagatgccatttcattgagagaaacatagagaaagttactgcccattcaataggtagaaagtagtctggtaaggctaggactgagcccaagacatgagtccctcagcaagttcgccactggcaaggttcaaatctgattcatggtggcattcttagtgattaccgtagaagctggctcataggagacagtaaccgtatgatgaattatttaataaatatgtgaataatgttttcagaatcaaaatgtccaattctgtaactggaattctattgatgaaacaaactagactatccatcaaaatgatgttgtttggcagaatgtgtttcaaataaatattatcaatttcttttgctttcaatattagcagtgaggtctgactatatttgtggatatccccagaaatactcaagtaaatgcatggggaaaagatacagaaagaaaaggggaaagtgaatggggaaataaaaagtggaatgcagaggataggaaagaagaaatgagtgaaagctatgagaaacagaaaaatgctaaccccaattatttaggctccacacgttctgctagcatgtttaatgacagaataaaaaaaggttggccgggagcggtggctcaagcctgtaatcccagcactttgggaagccgaggtgggcagatcacctgaggtcaggagttcaagaccagcctggccaatgtggtgaaaccccgtctctactaaaaatacaaaaatacaaaaaaaaaaaaaaaaaagccaggcatggtggtgggcacttgtaatcccagctatttgggaggctgaggcaggagaattgcttaaagctgggaggcagaggttgcagtgagccgagactgcaccattgcactccagcctgggcaacaagaacaaaaccccatctcaaaaaaaaaaaaaaaaaaggttaagacagtttctgataatagcaaaaagttagcacttcctaatttggacatgctaaataataaatcccagatctatttttaatttaaactgatttaattttaagggcctattacattaaaaaaatcactagaaatatgaatgcagtcattagtgagcctaggctgcttcagttatttactttttatacctaaaaagcacacattcaatgttcacccagaatgtacagggtcaactccacaggaaacagtttcacatttttaccaggaactttaccaaaaccagagaaaaaacaccaccaactgtgactattcctccccctttaatattattctacaccacattagccccatctagctgaaaccattctccagatgagttttccttttgcttaaatgacaaaataatgaatacaattaaatgctatgctccatttcatcatttattattcaatgatgaaattttattataatttttttgcctataaaattagctgcccataactgattcaaaaataagaattagagatgctaacataatccatgctgtgaattagtctaaaatatttatgcactcaaaagcaataggaataaaatagaaccaaatgaactggaaaacattagttatcctactttttgtcaaactctaaagtgaaaagttatacgtgtgaaaggctttgaaaagaaaagcatttcagagacaacagacagttaaaaaattatatcagcattttctgggaaagtacatactgcttttcgtttaagaatgcagtccaacctccaacgatttccctcaaccactgggcgtttcaggaagatttctggactcagcctgaaacaatgaaaccaagattttaagtaactaaaacaaaatataaagttctgattgtgtcataggaagcaaaggcaatttcagcccaattcaaccccattatcatcctccattgtgatgggtaatccaaagctttactatgagtctaggaacaacttcgtatgggaaaaatagcctttagctatacaaaacatcaatcttagttctttctctctctctctctctctcccccctctttaactgtctctcatacccacatgctcacatatgcacacaggtactgttggttgcccacccacagccaatctccaacttcttccctgctctcagagcctctctcccaccacagactgaatattctagatacttgctttcccagactcctgtgcagctagagcacaacgtgacacaatcctgaacaatgagatatatgaggaggtacacaggggcttaatgggaaagtttttcctccctgaaacacacacacaaacacacacacacacacacactctctctctctctctccctctccctctctttcgctctctctccctccctctcttttgctctctctccctctctctcagagaaagccctgcccacacttccagctttgggatggatgttgtatgggagtatgatgcttacaggggtgcagcaatattgaaattctaaggggaagaccataaccccagaatcactaaatcactctgccaacctcaggattgcccaactttagacttaacattaaatgtgaaaaatacatcctcagtgtttaagccctctttagttgaacattctgttaccccaaactaaaagcattctaatagatacacagacacatgacttcctatacaaagaagcagcatctgagggaacctggggctttctggacaggggagaaggaaggtcggctgatatatgaaatttttcctaggctcttctccttcagtaaggcataaggcagctaaggtaagctaagcttcacaaggcagctaagagtacaatagagtcatttttcccctggggctgggttctaaagttagtttctgagttaaacatgtacatgatgtaacttccctgtagttagaaaaaagaagcagtagaaaatactcctttctccactgaactgctagacctgaggcagcagaggtagactatgtcaggatgaaagccttatggaattctgcactggagtattgccctcccaggcagccctctaagcatgtgaaatcaacagtgctttaaggagctaaagagattaaaagaaatcaattttatgctctatttcattcagttaaagaaaataaaaacccagagataaagtttctaaaggaaacgttattgggtaaaataaataaggaaacagacaaatggaagagtttggacagtgtaagtcttgcatatttaattgagagtaggaaacaaactcaaaggtaatctatgtccaaacaagcaaacaaacaaataaagcacagcaattgatcagaaaagatcaaagaagcattaaaaggaaatctgttttaaaatagtaaaatgcattgctgtgcactgctagttcaccaaaagtgagagatagccaacaacatatatacaattgcaattttttgatgtgtacattaaatatgggctcaaagagcttcggtatgggggagacttttaatgtcatactctgcaattaagtatttatcatcatttatttcatttaatccacaaacatgtgtacccttgtatgctaagcattctacaagatactttgaagaatcttaagatagctcttgaggagccctcaattttgaggataatgcataaaaagaaaaaaagattttgttatatcatgctataaaagtataaaccatggctgcatggcaagaagaaagcagctataacttaccaagcattattatgtaagaatctttacttacttgtaaacaaagttattgtttaatattacatttcattggatctaggacaccagtgactgtaggatgcatcgttactgcatgtaccactaagaaagaaaacatcatgacaactataactgtaagagcataagatgcatcctgattgcggagatattaagacgtacctctaagtaagtgtaccacttagaagatttaatgactttaaatgcttacatgagaaagacaaaaaattaaaaattaatgatcagactttcctttcttaaaagatagaaaaagaagacattaaacccaaagtaagaagatgggggaataataaatataagagtagaacttgatgaaatacaaacctgaaaaaatacagagaaaattcaatgaaactagatgttgactctttgaaatatcaataaaatttgtgaacttctagcaaggctaaaaataaatgacaaaaaaatgattgaaaggatgggctcacatgtataaacccagcactttgggaggctaaaatgggaggattgcataagcccaggagtttgagaccagcttgggcaacatagcaagaccctgtctctacgaaaaaatttaaaaaattagccagacatggtggctcatgtctgtagttccagctactcggggggctgaggtaggaggattgcttgaacctagaaggttgaagctgcagtgagccacgatcatgtcagtgcacttcagcctgggcaacaaaggaagaccctgtctcaaaaaaaaaaaaggagtgaaagacaggtaatcactatagggcctagaggcattataattatattaaatgaataataactattaaaaataactgtatgccaatatttgtggtaatttaaataaaataaacatattccttgaataaaatattttcataatgaaaataaaaagaaattgaaactgacttcatagctattgaaaaactgaatttgtaattaaaactttcctacagggaaaactacagactttgccaactttacagaatttattaaacatttacagaatttattaaatatttgaattttatcaaatatttaagaaagaaatgatgctagtactacctaaattctttcagtaaacaaaggaggaacacttactatcttatttaatgaggtcagcattatcctgatactaaaaccaaataaagacaatgcaagaaaactaaagaacatcccttatgatcacagaagtaaaaatatttaccaaaaacacagcaacttagaaaaataatactacatcatgatcaagtgggattatcctaagatataaggttggtttaaaagttggaaatcaatcagtgcaattcaccacagtaacaacaaaaaggagaaaaacgttattattcaacaaatgcagaagaaatgatgaaattcaatatccattaacaataaatactcccaacaaattagaaatagaaaaaaacttccgtagtgtaataaagggtacctataaaaaaatctatctctaacatcacacataacataacaaaactgcatgctttcctcttaagattagaaacaaggcattctcaccactttcattcaacattttactggtgatactagccaatgcaacaaggcaagaaaataaaatataaagcatacagattagaacagaagaagtaaaactgtctttattcgtagatcacataatcatctataggacaaccctaagcaatctacaaaaaagctaccagcactaataaattaatttagcaaggtcacaagctataaggtaaatacacaaaaatcaattgcatttctagttctgtatggaaaatgaattttaaaatataatttacaataatatcaaaaaacataaagtactcagtaaaaaatttaacaaaatatgtaaagacctatacatagaaaaatacaaaatattgctgagaaaaattacataagagctaaataagtggaagcctcaatatagaaaaagaagtaccacctaaccagtggtaagtttaacatttttctccctttgattccttgacttggagggaaaacttggaaacaggcattggcacagagagaacttcaaaaatcctctagttcaggcttggggagaaagcaaaggatctctggtagtgacagggttgcagtggaaagcccaaagttactaaaacctctgaggcaggggaaatctcctctccaatggagatgtaaatacacctggcttggctctggacatgggtgccatcagagaaagcacattgcagagcacagtaaataaaaacccatctttctggctagaagactaaaaagggaagccatgggaaactaaaaattggggagaggagctcagaaaagcagctccataaagttgtttctgatttcctggctcattcccaagctgcctatgcatggatttcatcctaaacatcactccaaagaggctgagaactgaactgaggaatagaccaccaccgaagtcccagaagggccactaggtggcacacatatggggcagatctgaatagcaccacaaaggcattaacaacaaaaccggcattaaaacaacactcataaaaggctggttggaactttaagcctgaactgaaattggtaaattgcctgctaaaacaaaaatactaacattctccacaggattcaaacaagactcaagagtcttataacataataataaaatgttctagaatacattaaaagtacctggcacacaaagaaccaggaaaaaaaaaaaaaaaaaaaccttatcttgtacagaaaagggaatcagcagatgtcaataccaagacgacatggatattgaaattatctacttaaggctatgtcagatattataaaaatgctctaataagggtgaacactcttaaaatgaatgaaaagacaaaaaagtcttatagaaaaagatataaagaagaaccaaataaaaattttcaaagtgaaaaacactattaccaaaaacactagaaaaacaaaagcaaacaataaattccccaaacctcacaggataggctcaataccagaatggagatcatagagcagcagtccccaacctttttggcaccagaaaccggattcatggaagacaattttttccatgggtgggagctgggggtaaggataatttctggatgaaactgttgcacctcagataggccagcaggcaccagttagactctcataaggagcgggcagcctagattcctcacatgcgtagttcacaatagggttcatgttcccacgagaatctaatgccacggctgatctgacaggaggcggagctcaggcagtaatgctcatgctcgctacctcccccgacaagctctggctcacctcctgttgcatggcctggttcctaacaggctggggaccagtttggcttggaggttggggaccctgtcatagcggaaagagtcaatgaatttgaaggcaaataaataagatactatttgtgtcactgaagactcagaaggaggagagaaagaggaaagttcagaaaaaatgtgtaaagaaataatggctaacaatttcttaaatttagcaaaagatataaaactacagattcaggaagctcagagaaccccaaacaggataaacccaaacatcataaccaaactgctgaaaactaaagacagaaggaaaatattgaaaccactcagaggaaaaataacacattacttagaggggaacaatgtcttcaagagatggaaaatttctcaacagaaatcatggaggccagaatgaaatggaacaatcactttaactagaatgtacaaatacctcctacaactaaataagaagactaacacaatctccctctcaaaaaaaagggaaaagatttgaacagttaaaccaatgtccaaatagcacatgaaaatttgctcaacatgaaacgatgttgctgatacaagctaaaatcataataaaacactactgtataccctttgaaataaagactgacaacatcaagtgctagcaattatgtggaagaattgaaactctcatacattgctggtgaaaatgtaaaatggtacaactttggaaaacactacatttagctcttagtattgataaaatgtggtaaattaaatctatcttctaagataggtgtcaacaaactatagctcacaagccaaatgttgcccatagactgttttagtatggcctgtgagctaagaatggtttttatatttttaaagagttgtaaaaaaaatatgcttcagagaccatacatgatttgaaaagcctaaaacaaatttactctcttgctctttaaagaaaaaggttactaaccatttttgaaagtcagtggctttaaaacttttaaacttttggaccataagctgcagaaagaaatacattatacacccaaaccaacaccgggtcagtcagtctatctatctatctatctatctatctatctatctatctatctacaactgatataaaagtttccaaaattagtagcccttattaccacttacattgtaccctttctttcttttcccttccctttcctatcctatgccattctttttttttttaaatgctggtcacaacttaccaaattattttaatacacaattactaaagaggctcaacccatcatttgaaaaacactaacaatattaaaaccaacttaaagaatgttgcatttaaaaccaacttaaatacttttaaaacatgtattcttttacctggaatagtctttgtttgtgagtcagttagtaatgcaatgctgatttattttctttataacctttgtctccggcccaacctttgtctcttctgtttctctaccctttacaaacaccctcttttaaaaatctctgttcattgtttttcttttgtattctcctgttttattaattctatttctgacacatttaacatactgactccatacagagactggtagataaccccactctctcagatctacgcatactagtgtttggttaagtttctgaatgctcctttttgcaatatgcttgtacaacaagaattttctttacttgtttgagggaagttactgtgaaggttttatttctaatgatgtgttgtaataaaatggtatcctagtgcagtcgtgaaaaataagtaaccccgattcattctcttgctgaaagtagagaggaaaacattcagagttccatctctttatatgtttaattgaatcaacctaaatgaccatcaatggtagactggatgaagaaaatgtggtacatatacaccacagaatactatgcagccataaaaaagaatgagatcatgtcctttgcagcaacatggatggagctggaggccattatccttagaaaactaacacaggaacaaaaaaccgaatactacatgttctcacttataagtgggagctaaatgatgagaacacatggacacatacaagggaacaacacacactagggcctttcagaaggtagagggagaggatcaggaaaaataactagtgggtacaagacttaatacctgggtgataaaataatccatacaacaaattcccatgctacaagtttacctatttaacaaacctgcagttgtacccctgaatttaaaagttaaaaaaattttggtgttcagacataaagcatgaaaatctaggctcaatagaaaaattatttttagtctctctcacatcttcaccaaactttcagaaatattttttaaagaatatagtactcactggcacaaatttattatcacaagtgttcataaaatattcaaccaaagaaatagctcctaagcatgaaacattttttcctcctagtaactgactgaaaagacaaaatttggtaacaatagaaagaccagaattaagctcctccacaagcatgagcatgctggccaccacataccctgtctatcccctctagatcagtgattcccagccgacaaggatcttgcatcctctcccaaccccaaccagggaacatctagcaatgtatgaagatattatggtggtcacaactgggaacttactactggtacctagtggatgccgctaaacaccctacaatgcataggacagccccctacaacaaagaattatctagccccaaatgtcaacagggcaaaggttaagaaagcatgccttataattatagattccagacaaccgaagcaaaagatgtgtttgcattcttgaattagatattgatattgcccacaaaacctagaattagaagggaataaattatgatgatatattaacagttcctataaggtaccttttggaagaaaaccggatagagtaaaataaggggtaattcaggcaactactactaagttcctagaaggaaaacacattttagacatttccatatccatcgtagccagtgttggcatgtgtaatgggttttaactttccaggcagatgaatgattggaactgaagtcagactagaatgcctacaccaactacaggagtaaatttcccaagagttaaatgagtttccgatatgaggcttctggtgactttaataagcatagcaactcttatggatatttttttaaggtggtcacaaagttgaaaccggatgtatctctagaacagctgaccaggcctagtcattacagaggatatttttacggtaacaggcaagtggaactatttcaacatcaaaaggacaatttagaagaagtatattcactggccctcatgacagacataccaaaattagaaaaagacatccaaagacaccattacctctataactgtacttgcattacagtataatctttactgacatgaaaacttggaagtctgcttccaaatgcaaatataaaacctaattgttcaaactaagtattttatgaatattgttgaggccaaggtttttgaaaaggcctttcactgaaggcttagtcaactggttgagaccctggccaaaccatccacagatacagctgattttcataatgtgtaattcttgaacagcactataccactgtacatttctaaacatagagacttccagaaaaaaattcccagggacaaatactaaccaccagtctgtgataaaaatctcttcatttgcctcttccattgcatttgccacatcttcaaaatatcctttggcattaacatacctgaaagacaagtttattgttcctttttgttattaaaaaagaaaagaaaagaaacttatcttatggtaaagcaaaacatggaagccactgcctagagtctccacataacacataaccaccattgactttgtggacctggaaaacaaggattgaaaataccaagtttcctctgctgcctaggaagggcagtaagtgtaagcagcctgatttttctctgcttagagaacaacaaatttattgagcctcatcatcataaggagccagattaattttcctatcctgttgaacttacatacagtttttcttacatacagttctgagactgaaaacaaactagcttccaatccacgggtagaaaaacatgctaagcatgactttatttaaaagaaatatctagcaagtaaatgctttttcctaaattaggggtaatgacttaaataaaccttccatttgcatcattaaagaaatgtatgaagttagctttaaaattcaaacttcaaaatctaaagctagctaagctcactgtgaaaaatcttaaaagcaacaattgaaaaactaatctataatcaggtagtcccataattatcacaaaaagagaagcccttgttaagtataatgcataatctttcacagttttgaaaactgattccaggtgaatttaggccagtgtaatattagatgctatgactgccttgacaggcttagagaaataataacttaccatttagctaaagcattctcttggatagcagcatatgacccaaatcgatgatctttgagaaagttggtgccatgtttctggatgaattcttctatagcccctccccaccaccgagcatgtctatagctgttgcattttaaaataagtgtcctttaaagaaaaagccaaatattgaaaagactggtcactctgttctatctcatgctcttttttatttggtaatataccaaacacaaactgaaaatttgaggcaaagaacatcaagaaagcaggcatttaacattttttggtagtatttctaaaaatatattcaatataacaaaaataaatgttcaggttacttattcattcactcatgcaaacatgcataaaggtacttaccatagacctagagctgtgtgctaggccatgaggaggataaagaaagaggggtaaggtgaggttctatttttaagtattagttagagagctgttggctcccgtacagcagcggtccccaacttttcttttttcttttttttgagatggagtctcgctctgtcgcccaggctggagtgcagtggcgcgatctaggctcactgcaagctccacctcccgggttcacgccattctcctgcctcagcctcgagtagctgggactacaggcacccgccaccacgcccggctaatttttttgtatttttagtagagacggggtttcaccgtgttagccaggatggtctcgatctcctgacctcgtgatccgcccgcctcggcctcccaaagttctgggattacaggcgtggtccccaacttttttggtaccagggacaggcttgtggaaggcaatttttccacggatgatggggagtagtttcgagatgaaaccgttccacctcaggccatcaggaagtgatatgattctcgtgaggagcgcgcagccgagatcccgcgcatgtgcaatccacaatagggttcgagcttctgtgagaatctgatgctgtggctgatctgacagaaggcggaactcaggtggtaatgctccctcgcccactgctcacctcctgctgtgcggcccagttccgaacaggacacggactggtaccccgagggggttggcgacccctgctctagagggcacttccccttgtgctccctagtatccattccctcagcttctggaaatatcatcccaattgtgcttcatgacagccatcccttctcttcaacaaagctaagcaaaatggcatattccatctttctggttccagaaggtggttctggcatgactatattgtgagttttctatttcactaatcataggaaaactgttctttttttttttttttttttgagacggagtttcgctctgtcgcccaggctggagtgcaatggcgctatcttggctcactgcaacctccgcctcccgggttcaagtgattctcctgcctcagcctcccaagtagctgggattacaggcctgcacctccacgcccggctaattttgtatttttagtagagacggggtttctccatgttaggctggtctcgaactctcaacctcaggggatcggcctgcctcggcctcccaaagtgctgggattacaggcatgagccactgtgccagccttttttttttttttttttttttgaaatggagtcttgctttgtcaccaggctggagtgcagtggctcaatctcggctcactccaacttccgcctcctgggttcaagcgattctcctgcctcagcctcctaagtagctgggactacaggcgcgcaccatcatgcctggctaatttttgtatttttagtagcgacagggtttcacaatattggccaggctggtctcaaactcctgaccttgtgatccgcccacctcggcctcccaaagtgctgggattataggcgtgagccaccgcacctggccaggaaaactgttcttttgcaataataatcaattaaacatattgataccagaaaaaaaaggatactcatgtacatttgttcatcgattcctattaacaaatggacatgagtatcctttcaggcattcctaagcaaatgtgaggacttacttgctcaggaatgccaggaagggactctcttgcttccacagaatttggtgtgagtgtgggaggtggccatcttgctaccacaagggaatcagtcatgctcaacatggctgattagttctctttggtataagccagtttgctttagatttttctgtcactcataactaaactatcctaaactcttacagagttataaatgctaaaaaaaaaaaaaaaaaaaaaaaaattcagagtggattacagaaagttttttcttaatgccaagtgtcagaattctgcctactactaagagggaaaaataagttatccaaatttgaagtttgaaggaaaacagagtgttggagccagctgtatccctgccatgtaggcagaaatctaccatcataccaatgtaagaagactatgcgtgaggagggaggttgcttttttgaggaaatgcaatgatcctgatgagacgcagggaagggggctgtgttcacagattctaaaagaattatttataaagattagccatgtccaacctgctttcctcaatatgtcagaggtagatgctggcttttgtctgaaagtcatgaagacagggagaggctgctgctgctgggctgtggagacaggggaggagagacgtggtggagctgagaggagtgaagcatccccatcgcgtgtggtggagacacgggtttctagggatggagacgagagggcacaggaggtgcctgggcttgacctatcctgcaagcactactccaattgagctaaaaagcctcggaaaaacagttatgagaagactttacagaagagatgagtaacaagataagacattatcacaggatgtgagtcagtatcaagggggaaaacaagaactattccaaacatggacataagaaaagcaaagggaaagaggcaagaaaaaaatgctgccttcatagaacctgcaaggcgtattagggaggaatttcaaataaaggcaggaaaataaatgcccttcaaaaataagtgggggaatttggccttatttgataaaatcatgggggggatcttacaccaggaaggaaggtaatgaaacctggatgtgaatggcctcatttggcaatgacatacgggtaagtgagggtgggaaatgcagatgaagtggccaataaagtaagggaccagtgagaactgtggccagacttctgtggctcactgtaaaacaggaatgcaggaggaaggtgtaatggcagcaccattatatttccagtcacaatcttaaatgttccattctcatagaatatcatcaggaaggtcagcatctttttatacacacacacacatacacacacaaacatgtaaatcagtaagggaatatgaagctatgttggtaactatgtgcacagggagaaatgcatatatattcatatacatgatggtgaatgaactatacagagacaaatggatatatatgtataaagacacacatacatggtataactacaatcttccagaaagatcacatacacatgtactcactaataaaatctataataaatgtacatgagtgtcctttcaagatatctttcttggccaggcggagtggctcaggcctgttatcccagcactgtggaaggccgaggcagacagatcacttgaggtcaggagttcgagaccagcctggcaaacatggtgaaaccccgtctctatcaaaaaatacaaactttagtcgggggtggtggcaggcgcctgtagtcccagctactcaggaggctgaagtgggagaatcgcttgaacctgaaagatagagtttcagtgagtgaaggttgcagtgagcagagattgcaccactgcactccagtctgggtgacagagtgagagcctgtctcagagaaaaagaagatatctttcttaaaatatgtgtgtaacaatttttataaaacaaatcactcttttggtgttttgttaattaaagaatattgatttataaagtaaaagtttcatttattttaaaaatgtgaactattgctctaatctatctgtttagtaaactggcaaattgagtagtaatttctgttaacataggcaaacatctacatatgggattgtttattcagactgttgcacacaggatactctttaaaatatatacaaggaaaaaagtggtttcattactattgattgaggatgagctctaaattacaattttctaacactttttaaactccttttttacttaaggttgagaaaaaaatgtttttaaggcatttttgtagaaatcttttttaaatatttgaaatgtgtaccttgaaagattatcaattcggattccatatttcgtttctgtctccttcttccccaccttaattttgaattctttgtctaccagcaggacgaaggcaatggcaccgctgtctggtttcatatacaataaaaaggaatctttcactattaaccatctgtaagaaggtagtaagtatttttaaaagttgcattgagtaaataaaacgagaagaactaatcattatgacaagtcttaagtaatcactctggcagactgtagacataattacattttctacacaggagatttattttttttaatcgctatgaaacaaacaaaaaaaacccaacaaaacctttctattacgtttttctaagaaacagtgtaccaagtaattcacagtaattcattagctctttaaacactaatggcaaaactggaggaatgtccctaatattggcaggtagcactcacaggatgtacgacaggaagggcaagactgaggagatgggatccatttacagtgaatgcaaatggtaacttcatcaggctgcatataacaacatgtattcctatttgcctgcaattgtagagtgatagactgaatcatttgaaaactgagaagtaacaaagtgggcataatagtgcataccagacaaagtaaagcactctaggcacttccacattatggaatagtaaggttggaacatctgaatataaactaagtaatactgtaaatatagcatgggaactcagtatttaaaatatatctataataaatctttactgaaattgggaattgcattatgttttaatggctttataacttggaatttaatgtagacagacctacattgatttccacatagtttcatttcattaatttttttttaatacataagttatctccttcctaataaaagggcatagagtggatttaggataacttatagcaaagaacatatgtggtatggttcagaaaaggaaaaacgtcaaggtcacagaaagtaaatacctaaaatacctaaccacaaaggtaaatataattacagagatgacacactcatgtgggtgtaagcttcctagtttttcttgtcaaatgaataaattaaagaaataagtggatttcctccaaaactaaattccaaacaaagtttctcatttgggacctaacatgatacaactgaacaacataatgaataatattcccaataacaattttcaaagcaaacacagaaattatacattttataagagttcttataacactcctcaatacgaataccaaggctatgatatcaaagggtaaccccgttttcccagcactgtttactgaagagtgtgcactttccccaaagaatgttcttgatgccctcggaaaaatcagtaggctgtagatacatggattaatatctgagttctctattctgttctactggtcatgtgtctgtttttataccaataccatactgttttggttactatagctttgtaatatattttgaagtcaggtagtgtaatgcctctagctttggtttgttttttgtttttgttttttgctcaggattgctttggctgttcagggtcttttgttgttttatgtgaattttaggattgttttttctatttctgtgaaaatgtcattagtattttgatagggttgcactgaatctgtagattgctttggatagtatggtcattttaacagtattaattcttctgatcctcttcagtttttttttcatctgtgtcttgtagttgttctttttactagtcattagatatcaaggtaatttgatgctgggcttttattgaaagctcttctttattatgccattcataaaaactcctctgatttcttccctttttcttttttgtcaatagatatatttttttcttttaacttttactttgggttcagaggtacacatacaggtttgttacatagggaaacttgtgtcacaggggtttggtgtacagattgctttgtcacccaggtactaagcatagtacctgacaggcatttttttctgatcctttccctcctcccaccccccaccctcaagtaggccctagtatctgttgttgccgtctttgtgtccatgagttctcgttatttagctcccagttataagtgagaacaggtggtattgggtttcctgttcctgtgttagtttgctaaggacaatggcctccagctccatccatgttgctgcaaagtacatgatttcatatgctgtggtgtacatgtactatccagtctactacagatgggtatttaggttgattccatgtctttgctattgtaaattgtgctgcagtgaaaatacacatgcactgagtctttacagtagaatggttatagtcctctgggtatatatccaataatggaattgctgggttaaatggtaatactgttcttagttctttggggaatcatcacactgctttccacaatggctgaactaatttacgctccaaccagcagcatataagcatttccttttctctgaaacctcgtcagcatctgtttatttgtttgtttgttttttaatagccattctggctggtgtgagatgatatctcattgtggttttgatttgcatttctctaatgatcagtgatgttaagcattttttcaaatgtttcttggccatatgtatgtcttcttttgaaaagtgtctgttcatgtcctttgcccactttttaatggaattttttgtttttttgcttgtaaatttgtttaaattccttatagatactggctattaggtctttgtcagaagcacagcttgcaaatattttctcccattctgtaggttgtctgtctactctgttgatagtttcttttgctgtgcagaagctctttagtttaattagattccattcgccaatttttgattttgttgcaattacttttggtgtcttcatcattaaatatttgcccgttccaatgtccagaatggtatttcctaggttgtcttccagggtttttatagttttaggttttacatttaagtttctaaggggtccagtttcaatcttctgcacatggctagccagttatcccagcatcatttattaaggaggaagtccttttcccattgcttgtttttgtcagctttgttgaagatcagatggttgtaggtgtgcagtattatttctgggctctataattctgttccattggtctatgtgtctgttttcgtaccagtactgtactgtattggttactgttgccctgtagtgtagtttggagtcacgtaacatgatgtctccagctttgttctttttgcttggcattgccttggctattcaggctctttgttggttccatttgaattttaaaatagttttttctagttttgtgaagaatgttattggtagtttggtgggaatagcattgaatctgtagattgctttaggcagtatggccattttaatgatattgtttcttcctatccatgaacatggaatattttccatttgtttgtgtcacctctcatttctttgagcagtattttgtaattctcattgtagagatctttcacctccctagtcagctgaattcctaggtattttattctttttgtggaaattgtgaatggggttgcctccctgatttgactggaaagcaattccattcacaattggcttgattgttgttggtgtatagaaatgctagtgatttttctacattgattttgtatcctgaaacattgctgaagatgtatatcagctcaaggagtttttgggcaaagactgtggagttttctagatatagaatcatgtcatctgcaaataggaatagtttgacttcctcttttgctatttggatgccttttatttctttctcttgcctcattgctctggccaggacttccaatactatgttgaataggagtggtgagagagggcatccttgtcttgggccagttttcaaggggaatacttccagctcttgtccagtcagtatgatgttggctgtgggtttgtcatagatggctcttattattttggagtatgttccttcaatgtgtagtttattgagggttgttaaaatgaaggatgttgaattctatcaaaagtctttcctgcatctattgagataatcaggtagtttttatctttagttctgtttatgtgatgaatcacatttatcaatttgcatatgttgaaccatatagagaagattcaaaaccaaacagagaagattcaaataaacacaattagaaatgacaaagaggacattaccattgatcccacagaaatacaagtaactgtcagagactactatgaacaactctatgcacataaactagaaaatctacaagaaacagataaattcccagacacatacatccccctcaagactgaaccaggaagagactgaatccttaagtggaccaataatcagctctgaattagaatcagtaataaatagcctaccaaccaaaatacaaaaacaaagacaaaaagcccaggaccaggcggattcacactcaaattctataagacgtacaaagaagagctagtaccgttcctactgaaactactctaaacaattgaggaggaagaactactacccgactcattctatgaggccagcatcatcctaacaccaaaacctggcagagacacaacaaaaagaggagacttcaggccaatatcctttatgaacatagatgcagagcatctcaacaagattttgctttctttctcaggaatatataaatcaagtaaggcatctatcaaccagccttctaggagtcagcaccatctgcacagggatcaagtgcctgccctgaagtcagcctccctgggctccaattccacctgccactcactgcttgtaagaacttcagtaattgagcatgatgtcaaaatctataacatgaggataacataagacatataacatgaggacctaacagcaacatctagttcataagtattcataaagaattaactgagataactcatgcacatgcttagcacagtgcctggccccaatacatgcgaactattataactaatcttgttctaaaccatgtgagattaccgtctgttttaaaaagatacctcctgcctgtgttactacttgccatggcattcaaatgcagataagcccacttgagccagccctccccttctcagcctcatctactattgtctctcacaatgttagtcaatgttggttcttctttagacttgccagtcttcttctttgggctctatcgttgctgttcctctgcgtaaaaactgtttcttctaggcaattccatggatggtctcttcttgtcaatcaaacctctccttaaaaatccctctacaagcaggctactggattcaaaaaaaagctgttctccaccatccctgcctcatcacccccaactctcctccatcatgttgtcttgatttagcttctttgtagcacatctggaagtatttgtcttcttgtttattgtctgtctcctacagtacagcgtaaggtccctgggaacaggaaatgtggctgtcatgtctactactatctgttcaatgcctagaactatcttctagcagcccagagcaagctttcaggcaaggccaccatctcgcctaaataatggctgcatgaatggattccagagagtaaataaaaccatttagacactatcactgtctaaaaattttaattattggcacagctcatagttcactaaagtaaacactaagtaagaaagtgctaaggaattaaaagtaatggcaaaaaccacaattacttttgtaccaccctaataaatgctaaatttatttgttaacgtctatacatctctttttcttaagacattatttgacataagaaacttaacttacgaccaggtgcagagaagtttctcaataaatgtgctgtttaagcagatgttttagattgtaggatctctgtttgtctttttttaaaactcatctctcagataaggtcattatgagacctaactgaaaattcaatttccttgtttgccttactacaatttgtcaacgtagaataaattaacaagtgatcagaatgtatttttatgggtacaaatgaaaaaaagttatgaaggagtgtcatctttaaaagtaagtctcatttagacattaataaaatagtcgtcttggccaggtgctgtgcctcccgcctgtaatcccagcactttggaaggccaaggtgggcagatcacttgagctcaggagttcaagaccagcctgggcaatatggtaaaaccccatctttacaaaaaatacaaaatttatccaggtgcggtggtatgcacctgtatccctgctatctagggggctgaggtgggaggatcgcttgagctcaggaggtcgaggctgcagtgagccgagatcataccactgcactccagccttggtgacaaggtgagaccctgtctcaaaaaaaaaaaaaaaaaaaaggccgggcgcggtggctcacgcttgtaatcccaacactttgggagccgaggcgggcggatcacgaggttaggagattgagaccacagtgaaaccccgtctctactaaaaatacaaaaaattagccgggcgtcatgccgggcgcctgtagtcccagctactcggagagcctgaggcaggagaacggcatgaatctgggaggcggagcttgcagtgagcggagatcaggccgctgcactccagcctaggcgacagagcaagactccgtctcaaaaaaaaaaaaaagtcttccactgtgagaaactttctaaattatatgttatcatctatatatgctttctggtattttaaatcccaaaaatgtgactcaggaaatatttattaatatggaaccagggctttaatcttcacagaatgatttacacaatttacagtgatgacacatttcattccagggaggatcgtatctttttagattgtcccagttgacttatgatttaatccaaagtttaaaaagagggggcatatttattttgtgtaacaaagcctttccctcacctttcctagctgttgcttctcataagggttaaatccaaacgtcagtttttcagggagcctttccttgactcccagagctaaagtcaccctctgcaatccccagatccctcacaaaccatttttcccctttaaagctctcatcgctacctgaatttatacaatttacattaattgtcggcttagtgcctgcatttcccctctaacagaactccatgagggcagagacttcatcttgttcactactgttttcacaggagtatgccaccatctggcatacattaggcactcgaaaaatgactgaataaaccagaccatggcttccattccttgagtagacgccttaggttgggttgtcccagaagtaaactctgagatacggatatacgtgtataaaagagtttaagacagtggcaccaggaagcaccaattagggaaggatagaaagaaagagcaaggaaggaagccacagagagtgtattttcatgctttttattgtgggcagctgtgctgtaagccagctaaggagttctgggagacagtgtagagactgctgcagagtcaccccaactgaggaggatggggctggactccgatcagttcttggctgatggctgctcctgggagctgttgacacttcccagactgctgtgcacacagacaggtgggttctgacagcctacagaatttttggtcaaagaatcacaaatgcttaaggttacagtctgaaaactgtggttggcatgtagcagctgatttgggcaaagttaacgactagggaggagtggtcagaaggaatccccaagtttctaaaagttagagaagtgtatttgaaggcaaatactttttttagtatattatttcccttcttattttagtaaaacttctctcccagcgacagatcaagactccatctcagaaaaaaaaaaagaaaaaaaacttttttcccttacaaaaattttcagttttctttagtttaatcttctgatcttttccttgtaatttcttctgtcccttcaaatcccagaaagtaaaggcccagcttaatggtatttttttgttggtagtatatcttaaatcggtgtgtgtaaaggtggatgccagtattaattttatatattttgaatatacacatagctcaattccacatttaaacataaacacatttatcattttcaatttgggggaaatattatatacagatataaaatatttataattgatttcttcagtgttttaatagtttttcaaaatcccagtacattgttattgcaacagttactgtctattatgtgccaaacttgggggatacagataagaatcagatgagaatattgttcctcaaggagtttttagttggtaagacgtaagatataaaataatgttttctgtctatattacgcttaccatgataaacatttttcagaaatataagtgtaaaattatcatccctgaagtctgcacaattttacttaagtttttgttaaagtgtacagttcagtttgatttttggtatattcacaaagttgtataaccatcaccactatctagttccaaaatatcttcattggcccaaaaataaaccccataccagtatcaaattagtagaaagcaacctccttcccattccctggaaaccctttatctacttccgtctctacagatttgtctattctgaaaatttcttataaataagaatgataaaacatgtgcctttttgtatctggatgttttcatttatcctgttttcaaggttcatccacattgtagcatgtatcagaacttcatatccttttccatttaatttttagatttttattcagatgtaattcacatatcataaaacgtaccttttaaaagttcacaatgcgatggtttttagcatattgacagagttgtgcaaccggcactaccgtcttatttcagaatattttcatcaccccataaagaaactccatgaccatgaatggtcttcatttctctttttttaatgtatttttaatttctgtgggtacatagtaggtttatatatttatggggtatatgagatactttgatacaagcatataatgtgtaataataacatcaggataaatggggtatccatcacctcaagcattatcctttatgttacaaacaactcatactcttttatagttattgtaaaacatacaattaaattagtattgactatagtcacctgttgtgctatcaaatactagatcttaattatcctatttgtttgtatccattaaccatccccactatccccctccacactgcctttcccagcctctgataaaatctccatgagttcagttgttttaatttttagctcctactagtaactgagaacatgtgaagattgtctttctgtgcctggcttatttaactaaacataatgacctctagatccatccatgttgcaatgacgggatctcattcttttctatggctggatagtaccccatcatgtgtatgtacattttctttatccattcatctgttgatgaacacctgggttgcttccaaatcttggctattgtgaatagtgcttcaacacagatggaagtgcagatatatctttgatatactgatttccttcttttgggtatatacctagacgtggaactgctagatcatatggtagctctattttgagttttttgaggaacctccaaactgttctccgtagtcgtcgtactaatttacattcccatcaacagtgtatgagggttcccttttctccacatcctcaccagtatgttattgcctgtctttttgataaaagccattttaactggggtgagatgatatctcattgtagttttcatttgcatttctctgatgatcaatgatattgagcaccttttcatacacctgtttgccattggtatgttttctttcaagaaacgtatattcagatcttttgtccatttttaaatcagattattagatttttttcctatagagttctttctggttgttaatcccttatcagataggtagtttgtaggtattttctcccattctgtggtttatctcttcactttgttgactgtttcctttgctgtgcagaagctttttaacttgatgtgatttattccttttatggctggataatattccactctataggaataccacattttgtttatccattcatcaattgatgaacattagaattgtttccacttgtaaggctattatccataatactgctattataatactgctatagaaaagttctattgtagacatattttttcagttctcctaggtgaatccctggaattgctgggacatgtggtaactatgtttaacagtttaaagaactgccagactgttttccaaagtggctgcaccattttacatttccattaacaatatctgcggtttctctacagaaaatattctagtttctctacaccctcaccaccatttgttattgtccatctctttgattatagccatccttatgggtgtgaaattgtatctcattgtggatttgacttacatttccataatgactaataacgttgagcatcttttcgtatacttattggccatttgtacgtcttctttggctggccaatttgtgcgttctttgtccttgggttttcatgaatataatctgtacactttgcctacaagttcagctttgggtagaatatttaaatggatgctggaatttggattttaaaatataattaaaaatttgttctgccattgcttttaaaggatttataatttaaaactggtatgtaaaactagcccaaatacccagtgtattaaaacaaacaaatacacaaaactcactaattcctacctttttgaccatctgtagcaggctcttccctgaccacagcaattcaagcctggtattctgtgtcctccagatcttttcattatcataccttctctgaaagagacagaaaattaacccatcaccttcaaatttcccactcccacttagctcgtacagcctcccaacatgggactaaataaaccatctcattctcacatgactttcctccctactctctcctcctcgctctcaactagctcagtgccctgttaggccgggtaccctagaggcgaaccctaaaatacactggtgagatatagccccttcagcattcggggcagtgtgattctgttgtgcactacacaggaccttaagcatcctgtctcctggctctaaatgttgagtgttcccgttaactcgtcattaatgggtgcagcacaccaacatggcacatgtatacatatgtaacaaacccgcacgttgtgcacatgtaccctagaacttaaagtataataaatatatataaatataaaaaaatgttgagtgttccctcctcaacattgtgacactgtgacaaactaaaaaagactccatgcatttccacatgcctgcacagggatggtccacctgctgttgagaccatggtgcatctcacccacagattccaggacatctctgtgtctcttcacacccagttctagcaaactagttgagctagttgagccatgccaaaggaagcagagcacagctactagttttgaaaacagtatatcttaattctgaaaaatttgacaagaaaaagcaataacaaaggctaaactttaaaaaaaactttttttgaaacaactactaacaatgctcttaactagaacttgaaagttaagctctttatgttttcaagctctaatattgtgaaggaaaattataaactttcatctggctataaaacatattttacatagtattattttaaaataatcatcaaaatgagtagtaaacatttaactttataagggattgtaaaaggagatcttatatatttgatttttaatgtattctcctacacatcagacttgctataggtattgaacacttccactgttgggttagaaagaatctgtgctgtaagcacgtgacaaagacagtggagcagttgctaccgttgtttatcacaggagatgctctgatttgtatgaataattccatcagttgctctaactactggggagaagagaagctagcagtaaagccaggaggactccatcaccatggcatgctgctacgttaagtgtgaatgcaaatcaatttttcatacttctcttttaaggtttattgcaacttacatgccctttggtcccaaatcatggatgaaagacagctggcttatatcaagaaactctgtctgaaaagaagcaaaaaatccatctttagcaagcaaaacaattcaaatttatgcattaaaaaacatgtattaggtatagctgtgtgtatatactgtttggtgtgctccacagactacacagatcaataataatggcattgcactaaaagagtgcagattaggagtatataaacaatgaagacacatcctactagatcttctaaatctgaagagagagatgtgtgccttaatacatagagataaaatgctcaagaagcttggagagagagagagagagagtttattctcaatattctttcatgtttgtttttgttgcacgggatggatattgtgtggcacagtgtacactcaaacaataaaagaatgtgagaagcaagtgatattggtgcaggatctggaagatggactggatttgggcccacagtgtgaaatgggagatgaatggggggctagaacagaaggtcaaaaaggttataggatgtacagttgggttacagtgaataagatgaaggaaaagaataaaaaattaaacaggctgaaaagagaatggggagggctttgaacatcaggcataatgaaaagaattatttttaatgagttgaagaggaagagaattttaggcccaccttcactgtattagaaggttaaaaactgtaaatattataacaacaactgtggctgtgtttactgagtgctaactatgagttggtgttatgctaaccatttttcatgcattatctcaaacccctttgaagcaggtgctacttttcccattgtacagaagacgaaactgaggtttagtgtaagggtaagcaaatattttctgcaaagagccagacagtaaatattttgggctttgtgggcatacattccattttgcatctacttcgctctgctgttgtagcacggaaatagccatagacgcatacataaacgaataactgtggctgtgttccaataaaaccttatttatggatataaaatatgaagataatctaattttatgtgtcacaaaatattattcttttgattttttttcaaccacttaaaaatataaaaactattcttagttcacagaacatacaaaaacaggcaatgggcaatgggcaggatttggtccacgggccctagtttgcaggcctctgttttagagaagtcaagtaagttgtccaagatcacatagttaagaagggattaactcagtatggttaactcattatgaagtcagaccaaagtcagcgccctcaaaaccaagctggaagagcaaaatgtcattcaacatttatctaattcaaattgagttccttgcatattctaggtaggtgaaagctagatgtaaatgtggaggcatagaagggaaaaacaaatcaacattacataatgtttagcatatgcagatttgcagatcgttttgaaaagtgaccaacaataagatcagttccttaggccatgtcaatagcagccttgatagaccaacaaagactaaaaagatactctcccagcattaggaagcagacgggagaccagatatggaaaacactaccctcaatgaagttctgtgggatgaaccacactagatacatgtgaaagtagttacagagttatagaatagtggagggcaaccacttcccagctgacatgacatcacagaggcaggggcatttgatctaggtttgtaaatgggattagtaaaacaaaagttttccatgtaagttttatatgtgattggacatatctaacactactcttgtaaaaaaaaattacaaatatctcaaggcgtccatccttgtaaggttcatttaaatgcttgcatttttctcttttcttggggttatttgcagaaaataggtctttaaaattcaaaaggacttaaatatctttttaaaatcctaagtcaaaggtatcttcatacagcattttttaaattgagaatttaaaaagtcaaggtctcagtcaggcatagtggctcacgcctgtaatcccagcattttggaaggctgaggtgggtggatcacttgaggtcaagagttcaagaccagcctggccaacatggcaaaaccccatctctactaaaaatacaaaaattagccaggtgtggtggtgcatgcccgtaatcccagctactcaggaggcagaggctgaggcaggagaatcacttgaacccgggaggcagaggttgcagtgagcggagatcgtgcccctgcactccagcctgggcaacacagcaggactgtctcaaaaacaaacaaacaaacaaaaaacacctcaaggtctttacatttcatttcttatataaaacagtgattcagtatcatgcatttttatctggtttgtgaaaatgcttcttaattggaaaaggtaatcctatgggttattggaaatgattcacagattgccagccataaaatccaaaatattttaaaatcctgagtcataacttttatctctggagagcagacaaataatgtcagtcctagtttacatttgaagactatagtctactacagaggcataactaacttatgcaaagtcccagaacaaccgaagggaagaataggaaatgaaaacaaaaatcaaggaagccactaatctaatgcctggatattttcttatttacatagctgttatcatcaaatagttgacaacagaaatattctctgaaatcattcagaaatcataacttttggagtatatcataacaaaattgctaagcgtaaagaatctcagctaagtagacacattaataatgtagaaaattgaaagttacacattaatatgaaatttaatttatcctaatggcttagtaaagtttgactggagagagatttccagaaggaaccaggcctattatacagaaaaaaaaatctggcaataaacgtttttctaatacagagttatcaaattgaaagtaaatgtgtcagggtcaactgagaggcaaacctaactaataaaaattgaaatttaacaaagatgatgttgtccaaacttcttagtacatcttcagtgataagaattccattatccatttgggcaagtgattctcaggaataagaatttaaagatcaatttagcctaacggcatttcgcagggcttattccattgatcttttgagtaatgtataatcaatacctttttgtctttgtttttttggcaaaggaatttgtaaaatatgaatacaattgaaataatgttgcaatgcaataatgttcttggcactaggtggaaagtggtctcaagtaaaaaattccaacatgatctaccaattggatactaaaaacgttagagaaacagagaagcaaaaatatttccatgccaagagacaagcaacaagccctaggggtaacaaaaaatcctgaaaattacttggcaatcacgtacacactgccccttccacccatccttgtattgtaagagaagggtgactttcagaggctccttttatttaccaggtagcaaaaactcaagtaaatggccaggtgggaaattatcagatacaaggaaggtaagagcattgagttgggcaatgtccttgtagactcaggtactccaggaaaggcagggaacaaagaggacatctaatctatgaaggaaactgggaggctgggcaaaggcctaaagtccttctcaacgctaagactcaatcataagaaagaaaatatttcccttaatttgaagatgcagctgttcaaattagtatagcttttccctgttggaatgaaaacactgtgtgcacgtttattctttacctactcttcccctcaagttaaagttcattctacaaaacaagggagaggtgaactcagtattattgatctgtgggatgttttacccaaggatttcaagctaatcaccttcttggggataagaaatctgagtcacataagttaaatgatttacttcaaggtagagatacgatcctatcaccttagggcccttctcttggaaattgtacaatttgttccatttctagattttaatctcaggtatgaaaaaggtacatttattgctccttattcctctgattttaattccctggaagataagcattttccagttactaattaaaatgcctagctagtgagttctctactacagccagcactaatacaatttcagaatacaaaaggaattcttgtttgagatttttttgtatgttattacacaactcagatattgctatttttttacatatttatgcttagggtaaagaggaaatacatttgtccccattttacaaatgagcaaagaaaactgaacaaatcaccaatggtctctgaggcaactgtctgatcatgactacactaaaacactaggatgctctcctttgcagaaccacaagaaggaaaaaaaaaaaaagaattaaaagcagaggaagtcttcataatcatgggagagaaggtctgagcacaaacccaaccaatggctgtataaaagtgagaggaaagaactgtccatgtctaatttcagaggctacttaagaaaaataatgtcagtgcttagaaccctaaaccaaattcctttggggaaaatcctattatacaaacacctttataataaatctatctccacttttttttttttggcagagtcttcctctataacccaggctggagtgcagtggcgcaactgtggctcgctgcaacctccgcctcccgggttcaagcgattcttctgtctcagcctcccaagtagctgggattaaaggcgcccaccaccacgcctagctaatgtttgtatttttagtagagatgaggtttcaccatgttgtccaggctggtctcgaactcctgacctcaggttatccacctgccttggcctcccaaaatgctgggattgcaggcatgagccactgcgcccagccctgtctccactttttaaagtggtctaactttaccaagacatttctaagctgatcatagcattttagtttagttctcaaactcctgatgataagaatcacttgagctatttgttaaacacacttattccaaatacagatctggatggccctatagagattaagaacatatcctattcagtcccttgacctatgatccatgattctatctgcttatggacctgaattaacttaaaataggtttgttttatacttataaaagtataaatttattatatacatgttaaaataacttttaatatgctttttacagacagtaaagcattttttaacagatacttttttagtatttctcacaattattgaagaaaacatgtaaattccaatctcatttcacaaatatgaggcagaggtctacagatctagtctttaggccagactacatttaaagaaaaagaatgttagagaattaatgtatatcaaattgtatcctatgcttgaatcatattgaacaattcagctgttggagagaataatctcagtaaccatcgaaaatgagagggaggctgggcacggtggctcacgcctgtaatctcagcactttgggaggcagaggcgggcggatcacaaggtcaagggatcgaaatcatcctggccaacatggtgaaacctcgtctctactaaaaatacaaaaatttgctgtaatcccacctgtagtcccagctacttgggaggctgaggcaggggaatcacttgaacccgggaggcggcggttgcagtgagccgagatcatgccactgcactccagcctgggaaacagagcaagactccatcccaaaaaagaaaaaaaaaagaaaatgagaggagaatctattcacagtcagttgctaatgaggctttcccttccaaaggaaatgtttacaggtcactctgggatttctaaatacaacatggcctaactttgaaaatatttttatgactggaaaagtcattaaaaagaacactttttaaatctaaacattctttagtcaacagtagaatcccaaatgtagaaaagtacatgaaaagagaagaatgaactcaccaagaatggttacagccaaaagaaatagtaaaagtaaagtcacaggcaggcagaaaagtaaaagaaatggaaaattattgcatatggatactaatacacatttaaatagttgtctgttaaagaaaatagcatgtcggatttcagacaacacaacaggaggtatcatttttattaacaatagtagtagtatccttattcattgttatttcaacaatacaagttcctgagtcctagaagaaaagaaacccctgcctcccatcatccttctcttgagatcctctggtgcaacccaaattcctgttttcctgagaaaacccttctccaggtttatgaagacatagaagctccctcaagtccattgaatgccccagtgcaagctgctgctggaggcaggtagtgacctggatccaggtcacctgtgtgtaatgggacagctggatgtatatttggaccagactccaaaccatgtgctgcaaggcagcaggaaggcagctcctgtcatgagaaactcgcagagccaaatgctcttgcatcctctccaaaatacactaaagtctttactgtttcagtttatgtgtttatgtgatgccattctctaaactagcggacaaatcacaattgcaccaactctagagttctgcacatatataatatagatgcatacagcccccataaccatacaattcatacaaatgcatacatacatacgataaaccatgcattctcagttatccaggcctctgaataattgaaggctaaacctttaaaaacaccccacctttaatagtgcagagctacttgtttgctgacactagaaaacccactccctccctgcttgccagctgcataccccaagcttaatctctgtggctgcatctaagccccatcgcctcttctttctttacttggattcctcaagggttttttctttcctagcttttctcatgcttctcactttcacatgaaaagacatgcctttaacaggcatgacaaaccaatcagatggcaatcgccctacgcaccacaaaatcttcaggcattcaactccactcaactgttttcatcacttactactcaacagttactctttgtagctaaaaaatgctttttggcattatcctggaaacctgagaagagaagaaggttgatttctagataatctagcctatagcaggatttcaagttcatttaaatctattgttatagacatattaagttctactcaactttttaaaacagcgtcacaccactgtaaactggatccttgctgtaaaatcaactttgtattcacttaatttattttaatgcaaggacgaatgtaggtgtggatacaatcacttgtgttattaaaatgatccaaaatttagctgacaatttactatagtgaaaattactccaaacttaaatcactgactagtacttactgtggcatgatagtttctatacatgggcatttttagtatctttgtcaagtaatcttccagttgtttctgtaatgcaaatattttagataagtgttaacatggtcatatttatttttaaaaattaaacagtagtgacaatgatgagatcatcattttcatcttaacttctacaagttattcaattatttattaatataatcatggagcaaggaatcctgaatagcattaaggtgttatttccatatttctcttgaactattatttaaatatcttcttactgtttaactttccatatgcttaggtcttctataaactgctgacaagccctattatatgtatatagctattatagcaggacttgctataagttgttttaaagcatttgttgatattaccaaaaactttcatttttttttcaattctaacactgaacttactgaaagatacactacaaattttaaacagcttttcaggaaacaaaggtggagaaaggttaaaagactttctagtagaatgtactgattttaaatatgctaaactgtgtgtggaggcagcaggggagtagagggatataggcttggggcactggagcaacatatgtcaatcatattgaccatgatgtaaaatccagcatgcttttgctgaatcactaagtgtcattttcagttgaattcatacatgtgcacacagtaaaccaaaactatataattttatatgtctaggtatcttggaaaatatttggtccagatgcctacaaagattttaaacaagatgacaactacaaaggagaaatcaaacattccctctggaacataaacatttcagattacaaaacagaactgacagaaattaacaaacacttgttcattttctagtaaaaaaaattaattgtccacactctgcagcacccatcttggaagcagagcaggcagaagtgcccctcctctggagttttctgtcccagtgctgtgcctgtctgtactccgtcagactcttctcaggccctaactgctccatctatagtttaggaatgagattttacatatatttaagatgggctattacaaacacggaaacttatgtatggaaaatattattttaaaagagtagatctcaaaacccacaacaatgagttcaatctttgactcacaataagcccaaggagattctagcagggagaacagcttcttcataatgtcaaggcctaaccaagaacgctcttcctcttctgagaaaatgcactgtatggcttggggaaagaagggactgcctaactagttccagaaaagctaaaccagcctggggatcaatgagtggatgagaggagttgtagccaggcctacttcacccctcagtagatgctgtgtttctacagcactgcaaaattaggtttaaaaccacagaatagtgaagaaacttactcttctaccaaggaattgttcttctcttatcatgttttcagatgaacggggcaaactgggcatctctcgaggctcctctctgacgttttgcctcctaaacgtgtgtctaaaacacaaacacacagaatgcaaacacctactagattattctgtgactatgactttagtatgtctttcatgagacggcatatttttaagagactatttaattgaaaatatctaccaacaatagactagttagccgatattgtgaattaaatacactttttatttatttattttaaagattggatgtactctgtcacccaggatggagtgcagtggtacaatcatgctcactgcagttttaaactcttgggctcaagcaatcctcctgttgtagcctcctgagtaggtagaactactaactatcaccacgtgccaccacgtccagctaaatttttaatttttttatagggaggaggtcttgctacgttacacaggctagtctcaaactcatgacctcaactgatcctcctgcctcagcctcccaaagtggtgagattacaggtgtgagctaccacacccagacaaaatacactttccattcaacttgtatactggcataattaattccaaaatggttaccttctagtgggaatggggatgcggataaaggctttgtacttgagcagctctctgtgaaattcttgaaaatgcttgaatttcctcttaacttgccatttaaattccccatgtgttaattcaatagtgtaaagattaatacttggtacctacagtgatacataaaaatgtttgatattttagataacaacaaaaattccaaaagctttcagtgaacaatatttaactagtaacagagaagtatacttaagtccagcctacttattttgtgtaagtacttaagtaaatttgtttcaaaagcagccaattgcagaaataatattctctaaatgttcacttgatgaattacataagacaaactttcaatcacacgagacgattcctacaaacgctgttcctccaacatatgtgcgtgtatgcatccacgcacacacacacctgaaatgaagaactaggtggaggagacaatgagaaaggccctaattagccttcaggggtccagtccacaaatataagccgtgcaccaggcaattggcaggggtgagacgtattgtatactaacagcaccatcttggctgtttttgttcttcagaaatggcacgacatgccttctctccttctcttgtgaaacacattccaaggtccagccttgtctataccacccacccaccctaaggaaccaccagtgttaaggaggggtgggtggaaaaagtgactgcagtaatgagtatacagtgtatacttgtataatataatacatatgtattattattactaaatctttgtaataaacctataatgtaagcactgttataccctttattcagaagaggaaacaggaacagagaggttaagtcactcattcaagatcacaaggcaaagatgaattaaaccatgcagtctgcctctagagtctgtcatttacccccacatgttattatctttcaatctaaatgctggcaggtgaaataagaaaacaaagctcatcttagagacatttctgagggagttgtgctcagtggtgtatcagggagacatggacccgagtcacagggaaagcctaaaccagaggctgacaccaaaatgagtgtaagctgggagtcagtacatgtgcaggtaggctgggacacagcaccaggcaaaaccacccagaaagcaatgcagcgcatgccacctccaaaagacaaggaggaagggaaggcaaagcatgccctgacagctggttattaatctgtgcttcccctgaggcaggaggcagtggtggccttactctgccatggctagatcttagcctgaagggacaaaggtcaccaccctgcagcaattgtcctcccccggagacttaacaactgcaaaatccagccaggaacagagaaaagtagctaccctaacagcttcttctagtccaatccatttcaaagggcataactttgattgttgaagacattttactccaaagccttttcagcgttcagtgaaatatcacgtgaatgaggactaaaggatggttttctaggaaccaatcagagaggcagagtatggctgcagaattctctcaacagtattttgaggtaatggcactggccgatccagtatcccggctttttttcttaagagccaggtagcaccaacattttcatgctaaataaacattaggaaagctaaaattcttgttgacttatacctgccatgcaaggtggaataaatatgcatcaagagtccaaatgaaacagaaaactggggagagaagaagattaagagaggcactttgcaatttattaaactgttaatttgccttacatgcctttttaaaagaaagagctttggctcaaatgaagaaagaggaatataagaatgaagattaaatgggaaggaggcaaaaacttgacaggtgaaaatgacttggaaatgatagatacataaaaacaaacaaacaaaaacctacaaacatgatcatagctaagagggaggaaaatgaaaggctatgtactaattcacatatattgacaaaagaaaaaagggtgagtccataaacgctctgacccttgttgtagatgtgaagcgttccacttccagaacttgtgcttttattggacagccggagagatacgtctgtatattaggctccttaaatccttgagtgttataaatagcagagaaagggatatacactaaaaaaaaaagtaaataaagttaatgcaatatatgattagcataacttgtcttttacaggcattcttttaagaatcacgtgttaaaacaagtaagcctcttataaaatgatctgagcccggtgttacatctgcaaggaaaatcaatcatttgctggttacttcaaatttgtggtcttccgaccaaccgagataaactcttttcttccccgctcagatcatccgtctttaccttcttgtatcttgggatcgctgggagacacgtcgtagtctacctcctctccctcaaagtggagttcccgcgtgtccagattttctatgatattactcatgtcagcagcaattttctgcagtgcagaggtatttacccgtggctcgtttttcagtgacatgttaactttggacagagtaaaagcaaaggggctaggaaagaagaaaacggttacaaagacttagcattttgataacataaaatgctattccacaatttgaatccagacttagatacagcatatggaaacaattcagcctgctctgtgtgagcctcagttatccaaaacaaccttttagtttacgttcctgtttaacatttaaaggattcctaacttgtaaattaaaacagagtgcttaattgaaaacaagagaaaaaaaaaagaaaaaaaaaagcaacaccacattgaatgccaacatttctctcatccaactttattaacttggataagtaattcaagggagattggtttgggaaagcttattcagagaaagaaatagattatttgctgtaataaatacagctgaagaaagaatatcatgaaaaataagcaactctaaatatttcctaaagaaaatttagagtatttcacatattgaaatatatagatttagaaatatttttatgatagcataatatttctacattttctctgtaggtgatatcccaagcaaagtgtatattacctcttcaagaaaggagattttggccatgactttacgtgaggtataatgacgtatgtgtcttgaaaggaaattgattaatatacctattccgaaagacatctgaggtgctagaattatacttccctcctttctttttctttaaagaaaaccagttctatttcattctgacatttaataacacaagtcgttgcacatcagtacccagggcagaagagttcacatggatattatttttcatgtaaaatattgagattcaagctttgcacactgtcatcagagttggatgaaacatctgttttgcctgatgtagaaataatctgttaaaaccaggccctagaatggaaggacgctcataccagtaactctttggcacatgttcctttcttactgcaaatcacaaacactgagcatccaccacatgtgagatgagatgaatgaaaacgtgaaggtgaataaggcaggcccctgtgattaaggagcacctgatatgggtgaggaaaatgaggcatctaacccaaagttcacccctggcctcctccaaggtcttaggcttcttgagaatgaaatttgcccaggggaagacacttagctgggtctctcctgcaggtgctatcaaaaagctaagtggctatatgggaaatgctaagaaagtctcaggcaaacttacacagcccttattataactcaatgagtctcgaaaacctatacttttatgtctgggagaaagagactgtgtttggaaattcaaaaatgggagcgaaggagggaggttctggtttggccagacatataaaattcatatatctaagttccctggaactatgtaatcaatcatgtttctttctctatgttgcctgtaagaaagcttggagccaaatttgtggcctactatatagccaagtataggactatctcttcccttcaactttccctcccacttctaatttatatcataatagttaatagttactaatgtttagaatgcacctcgctggtgataattgtttacatacattgtctcatttgtcattaataataaatctgtgagggcttgttttttctattttgagcatgacaggagtttgccatcccctctttatagataaggaaactgaggcaaagaaagactaagtaacttgaccaatattttaaacaatctgtcaaggtcacacagctggtaagtggtgaagaagggactggaattcaggtttctctaacccaaaagttgatattctcaaccacgacctttatcttgctctctattctttgtagatatgtaagtgctttggaatagatggaacagttaatataaataagtaccctggggcaagtccatgtaagagcaaaccctaacaggaagaattggaaataatctcctgcaactcggttaccacaggatgaagccatttaaattcccagggtctttgtttcctctctataaattgaggaggttgagccatttcatctctagagttcttttaacacgaaaaccctaactgtagataagagatgccataaaagtattcagcctcccttataatttaattactttaacccttttcctatcccaagagattaatcagagtagttttgcatttgggtaagagaagcaggtagcagaatgttttctaacctggataacttaattaagatctattcagcctccattgaggagccattgcccttggtcaaaatcaaaatatgtatgtcctttcctcttcattcaacaaacacttaacaatgtgtcagattttactttatttaaaatacaaggtaatgaaaaatttagaggaaaagagacaaggaaaaacagataagaaattacatcatatcattgcagcttgttaatttttaaagacttcagatattttttattgattaaacagacttattaactttgccaactttcttaacatagtgaagaaaaacaaaggttactccaaataaccttccttttgaactatgtgctgatcttaaaaatgcctgttaattttaagaaatacaaagactacagtaatctacacagtgttacagagccaatgcaccaagctgaaataaatatctgacttcagatagagaaaaaagaagcatattcacttatgaaaaacttgaagagtgagacatgaaacaaagaaaacatcttatcatttatcaagtgtttattacatgctaaacacaattttagcacagttatgttatttaatactcacaatgaccctacctggtaggtatgattattctgagagattgagttaaacaatcgtccaaggtcactcaacttgtgtcagtgttgagtttataaagcagattttgtctggctctaaaatcttatggagttggttacagaggcccataattacttttattttatgggcttgaatgtctataaatctaaattcatcttttatatgaagtttaagtcctgtgacaagacatgtcctctactttagtcaccataccttggaagggatcatactaatcccacagtcacctcaattatgaaaacaacatatctcaacagcttcctgagtttcttcttagccttttacttttatggtttataatattttataagatcatgtggaacttcaatggacccaatgcatttgcagacttgttcatgcttttgtaaagactttactatttaataatagacaatgaaagaagtgatttgtctatctctacctttacttatgtccatgggcattgtgtgctgacttttcatccaaccattgtattgttggtttcattcttgaatatcaagctgcaaaactatctacgctcctatgttgtcaaatcttcatttatcagtcaatgttttctttcatctaaaataatctataatagggggtgagcagctgccacaggcacagcctatattagccagcaatgggataagggcttcagtgtttacacttgagataatgcaattgattttgttacctccttataaaattatactgcaagatcattatctctttcagtaccaagaagagatggtgcccatggagagataagagcagctgtgttttatttctgtttgcatttgtatctggaaagcaaataagggtttttttattctcgttttgaattatagaactgaaaatctttgcagggaagatttaatgacctccagttattcagtgatgaaatcagataattttctattcttgattttcaacaagattgggaagtagaacatcaaagagaagcagatactttccttttcagataacaaatagataaacattgccttagccaaaatacaataataatatcaactataattattgatattaacataaatatgaacattagccagtatttgctaaatatgtactacatgccaggttttgtacaaagtgattaatatcatgatctcatttaatcttcacaataactttaggagctgggtcccattgttactagcatttttaatgagtagcttagagaaggtagaaacttggcagggccacacagctgggaagtgatgaagctggtgatcaatttgatctgacctcaaagcccagctacttgccaatccagaggtgggactggggtgggaggaaagatgggcactgggagacttttacaattttcttcatatactcttaaaacttttttttaaagtcagggtcttgctctcttgcccaggctgcagtacagtggtatgatcatagctcaatgccgccttgaactcctgagctcaagtgacctgcctgcctcagcctccagagtaactaagactgtaggcatgtgccactacgcatggctaaaaagtaaaacaatttttaaaataaaaacaacccacattcactctatgaacatagttacgatttacttattgctccctttctaacataatatgcaaaaattcatttttttctagctgctattgtacttaactgagataaataaatgcaatggattcctaagccaaaaattatatcataatgtatgaacgtaaaaaaaaattatgattagatagtttaaacccaaactgagttatggggatatcttgttttcccattttttcatgatgatgaaataaattaaaggatccataatatataacctatgaaaacacatcatacagcaactctatatctggaactgacttgatgctctctgagatataaaaattataaatgtggattcaagtactaaactcaatctttagtaatataatacgacttggataaatattttttgagtttagctgactttgaataaagtaaatgatattaacatattttacattccagactatatattttgagaaaatacattttaaatatcctctgatgtttacttggatctttgactttttttttaaaaggaacattgcttctgcaaatattaatggaaggtgattatgtaccttggacagaaaatgagatgtcaatggtataagggaaagatcaaatgacctagaattgttctatccttactatgagtgtaacctgggcaactaccagccccagggttgcagtgtccctctgtgaaatgttccactcatgcttcctcccttgggaagctgtgaggagcaaatgtgatcatggatactcatctacaggcaaaaatcatcttggttgctagtgtcatctttaattctattaaaagctgacccctgaaaaaataatcttaggagagtttatcctgcttttcatctcttatttagctcccaaaactaacataccatcttgcaactgtctttctggctgggctactctaagaatgggtctctgtcattcaaccagtcctgaaatttctggactgtactacactaagtataagagaaaccagtaagccttcctctgcaaaaacaatcatggaaggcattagccagtcagacccagctaatgcttccttttccctgcatgtcttcctggcctcatccaacctgctctccctggctggttatgcaatccttccttggcatccccatagcgctctccacttttctcacaacagtggctcctgctccctttgaggtccggcatcctttgcaactttgatgaaatctatgaacccacaaccccagaaaaaaatgagcacgggctcacacacagcattttgcatatattttcataggttcatggttgcactctcaagacctttaagtgaagaagcacgtccactgagccgcaatcatgtgctgatgcactgacacatctgtcttcccactagacagggacactctttggggaggagggttagagtcatgggcattcaccacagacacccagccgagcacccactcaatacgtttgttgattaagtgacataatcaatgagctgtccatagagaaagctgtcagctccaggttattcagtaaatgacacaaagagatattattttccctcgcataccacagacacactcagatgtagaagccttctggttgaaaagcccctgagaggcgtgtaacatgttagaaacagattggctgccaacgcaatcacagctaacacagcaaactgctagtgaagcttcctgtgtgccaggcttttgctgagggcttttcatgcatcatgtcaaatgatcctcacagcaacttcatgaggagtactgtcatcattcccactttgcagacagtctgacagaggtgaagagtcagaaagtcagtaagtcagctctcagcctggctctggctgacccaaaagccatgcacctgctcctcttctgccttccacctgtgcccgtgccaagaaaaggagattccaagacatggaatcacccagccgcctttcctgcccataacctgtgagtccagcttgctattatgtctatggttctaagagtcagaagtctgactcccaaacacagcccttccactgagctccacatctagtctgatctcagggagcccagagcccagcaatcttccacttacttatccttctctcctggttttatatcacaccctccacgtggcctaatgctgacgctgcttttatccctgagatatacagactggtgctaaatactttggactcactgtgcccacagaatagaagttgaactcacgttctctttttttcccctagctaaaaacaaagaaacaaacaaaaacacatctataatgacataaagcaaaatggttacatagctcttaaaatttccacaatttctgccattagctaatctcaactagtaagtatgtcattaggatacttctgataatgatctatcccagccatttttaataataacccaagaaaaccaaggcagctttatgccatggaggcaataagaaatcccataagacatcatggtttccagaaaggacaaccttgtagacagctgtttcactatccaatactgaattaggatataactcacacgttttggggcattaaaagcatttcttgattctcatgacttttcctaaattctttgacctctttggacgaccttttaaaaacatcctcggcatttgttctctggcatgagctttctaatttcctttaatatatcctagagttaaatatttccctctttgcagtggtgtcagcttctagctcatctcagtcatatctttgaattcaaactttgcttccagagtcaaatacaaatgttaaaggaaattgacatctatttcaaatgttgatggttaagaaaatatgatctgtcatttcctgagtgcctgtactgaaaggcacgttacaggtattacttccaatcctcacaacaatctcactggggccatgggagcttactgaggctgcacagttgtgagtggtgggactggtccctgtatgcaggcctccagatgggctgggtccatctgcatccctggcctctgctcagtaaagatccccagtcacaactgctctcacttcttctcctaatgccaccaacaatctcagcctccttctgggcaagagcagggctttggcacagcctccatggcatgcagcacagcacgtgggctccactgacctccaaccagaccctcagaggcactggcacatccagatgtttttggattcagttgaagtgctgcaccagggacgtgttctcttgcttcctcaggagttgtacatcaggggggtaagaggagtacagggaagcaagtcacacagcgtgtgatactgagaggtgacaacgtgctagcagtcctcactcgctcttggcacctcctcaggccatggcgtccacgctggctgcgcttgaggagcccttcagcccaccgctgcactgtgggagcccctctctgggctggcggaggccagagccaactccttctgcttgcagggaggtgtggagggagagacgccagtgggaaccaggctgcctgctgcactcacaggccagcgcgagttctgggtgggcgtgggctcggcaagtcccgcactcagagcggctggcgccaccggccccgggcagtgaggggcttagcaccgggcaagcagttgcggagggtacgccgggtcccccagcactgccggcccgccccactgcgcttgaattctcactgggcctcagccgcctccccgcggggcagagcttgggacctgcagcctgccatgcccgagcccctcccctccgcgggctcccgcacagccggagcctccacgggcaccaccccctgctccacagcacctggtaccattgactgcccaagagctgaggagtgcaggctcgcagcgcgggactggcgggcagctcagcctgcagcctgggcacgggatccactaggcaaagccagctgggctcctaagttgggtggtgacttggagaacatttatgtctagctggaggatcctatatgcaccaatcagcactctgtgtctagctaaaggtttgtaaacgcaccaatcagtgctctgtgtccagctaatctggtggggacttggagaacttttatgtccagctggaggattgtaaatacaacaatcagcactctgtgtctagctcaaggtctgtaaacacaccaatcagcaccctgtgtctagctcaaggtttgtaaatacaccagtcagtgctctgtgtctagctaatctagtggggacttggagaacctttatgtctagctaaaggattgaaaatacaccaatcagcactctgtgtctagctcaaggtttgtaaatgcaccaatcagcaccctgtcaaaatggaccaatcagttctctgtaaaatggaccaatcagctctctgtaaaatggacgaatcagcagaatgtgggtgggcccagataaggcaataaaagcaggctgcccaagacagcactggcaaccagctggggcccccttcaatacggtggaaggtttgttcttttgctctttgcaataaatcttgctgctgctgtttaggctttgggtctgcactgcttttattagctgtaacactcatggcaaaggtctgcagttttacttctcaggccagcaagaccacgaacccacccggagaaatgaacaactccagacgcgccactttaagagctgtggcactcaaggagcaggtctgcagcttcactcctgaggccagcgagaccacgaacccaccagaaggaagaaactccaagcacatcagaaggaacaaactccggacacaccatctttaagaactgtaacacttaccacaagggtctgcggcttcattcgtgaagtcagtgcagaccaagaacccaccaatttcagacacaatactagggcaggttaagttgctggcagatgcatgcctctcccctctccttttggccttggctgtgctgagcacactgatacaaaacagtcgatctggatgatgttctatgtgatggagcaactggctgctttttgtgggaagctatggccagccaggaaatgactgctttgccttcttccctgcctctcttctcttcctctcttttttttttttttctcctctagaattataactactcccattcaaccctactatgcaaccttagaggctctatacaggaaacttgagctaggatagtgttagaaccaggattccaaagcccatgttttgttcattgtttttttctgaaccatcctggctcctgcagaaattcatttatgctgaatttaacagtaatttttaaaaagcagacttgcatcatgtttactatgtaccaggcagtgatccaggtggtttgcatgcattaactcaatctgtccttacaacagacctatgaagtaactgctgttcttagccccttttaagcaaggaaactgaaggcacagacaggtaagtgactgtaagggtcacccaacaatctgatctaatttgctattatttctgccttgattaacttgggcaaagtaactttaggtggtgctcaacttcctcacctaaaaactgaaaattaaaatatctgttttacatgaatatgaagttgtctgtgtttaggactttacaatagatagattaaaattttaaaaactcctctctcaacattactaaatgttagaaaaacaacatattctaagtgacatcacccagaagacaaaaactagcccaaatgccaagggcatttagatgaggattccgagtcaacgtctaagaagatttattcctgcccctgtaaatgacaaggcacattataaagatttgtatttgaagagaaaatatgggaggattactcctgacttcaaagcctgttaataagtttattacgtgtaagtcagactttgtacaaccgctggattgacttaagtcaaagggaaaattcttctttataaaagaaaggtagttaatattgctaaaaactgtggtcagacttctaaaattaacatccttggatgttaaatgaatactcagtttcttcatggccaagaacggaatattcatgcattcctttctttcacttcccttcaaagcaacagggaagcaacctctgttggtgtgagttttggcagtacagagagtgttttcaatgataacccatgaatttcacgtatgagaagaatggatctggcaaactcacattgtaatctcctccaaacactctccagtgctgattagcttttgaattctgtcacaactgctagtagacatagcacaatttcaattttttggccatctatgtaattactaaaaatgtttgttgaggcagtacagtaccatggtagatatgtgattttgagtgaagtaacttgaaatatgactctccttatggtgaaacaagttatttctgtctttctgtgtctcagattcctaatgtgtaaaatggaagtaatattgcgtggcttagagcttgggctatactagatgctaaaataatgttagttgttcctatgcccctagttattctaagagctatcagtaagacccctgcccaaagtccatatattcctacctgaatcatgtcccccctaagcacaggaactagcagcaacagttggatttgggaatggtctgatgttgtccactatagaaaacactgctacaaacttctggaaacaaaatgaatcaagctaatacatatgctccatttctactgaaaacacagaattgttaggtaaattgtaattgttttaagaaaagatttattcaaggttaacagcagtggcagcagcaacaaaaacaataatgaagaaaaaacctacagtgtctaagaatgaagaaactaaagtctgatgggcacactggaactgaagctgtagggcccaaagggttctggatctcagataagcatctgagattacagttctgttgcctcacataaattttaggagataagatctcagaatcatgggaggcagcagcctggaagtgacactcttacaaaaaaacccagagcttcagcgagctacactgcctatttaaaagggactaaataaccacacccagcatccctgggaagaaactacatggaactgtggttaactacaaaatgaaaaactgtacataaaaattatccaagatcacaatgtctagctttcagtaattgaggtagtgcttttattagatttaccatcccacagataattacatattctggaatatatatatgaaactgcaaggaaacctacatttggaagaaagaaacagcattgtttttgtataagggctggtcccagaccatgtcaacttgagtgactaaaactcggatagaaagtccatagatttccagcttgaagaaacaaagaacaaacttcacagcaatcacagcagctgaaaagtgaggccagaaatcctagaaaggagagagccacagagagggagacagccccaaattttgcataggctgacgcttgaactacataggcatgggatacattccaatgcaactcagctagtactaaaatgactttaacagatatttctgctactgcccaccacaggacagatggggtttggtgtttgagtccaagcaagttaaatgactggaaaacaaaactaaactcaacaaaaaatcccaactctggaaagaagtataaaggaattcagagtctctacaacatgtcagtcacaatgtcacctaaaactactacacatagaagaaacggaaagatgtgctccattgtgaagagtagagaccaatcctgacatgttgaaattagctgagaaggattatttaaagtgactattataataatgctcaaggatgtaaaggaaaatatggttttagtgaacgaataagtagaaaatctcaccagagaaaagaaaaaatttgcaggatgggcttaacagcagaatagcaatgacagaagaaagggtcaataaacctgaagacaacaatagaaattatccaatctgaaggacagacagaggggaaaaaagatttttaaagaaatgaacagagccttagtattgtatgtgataatactttaaaaatctaacaagcatataatttgaatcccagaaagatagggtaaagagaaaatggggcagaaaaaaaaatgtgtaaagaaataatgataaaaaattcattaaatttggtgaaagaaataaatttacaggttgaagaagttcagcggatcccaaacaggaataaatgcaaagaaaattacaccgaggtacattaaagtcaagctgctgtcatgtaaagaaaaaagacaattttgaaagcagccagagaaaaatagcttgtgttcaggagaaccacactaatgacgataaacttctcattagaaataaatggaggctataagattgaaacaacatcctaaagcttaattaatgtggttgaattagtaaacaaaggttgcttttcctcaaaggaaatctactgattcaaattcctaagaatttcttacagaacctgacaatatgatcctggaatctgtaacagagaaattataataggtagataagacttgccctatcaggtagatcaataattattacgaacctgaaagaaataaaattttacattattggcacagaaatagatgaactgaaccaagtagggaccccccccaaaacaaacctattcaaatatgagttcttggcatatgacaaaagtgaaatgaaaaaaataatggagaaaaataaactgtttaataaacaatgctgagactattggcaattcagagaaatataaaataaaattagttctctacctcaaagctccaataagaatagtttccatattatagtcccaaatatgaacaacaaatatttttaggattaaagagctaaacatgaactacaaacatgtaaacatttgaaatatagaagaatgttcttaagaccttagagtcagaaaggaataaaaagcacaaaccataaaggaaaagctataaattcaactactctaaagtttaaaacgttcattgaacaaatgggaaaattacacacacacacacaaaatttgtaagaacaccagattgggagaagacataagtagaatgtataaagaactcctataaaaacataagaaaaatgtaaaaaatacaaagaacaagggccaggggcatatacaggtaacccataggagatcaattctaaattgtcaataaaactttaaacatgctcaacctttccagtaatcagggaagtcgtattgaaacaatgagatactattttacattcattggatcggaaaatttttccaagtataaaattacaatgtattggtgaggaaatggaactctcatgcactgctgtgaattaaaataaccttttagaaagtaatttcatggccaagcgcggtggctcacgcctgtaatcccagcactttggaaagccaagacaggcggatcacgaggtcaggagatcgagaccatcctggctaacacggtgaaaccccatctctactaaaactacaaaaaattagccgggcatggtgatgggcgcctgtagtgctagctactctttgggaagctggggcaggagaatggtatgaacctgggaggtggagcttgcagtgagccgagatcgcgccactgtactccagcctgggcgacagagcgagactccgtctcaaaaaaaaaaaaaaagaaagaaagaaaattagacaactgaaaatatccatctatcagagaataggtaaatgaatgttttaaatggaatgctatacagcagagaaaataagtgcattagaactacatgtatcaacatgaataaatgtcaatacaaagtttggtgggaaaaatccagcttacagtttttgtttaggatttaaaaacatagaacaatcctgttaggttgtctatggataaatatatatggaagtatgacataaaaactaattgaggaaatgatacacaataactttagaagagtggtaacctttagcaagagaggtgggaggagaacgcagttagcaaggagtccaaaagggactcagtgaatttttatttctgtggtctctatcatacaaatctgacattttttctggctaaaccgaagttatctatttgcagctctttccctcttgctgagctgtaagctctttgagaactcagaatgacaataaatgaaacttgtggccagacttcccagttacatctccatggcaaacattaatctgtgatcacagcctactttctctgagcctgcacagacctcctagttcttcttaccccacacttcagaggctttaatatcttgccatctctgaaagaaatcaaatctgatctctctcatatctttagtatttgttgagaagaaatgaattaaatgagggaaatgaattacataaccagtgggcagtattttactatatgtgtgtatgtgtcttagaaagaatagaaattaatgcaactcaattcaattcaaaacctgtatggtgcacatatttggtggcagacactgagtaagaactgagcatacaacttttagactgaagaaaccaatgaatacaaaacctggtctgtaatgcctggcacacatgatgatctaggcattcatttggtccaacctcttcaatgcactgagaagacagaggctcagaagcatacagacaaaggattgatgagactagaactcacacctctgttgcactctgcttgcccatacaagcctgtttcaggggtggattatttctttataatgcagctttgaaccatgtctgaaatgtgtaagaaagacaaccagatgggctggataaactgcttttgtctgagctgcagccagactctgctcagtgggtgtggacaggctgccagcctcactgagaaagaactagtttggtctttgttcaaccgctgctcctatgcatagtactaaggaacagagatattctcaggacacctgaatcctgtgacgacattcccaagggtcagaagcacatgggttgcatcaatactaacaagaaatggcaagttaaaaggcaggctgccaaactttgacgaactggaaagagagtcggtgtgcaccagccagactgataagccaccttgctttccagtgcagccgctttgcagggcttcttaagcagcttctcaggatgacagtagttcactcaatggatatttattgaacaccttctatgtgctgagcaccatgctaggcactgagaatataaaataacctcatgcatttcactttaccatgacaagggaggctttaagggcagaatctctcaatgtccctcaccttatttgtgattttgactcctttcccaccaaaacattggaagaagacccctcctctgcctctcctgtctcccacctttgcttgtttccaaccgtcctctcattatttcatcagtcaactccctcatcaacttctcctgatcctgtgactttcccctattaccacttaaaacattctcaagtatctcaattacacatatgttcccttctaccgcttctctctccctgtgattcatagttgaggtttttgtattacgtttccctgctcagctggactgaaccaaacatgctccatgctctccaaactcagcctttcaataggctgctccgtctgcagctttgcgttcctccaaccccatctttgcctgattgattcctatcatccattgggactcatatcaggtgtcacctcttccagaaagcctcccctgacagcccaggctggtttaggtgccttttctctcagtgtttctatggcatccaagtgagttcattgagtacactcctttccacttggtctctgactcctctggaagactgagttttctgaagggagaggctgtctctaaatcctgagtcactggtgtctattgggttctcagtcactgtttctgaatgaatcaaatgggaatgaatgaatatgaataagacttagaactgctcacagtttgggcagcacaaggaacatgtgtgtaatgctttctgggttacaaagcattctgtacacatatctcttaattttcctaataatcctacaggggaaactattatttttaaccttcttttcattgaagaagtaataactcaaagtgattaaggtcatactgtgaaactgttggtctgagactcagtcctgacccctcaacttcatgttccctgctttttccatctcctgtaagttactgccttcatattcagatgtatacaattctccataaactatcctcatcaaaatctcatatctggaaaccagtcttctcaccttgtgtctaaccaaactacttattagaattgaagataagtcaattctggctaattttaacaaaagaagtaaagctagaaaaggaaataatacaaccagaacaatagagataacacttccatttttctccagtgtgatggatgaacataaatattagtgatattacatccttcttccaagtggcaaaacatctcaaatgtagggcttatgacaaaatgaccagagatttgccctgtgactcgctccttattaaaaccaggaaatctccatcctatctggtgagacagctgtgcaggcaacttttatccaaggtcacccttgagactcagctactactatatctccaacaaggtgttaactcgccaccagctccttctagacctcacaccctgttcatccaactgagagcatgcagtccatctctgactcttcatttgcccaaaaatctctgcttgtatgtccttcttttgcagtcatctggagaaattcaatcctgggccacacgaactatctgccttcttggcacttaccccaaggcttctaaacaggggctgcagaaacagcactcaactacatagactggtatttatggggctttccagctatgtctctcacccccttttcaaagtcaacttcctaagaaagttgtctacttcctccttctagttcatccctcctccttctttaacttgctgccactggcctccatttgtacactccaccaaacagctctctccaaagttcataaccacctgcatattccagaatacgaaggacacttccccattcttatctcacttaatctttctgttgcacaacccttgactgcatccttcttgagggtctctttcctcagcttacatgttctcacactcctctagttttcctcctccctctctgccaactgagatgaagtcttctttgatgctgttcttcttgtgctcaaaatttacatgctaatattattcagggtcccaggattattctttctcactcttctcagggtgatctcatccactctaatggttaaaatacatgctgatgtttcctttactcagggataccactagtgaatacattcctttcctcttggcttctgtctcccctaaaagactgggagctccctgaagagagaggccatctctgtattgcccatcactagcatctactgggctctcagtaactgtttccaactgcgatccttgtcctgatcttcagacctatctatccagctgcctaggaacttccccactgggtgatcccatagagcatctcaatatgctcaaaacagaattcatcatcttctaaccacaaaacactccctcttcctatgttttcttcttgaagaaaattggaaacatcatctacccagctgcataaaccagaatcctggaactcatccttagcaattctctttcctaactctctatatccaatcaattaataaatccagccaaattctaaatatctctcccatctgaccactgtattttaactccataaccatgatatgtttgaagaaatgaaaaaggtgcagtgtacctggacatagagtacaaggcaggtgatgttaaggcatttagactttacctttccacccccttctgccagagtggtcttgatgctgtggtcctagagctaaaaagtcttcagtaaaaataagtttgggctgccccaaatatgattttgtaggataagtaacatcacttttacttggttatttttaattacccagctaaactatggtattctatcacaaatttatattctgctaaacagaaaaccagctctctataaagttgctacagggaacaatgatttccagatgagtttcagctgtgtaaagtaatgccttaatgggaccaccagaattctgtctgtcacatttaagaagcaatgcaatatttaaggtaaacaagctaaactggatgtgtgtcgacggtgaggttcggggggaagaaaggatggaaggggtaatgaagaacatgccaggcttaagaatgcataggcatagttgacagattattgattcaccattaaaatggcattaatataaagtgaataaaaacatacgatgtaatcaggatgtgccttaagttagtagctgttaaaaagtcattgttatggtacttacatctgcccaaaactataaatagtggcaaaattcattaaagaaatgttaatacagaggaactaaagcatacacagtagaaagagaagggaacaacgtgctagcaaaaatctgcaaagacaactccgtcaatacactaaaaatcttgaattgttcactttcagtgggtgaatttcatggtttataaattatatcccaataaagatttttttaaaatcagcaatggcataggaataatgacctgagttgtaaaaatcaatcaatattcaaagaaagggcaggtaattttccttgatcccatggcagaaaaaccagaggcaaaaaccatttttacatttcttataacaaaaatagacaaattgcctatactaaaaagaaaaggggaaaagacattgtcaaaacacttaaagaaagcaatctaccgacgtctacattgaatattactttaattccactgttttcttctgaagactctgctcagtgagataattatgttttcacaaacacagaaatcatactgggaactattatcgtctttaaaaaactacaaaagtatgtgtcacaaagaaaactattgtaagttcagagaaagtatggaaggctcaataactagaaaaaacaatcagataaagaaaagagaaattctgggtcagtgatcatttcctttttaagacagggttccaaaaaaatgtagaaaagatggacacaaagcaggaatacccagctcctcaaaggcacacacacactcatgctgggcaattgttggaaaagacacgggatgcaaaatttttagtctctattagagaaacaagttagctcatgtgaaaacagagtccttttgaaatcactttccggatttcactttcagaaagatagatgccaaaagtggaaggcatgtatatgctcagaatttgatctgccagaataaaaattgattatacctgcctttgatatcattcagttctagttacccaagaaaaagtttcagctgataaagaaacgaaacaaaacaaaatgaaaacctgccctttgatttccatcttcagagatacctcgctcaaacacaggaactaaatgtaaatcacttggtcttaaaagtcagaacatgttcaattcactgattcagcacatggcttttacttaattaaagctggtctgaaaccagctttgtttccttatagctacccaatataagaaatagccaatgagcatgtggacagaaagggcactggccctggagtcaaaagttttagatcttagctcaactctggggactctcaaataaaccaattaaatctcctctgaaattaaagagctggcttttaatctttccatctctaccttaacatgccaggcatgtggtagatgttcaataaatgcttcctggattattactactaatagctaatagttagcaaacccttattaagtatgtacattatattaatcatcacaataaccctatagtgtaaattttcatattatttgcatgtcataacttcagaaactgaggtttagagggattggtcatgtgctcacgtgactcagctggtgggtggcagaaagatgaccgcagggcccaatttcttaatcaatgtgcactgccccctatctgaacttaactggacactggccaaagtaatcatagtgatcaatgaacaaatgttgctcctccatttaatctctgttttattgctcacctttccccaccatctgtctctctgggactgtcgacaattaaaacctagagatccttgctactgagagtgtggtccatggactagcctcgtaggcatcatccaggagcttgttggaaatgcaaaaccttggccacactctggaaacagaatctgcattttaacaaaacatccaagtgagccatatgcatatcagcttccgagacactggtttagactagatccaaagtaaaacacttccttcatgataggaggaaagaatgtccaagaaggaaaatatgacagaagcgttgtgcccagagagaacaaaaccagctggctttggctgtatcaggaccttccttctcctggatagtgacatatggatatttgtaagtcaggacctatgaagatccccagagaactggtgacagaagcaataactgaatctatagggagtgtatctatcattctacttctctctgaaatttccaaacctgtctttagaagcatgtatcatgtagcaaataaaaatacattaagtctttggcaaatacagaatcactcatcaggcaaagtagagctgccctgtggattgataaaactcaacatgtgtatgatattaccaccttccttcacaatccagcagttgcttcttgtcaaggccactttttccttttaaatattaacacaattttttttttagcacatatacaacactaaggctaacaaacgagcttaaactggatttaaatgagtttttttcagtaaggtttatggttttctttttaagcggtatgccttattcaggcagaaggtcctgcatttttggctgagaggtgcaggacagtagctgtcctctcacaagagagttcattttgctcaataactccacctataaaagtcatgcaaataatggaatgaagttatattttgatgatatccagatactgaagatactaattactgaagatactaatttttttccttttcattcaagaaagataattttacacttattctttgaaagagaaattctatggaattttcttcttctaatttaattccagaatacattctctcaaccctatgccctcatactagtaacttgatggttagcgggtaagtaggtagtagtagaagaacagaaagggaaatttggggagcagaaaagggagaaaaagaagaaaagggaaccttctagtttcctaatagaaaagctagagaattccattcctgaaaattaaagatattttacacgtttgtgtatgtacgtggctttgtgtttatacacataccgttttgtttcatgtagcataatcaaatctattgctaattgtttagttaatatttacttattcaaacatctttttaacatcttgcccaatattcaatttacattttacttagcaattagcttgtctggccacttgctgttttacttcttttcttaacaaaaacccaacactgatgttctaacagaacagtcttactgtcctttcggttattgtcatttctcttgcttccccaagggcagaagctctgctattttgcttgcaaaagcaagactgatatttcattgttgctacaaaagggtcaagatagagttatcgaaccctaataactccacctataatagtcatgcaaataatgaaaggaggttttagtagaagccaagaagtatatttgacttttttatttattcccgttttaaaaataaattacatttattttttaaaattacatttttacagatctacacttcctagaactaagagaatgacacagtatacaggtagaaattctttcttttattgagttttatcctttttgtgatttaaaatctagcaggtggtttcttttccttaatgccttcaattacacattcttcacactttctgctatcactttccctgccttcatctagtgataactagaataattagaatggatttcttgctaatcaatcatctaggtattatcttctagaaagtttgcaagacatccctccttcaaccaccgtggttctataaaaagaattgcttttaattctcaacactcttattctgttactgtcatgagacatcctctagtttcagagaatttctataaactgcctaaaataacctaggattttacaatgatggaaaaggaagaaagtgagcatgctcaaagtcagaggatgagagggaagcacagcaaagtctggggcagtgcaatccaaggtgtctggctcaaggcggagtccagaggccactgcaacctggagacacatgttaattaccaagggagcacctggcagggtaactcaccagcctgagtcagcctaggatgggagcttaagggggacctgaggaactccaagagagaatcacatgcatgagttttccacaagggacccaagttcccagcccaaatgagacaagcaatggatcgtattaaaagctagtaacaattgtgctgaagcaacctcttgctggtggcattgttaatggagacaccattctcaggcaaactttagtaggatatttgaagagcaacaaaagcatttatactttttgatcgggtaatcacactgtaaaaatatggggaaagggacatacacagagttgttccttgctaaataaaagagacaaaatttaataagataaatgtatacatcttcatttaagtttaaacacacgtatacatgtataggctggcagttgcctggactagcagctattcttgtgagaaagccctgggaattttggatcagccaacatcacagcagggctacttgggagggagcagagcaagtggtaggaacacactttatagtcaggcaaagaagggtctggatatccccttctacagaccatggcaagtcactcactttctaatacatccagccatccaacagttaaaaggcctttgaaaatgcagagcttcctaaaaaaggagatgcttcatcagcccctgagtttcctagagccagcactctccaggagagcctccttggtctcagaaaacacacgctggcatctacctcaacttcagaattgcacacctgactcttcctcctccagacctaggcaagacctccaccagagcaaaaccagcaaaaagcaaggagaagaaggtggttttaccggggtgtctggtgctgtaactatgcacaagggaggcagactcaacttggatggagaagcctggaaaattcaaactcaggtgtcaagaagcagtgtttcctaggatttacagagtgggaaagtattaagtctagtgctcagagtaggcacgtggtaagtcctgagactcccagataaaatgaccagcacctgggctcattctgtgaagaatgttccagttgggcctataattaatccatttaagatgtggaccagtttttatgaatcacaacaaacccttggtaagatccactttctttcctttagatgcaggccagcctctttgtttcccccgttaacacacattttcttaaattaaccctctatccacacattaagaaaaaatatctatacatactccatgaaaactgcaaaggtctcagattaatacagaaacgtaactttggactctatcttcttatcagcattcatttgaacactggtattaagtttactgtgaactttatcattcaaccatatgtaaaatgttacaatcattttatttacatttctctgagcaaaggtggtgggtatcaaccttgtccaacagacgagcaccttacttacatcaggatattagcagacaccaagtgaaaatgaatgatgcagtaaccaagtgcaagggcttcacagtcttattccccagatgatgctacttttggtctaggagaagccataggctttttggtcatcttcttcagccctcagttaatcaaggtttgtctacacattttatatccaaaaacatctcttatagttgcaaactctctaaaatcagatatagttaaatatccacatgaagtaagatcaagttccctcttccactgtattgagaagctactaagtgtcaggggctgggatggggtttaggaacacaagctaaacagagctctctctcaggggctcacaagccaggggaggacacagtgaattctcaagagtgtgaacagaagtgtagcggggacccagaggaggagctgctcaacatctgggcattggggaaggttgccgctgataaagcaccttggacaggaatcttgaagaccaattaggagctcacgtgagtggaaagcccgttccaggagagaggaaggggtatggtgggtcggactgtgcaatctaaggaacaatatatgcatctctggatgtctgagcaagaaagtgagttaggtgaggataatgataattgttttcagatatctgaaggactagcagattaggcatttggttctccatgtagaagatattactagacttgggagggtaagggggcagctataagagtgtaaatttcagtttaacatgtgtgagaacattctataaaacagaactattaacaagaaaactagttgccttaagtaagcaattttacttcctgattacatagttttggagtcattttggattctaattctaacttagctcatagtaagtgcttatgatacatataaatagtagctattcatattgtgagatggtgaactcactctcacactctgagttccagcaccataccacagcaaattgtcttctatggcaaagtctcatgccccagtgtgagtgtggaccagaaaccatcgaaggtccttcccagcctgggactctcatttggttgtctctgctcatttatgatttggcattattccctcaactcacatggaaagacactgaaagaaaggtttattaaaaacatgctatagaccaggcatggtggctcacacttgtagtcctagctactcgagaggctgaggtaggaggattagcttgagcccaggaggtcaaggctgcggtgaagtttgatgacaccactgcactccagcctgggcaaaagagcaagactctggctctaaaacagagaagaaaagaagagaaagaggaggggaggggaggggaggggaggggaggggaggaggggaggggaggggggaggggaggaggggaagggagcggaggggaggagaggggaggggaggggaggggagagacaagacgaggagaaaaaaggagaaaagaaaagagaacctgctgtatacatgttggctatcattactactgttattatttcctctgatattatctttctattaacacaattattcctgatccctgattttaatgttttattcttgggtgtatgtatgtgtatatgtttaatgttatgcaaatattcttgtaagccaattcaaatccttggtatagcataaagtcataaaaatagaataaaataacattatacagcttattttctttctttcttttttttttttttttttttttgagatagagtcttgctctgtctccatgccgatgaagttgataggtcttcctaggaagcagtaatcagcctaccacctctttctcagacatcattaggtaaatgctgaatggcattagcgtttagtttttaccaacctaggagaaatggaaatataatttcatacatcattactaaaatgggtgatcaaagctcactgtagcgttgaactcctggcctcaagcaatcctcccacctcagcctcccaaatacctgggaccatagtcacatgccaccacgtccagctaattttatttatgtttttagtagagatggagtttctctatgttgcccagagtgatctgaaactcctgggctcaagtgatcctcttgcctagactcccaaagggctgaggttacaggcatgagccactgcgcctggtctacagtttatttttgatgacacataagaatcactaatattcatttaacacttataatgtatggggcattatgataagctttttatatacattatttcatttaattcttacaagaaccctctaaggtaagtacaattattatccccattttataaggcaacgaagttgagtcttagagaagtcatgtaatttgctcaaggtcacaactaataagcaatgatctaacccagtaattttgcaacatggcctacaacacactcacattaatgagtatgtacttttctttaactttgaaaagttaaagagttagacactccagaggccaaaaacaagtcatttaatccaataaaacagttggcagcactgacagagttcatttggtcttaatctcacactcaggacactgttgggaagatggggcctgcagagtaaccaggtcatgtttgtctacacggtctttgaaaatcaaatcaaaattttcaggattctcacatattgcatgattccattcatatgagatgttcaaaatgggcaaatcaagaaagaaagaaagagaaagaaagaaagaaagaaagaaagaaagaaagaaagaaagaaagaaagaaagaaagaaagaaagaaaggaaggaaggaaggaaggaaagaaagaaaggaaagaaaggaaagaaagaaagaaagaaagaaagaaagaaagaaagaaagaaagaaagaaagaaagaaagaaagaaagaaagagaaaaagaaaaagaaaaagaaagaaagctgcctagagctaggggaggaaaagagagaggtagggaggatgggtacaaagtctccttttggagtgatgaaaatgtttaaaaaatggactatagttatggtcacacaactctgtagatattcaaaaaaccaatgaattgtatactttaaagggcttaacttgatgatctgtaaattatacaatatcaataaagctgttaaaaaacgatttccagagctcagtatcaagtgttctctagtcactccatgaggctgccgtcttccagaacaaacatagtaaccagatgtgtgtaaagtaagcttgtacccaagaacaaaatgttccaacaacaatgatgagagtaatgagcatgctggtgaagttggtaggtcttcctaggaagcagttatcagcctaccgcctctttttcaaacatcattaggtaagttctgaatggtgttagctttgagtttttaccaacctaggagaaatggaaataaaatttcattcatcattactaaagtgtgtgaaaacgagcagaatattataaagagcagcagagggggaatcaaaggaccccaaaagcttccattcgaatctactacgaccttgtagacttgaggactcaatcattttgggcttcagtgacttgatctgtaaaatgaggaaggggaagtatgaagtcagctactctaaggttttcttctgtcttcagcattccagtcaaatcgtcccttctaaggattgtcttggtatgctgacttgtccctttcatcacatcatcaactgcgtttagaccaaagaattgttatccagacatctggacatattgaaaatctctcaaagaatctttcctggactgatgtttcaggtatttacatgaacttcctccgtatcctttattaaatacactatctaccttatagtttaattagctataaaaacctaactgaaattttaagcttgacacagaaaagtcaaaaaggtgtttcctaacatgatgtataagggcagcaatataattgttctccaaagtaaaatgattctgtcctttataaaaattcattttacctcaactctaacctgtcacttctaatcaattttaatttttattataaaaatgataaattctcatctaagaaaaccttaaatatatacaaatttgaggaaattaaaatcagttttagagccaataccttaaatagattaagagtaatgttagtctactatttctactattatatgttggtatagtctcacttttttctccatgaatagtttttcccttttttaaaatgaatataaagtaatcatgtttaaaataccaatatgtagaaaagtataagaagaaaatataaatcatcagaaatcccaccttcaaaataacccctaaatccctattaacttaaggtgatcatccgttctattgtctctgtaagcataacacacacatagagaggtatattttaaacacattcagatgtgtgatggagagatagtttaatatccattatttttacttaaatatctatcatcaccatttcctcctattacaattttccataaataaaattgtgatggtccgtcatgcaattttcttctgctactttatgtttttattatttgcaacttttcatggtaataaataatgcttcaattaacatttttatacttaaagcgtctacactcctacctagaaaatttaaatctattgactttttccttttgtgatttcctctattgattttgggaagagaaagtgcttacccattcaaagatcagaatttttattttttcgtttcttttctttcttttaagttagctccttaatctgtctgggttatcttgttctatattgttaaaggttctaaacttatttgtaacacgtttaaattttagccaaattgggtagaagttatttgcccaatatttttcaaatgcacatttatgtcttttaaaaaaatatatgtctcataatcttggttatccactaaacttaaggaaaccttcaagactgccaaataaccagagctttgattactagcaggaagtcatactgggcagaaataaagaggacactcctactggccaaattaaaactaaacaatcagaaaagtccaagttcctagctttagtggctttattattttagccttaaaaagtctctaaaatcccaaaagtagcttaagtgtttaaaagacagtattcaatgcagtgggctattctccatacggcctggccactactggtctcatttacgggccatgggcaacctctatatcctgccattggtcaccaggttcttgccactggtcacgagcagagtaggtgagaaagtggagcacaagcttaccaacccaagtagagaaaggacaccaatggcttgccttgctggttgacagtaagtcaacagagcatcttctaaatgaagagcagcacagatgtcagtatctacatggttgtttctcaataataagtactgggttatattggacataatacaatccaaaatgtattaggttgtatttttttcttatatttttctaatattggattctattttcagttcttccccctccacagcaccttctgatgcacaacactgtcatagctgcctactagttgctctgacttaggtcaatctaactttcttgaatagtttcctcaactgtaaaatggagataataaagaaaatcaacaacttaaggttgttgtgaggattaaggaaaaggcttagaacaggccgggcatgtttacaaggctcatgcctataatcccagcattttgtttacatggctcatgcctgtaatcccagcattttgggaagccaaggtgggaggctgacttaagaccaagagtttgaggttgcagtgagcagtgatcgtgccactgcactccagcctgggcaacagagtgagactctgcctcaaaaaaaaagagaggggggctggggcttagaacagtgactgcacttaggaaatgacttttatgtgttcattattattattattattattattattaccactattctaccacttctgctatgactattactactaactggggtagtactactaccccagaaatgctgggtcaaacttaaattgggttcttcagaatgaaacaggcaactggggagctctgtggtcagatcagctccaggagtatactctatcctcaacttttgcaatccctctgggaagttaagtatttactgacattactaaaatagtgaatttccagggtggatggcatcacaatctcccacattttctggtacgtaaccataagacctatgtgcacacaagcacctggttcttgaggggggcaagaaccaggaggttaggcatggaaaaggcagatgtggcacagttcattttagtcaatacatgaagctgacaaggctataaactgcagatgaaaagcctgcacctcccaaaccgtacgctgcaaagatcaagactatgtgtgatcacacaggaacaaggagtgatctgggctgtgaagaacggaactggtccatcaggtgaaaatctaccaaggttcgacggtcagaaaattcatctctaataccactactactcctagttcttcaattctttcctcagagtcctgatcttctactgccatgcaacttcctcaacgtttggggcgtagccaattcaagttaaaaaagtttgcctaagaatttctctccagctttgaaactcagattcattttataagaaaattggcatcacgcccttctgggtcacagcgaggtccataaaccatctgagatgtgtgagacatctaagtcactttgactatcaacaagaaagcatgttggataaaaattaattagcacaaaactcaacttaaaattagatggtatgttatgagacaaatgctcatctcttattagccaaaagacccagatataacaaaattaagccagtccagcagaatgagagcaagaatgcaatgtgtgttccaaacctagaatcaggaataatctaaggtttgcttagacactttaccccaaatttacagattttgaactctctactgtacagtccttttttttctcccacgtttggaggaaacattttaacgtgtatattctctgggaaaaccctaaaatctggtttttagggagtttccctcttatctaatcctttgccacattatttttgtttcgaatctgtggtctttgctttgttaccatctctagatgaaaagctatgaagcacttgggaacacagaaactgagatccacaagatacaaatgagtttcatgtaagcttttaaagacctttatctgtacccatcaagcacaaacaagtaatcaacgactaaaatgtcttaatatttctctctaaaatcatcaggcagctacaatcaggtggacaagtcgttccttaaaatttaatatcatttaataattaataattgcacaatagcatatatgcgtagtaatagcatatatatggcatgtatataaaacatagcaaagtcatagcaatctttgcacttttgggaaagctaaaatgatgtaataaacttactgttaaagaaaatatctacagaggcaggggcaataacacagctgtacaattgtgccttagggggtataaaatacagtccactttgtaatcccgaaatggcatgcagccataacattgtaacttcaacttagcactgatggggaaagggatccttaaagtttagcatatcacctcagagatcttttttaagtacctatttctgtctcccttccccctcaattttttttaagcagagaagaacatgaaagaacagaccctttctaatacactgtatttcgcagtggggaaaaaaggagaataaaatggcaataacagaagcatattagcatatttaaaacactagtacattaccctgaactaaagcatccttaaagtaacatgaaagcaagagaaactatatttcataaagtgttgcaaactttaaaacaccaaattgaactactcctatagaacaatttcatgccagattgctttggtggcaaattaataaaggcagaattgctctttagatctttaaattaacgagattaaggaagacaatgtctttctctgtgcttaattatattgacttaatttcttaattactattaactatacttttatgttttacaagtcacactccatttttacagctgttctttaatcctcgggtaatctcgtattctgaagaatcacttgagaataaaaacagcaaaactgaagacaaaattcaattgggcttaatccacctgtacattctgcctgaatcaattcttatgccagtattttgaggcattccagaaaagtgccagacttttcaaagagaaaaattaaaatgatattctggttcactgaaactccaaggagtaggcctgaagaaaaaccgtgcatcagacaagcacgcaccagtggggtgagggaggacaaccccaactggggcccaacactccactacttaacgtttcaaaaaataaaatcaactgtgtataaaatcatatttatacctagaaggtctagtgcgacgacacaaagaaagcaattataagaaaggaactaggctaggcaaggtggctcacgcctgtaatcccagcactttgggaggacaaggcaggcaaatcgcttgagccctggggttggagaccagcctgggcaacatggcaaaacctggtctctataaaaaagtataaaaaaaaaaattagctgggtgcggtggcatgcacctgtaatcccagctattcaggaggttgaggtgggaggatcgcttgagcccaagaggttgagactacagtgagccatgatcattcaactgcactccagccttggtgacagagcaaaaccctatctcaaaaaaaaaaaaaaaaaaaaaaagggggcgggggcagggctgatatttactaacaagacctctggactgcaaatccaacacagatactaatatgtcatttccacttggcttccagttgtatttaatatggtcaaaaaatgcatatattataaggagaaacataaccccctaaacctctgcaggataaacgaactcacattattttctaaaagaacgcagcaacccagtctgtcctatcatcacaccgtgagctcagaaagaaaatctgacacacgcagcagaaagtgcaaaatgttatttactaacctggtgcccctgtgaaagcagttgctccatatcaccttaaagaaagaatccttactatgaaaccaatctccaaggcagctgatagccaagaggtggcaaaatcgactaccctgagaatccaaataaacgggcaaagccttcctgttcccaagcccagttttggctgactccctcaaggcaacttaagtcatagccaagcccacaaagcactttagcctataagctttagtaatgaacttgaaaccactccccatatgttaaagagacaccggactgctgtgagaaataaaacccacatacagaatgagctacagcttcaggctgcacttttgtacttgctgcccaagaaaaccataacacaaacttaaacaaagagaactctcactcccttctctcccctcagacactgcaataaagtgaatgattaattttaagcaaggggatacagtctgccctccattagggccatgaaatgacttttatattgttcaagttgtgtggcagttatggaacagatagcactgtaatttcacattgcataagagggacatatgaagttatcatttctgagaatcaaatgtagatagtattactattttcagataacattgaataagcttaaaaacctcatcaaatccaacgattaacataagttcaataggaaattttgtcaaagaaccttctaacttctgattctgacttagtgtctataaatcttaaaaacattcttataattcagtttcaccacctacatttagaatggatgtataagctaagacacgtcttttaacatggatctttaagctgccttttaaaatggaacttaataccactcactaagatttcaaaataagaaatttatgtttcattctagaaaaatgtagtcaatcaattccttaaagcagttagatcttaaaacagagtcagtaatgttctagcatattgttagaacatcagctttttaacacaatgtgttcacagtatacttattttcccctagttttcaactccaagaacagttttaattctaatggcttgttgccatgatttgtattttgtttaaatgagacttatttcaacacaataaccaaggtttttgaactttaattattgtttctcctaaaccataagattggaccaaatatgcaggcaaagcttgattcacctgttgccaaactgatttacatgaattactggtaaaattcaagttactcaaaacctgtgaaatataagccattagctcaacaaattcacccatgaaaatcctggagactattttagatctaatacacaccttgcccacccctctacccactcccaggtcagggctcaagaggatctcatggggtcaccatagaatgagggggcaagataatttcttttctcagggaaaaaagaaaacgagcctcaagacctgtggctgatgactttaaaaggagctagtaccccacctgctggcaaaaccaagcgaaagctggatgagctgaacaaacctcaggggaaatgttattactttgatgttggaagaaaaacagagaaggagcagctatgcgagcacattaatgtcacattcagtatgtcgttaaatattattaaatttttccccacaatagtgatatatttctagaggatataaaaatgctcatgcaaaaaaagtagattcaaaaccatctattttacatggatctggtttgcaaacatatatgatgatttgcatgcccaaggaaatcctctgataaataatattgatctctcctctgcagaaagagcttcaaaaaatactcctgggagaccaacacaatctttgaaatggaagaaatatgaataaatccccaactcagctagataaactactggtggggctgtgtctccatcagtctgtatgtctgtattcccagaatttctcttatctttcagcaaaaatttatttccttttgccacatataaattaattcttctaaaatgaatatctgatattaaccttaatgaagatgaagaaaagttaagtggtgggcaccaaattacactacattctttaataaaaccccgcaataataagagtatagcaggatatgacttttaaatgagcccaagctgtactactaaaactaaaatgaggccaggtgcagtggctcatgcctgtaagcccagcacgttgggaggccgaggcgggtggatcacgagtcaggagctccagatcagcctgaccaacatggtgaaaccccatctaaaccccgtctctactaaaaatacaaaaattagccgggcgtggagtagtgcacctataatcccagctactcaggaggctgaggcaggagaatcgcttgaacccgggaggcggaggttgcagtgagccgacttcgtgccattgcactccagcctgggcaacagagcgagactccgtctcaaaaaacaaaacaaaacaaacaaactaactaaaatgaataaggatagctattatataagctcttccgatgagccaagcttggttctaaagtgctttataagtaccaactcatttaaacattaccactctattattataccagtttgtttgtttgtttgtttgtttgagacggagtctcgctctgtcacccaggcgggactgcagtggcgctgtctcggctcactgcaacctccgcctcctgggttcacgccattcttctgcctcagcctcccgagtagctgggactacaggcgcccgccaccgcacccagctaattttttgtacttttagtagagacggggtttcaccgtgttagccaggatggtctcgatctcctgacctcatgatccgcccgcctcggcctcccaaagtgctgggattacaggcgtgagccaccgcgcccggctattataccagttttacagatgataaaactgaggcgtccaaaggctagtaagtacactgccaagatcacacagttagagacagagctgggattagaacccaggtcggtgctcctagccatgtactttaaaaactctttcttcctgagtgcgtaccacttaaaccctgccaggccctggtcaaatgcaagggcgggggagacagtggataaggcctgcactgtgaacagtcctcataaaggctttccagagaagtggccacagaactgagacctggaggtgacatggaagggaaagggtccccagggagagggcactcactcagtctgccaaggcaaagggtaaacggggtgggggacattggagggactgcctgcagggaccttagtaaggctgagggaccagcagaagaaaatgctgtgaggaaggcagagtcctcttatgtcacatcatggagcaaagaggcatcaccaacggatgctaaaccggaaagtgtccagatatgcatgttgaaaaggtaagtaggaggaatgaggcctttttgggtgagtaggaatttagacattccaggtaaaggcaagcacaggccagtgctgtaagacatacaagtttatactttcataaactgtatcaaggaggcttgtgccgtaaaccccgcagcagcatgcgcactggctcccttgtcaagccagctcggggctggagccacgtggtggttactaatgccattcacagagttagggacaaggaggaagggcagggtggtgggaggagggtggggagatgctcaagccaaggagttcactgagggaggctgggtttgaggtcctctgagctgttcagggaggatatccagcaggccccaggagatgcaggccaggtgctacagtcctttgcctagacagcagaggtgcacatttaggagtcactgacactgaaggagcagctgcagctgggggacagtgggacacagagtttgtccctggaaaatgtacagcatgagaagaaagagtgaaatttaaggcaaggctaagggtgtcagacagaattcaggctgttgataaaaaattttatttttatttttactaacttctaactaaaattatcatttccttctgtaacttgtcatcaaagatattttctttgacgtcaaagatattttcttagacatcaaggatttttcatatcacattagttattgcaatatctcaaagtatcatttccactcatcactatttcaaaattacagtagttattagacctgccactagatactggtaagtaatgcattttaataaaggacatgtattacaatatgacatatttacttctttgcatattgataactttatgtcagtataattggtttcctttgtaatcctatgcattttaattttatgtgtttaattttacagaataaatattctgtagagtggttcattagcttaattagaatgtcaaagaggtccccatggcacaagtaaaagtaaagaacatctgatttaaagagggaaagagcccagcgcagtggctcacgtctgtgatcccagcactttgggaggctgagaggggcggatcacctgaggtcaggggttcaagaccagcctggccgacatggtgaaaccccgtctctactaaaaatacaaaaattagccgggcgtggtggcacacatctgtaatcccagctattcaggaggctgaggcaggacaattgcttgaacccaggaggcagaggttgcagtgagcagagactatgccactgcactccagcctggatgacagagggacactctgtctcaaaataagtaaacaaaaaaaattaattaattaattaaaataaaaggggaaagaaaaagccacaggaaaacacttaaaaatagctctgcgaaaagggggaccctagtatgagatggagacagctttcaaagctaggatgcaaacgcaggacttctgactttgtgttctttctaccacgtgactccacaccctaaaataataaaaacagtaaccccttcatttgcgtaaacaaagggctttcacatgtattagcctgttagttcatcacatctattcagagtaggaaaaggcaggaacccaaacgtgccttgaagctgccatctaagaagacactccttcctgggcctcagcactgcgccagtgctgcagcggacggtggtacctgtcaccccactctatggagctgtagtcatgggcacagaagagtaagatgaagagcccctccctcataccacactagctagaacctgatcgcaagaggtgggcacagtgggtgcccacccaaatgatgagttgcacttctctccaggcttctatttacaggtaaggctaagaatttgtttccttgctcaaagctcttttatttagttctgattggtgatccagagtgaattacaagatttgcaatatttcagctctttaatttgccattggctctaaccaagacagaagactttacttaagcaattggtttgaaattagatggacaagctgaaacaatgggctctctgttctttcctctctgtgcccaccaactggcattcattatttaatctgtgacgtgtgttgccagggctgcggtaatgacaacggcacctattgtcttcacatcccttccctattctgtaacatctgtcatggctcctgtctatatttcattttattttgttttattttgcttcttttacttttacaaggttattcttaattactacaaattgctctgaaatctattctaaccctgcaaagtgtagcatcattttgtaacttggcaataacaataaactgaaggcgcgtgtgatagcacccttttaaattactgtaattttacataaaactgtataatttcaaacaaattttatctcaaggttaactagataacctctctttttaaatacctgatcagttcacagacgactttggccccttctcatataatacatgacttccttttacacaataatgagaatgtgggtttatatgactaatctgacacaatacagtaacttctgcttaaaaaaaaaagctgaacatttcttaatatgcagttacaatgtaaattactatgttcatggatggatctttaatttccaagtttctctattattttctttcttttttaaataaggagccagagtgaaaattgtcacttgccttgtaatcagtcacctaaaaactagagtgaaaattgttgtgtgtgaaaagagttcaaaattggtttctatgtcccaggaaccggagagctggtcttcctactgctgtctgtctcaggacacagcacacccatccgctgtaggaaaggcagaggtttcgcttagagctgcttgcgtgtaagggaagagggaactcaacctggcaggaacaagcccttgatgatttaccttctttcctaattgcccagaggcatttccttccttgcttacccaatctaaggaagggtttcctactgccctagcagttcctttaacctgaagccattttctctagttcctaccctgttttttgtgttgctctcaatctgctttctcacaagacctcactttccagccaaattggtttattctgtttttcaaattacctagttcttccttccttttgagtttgtgccactgtcccaactgtggcaatgcccttccccctcctcgacagtaaaggagtcaaatcctccccagcatttcaaggggcggcccaaacccatgtcctctacaaagcattttcaggtcaccctgctttaaaaaaaaacaaaattgctcaacaactacagcaatcatcatcagcagccgcaaatccattaggcaacaaattatgccttgcgactttctattttatctggatgggttatttaaatagtgatggcatttaacttttcatgcatttataactacttcctccaacttagtaatcagtaactacatattacaagttatacctctgaaatcaaccattgtaaaaagcatatagcaaaaattctaccttacattgcattcatatatgtatttgttgcttacaagatatttaaattatttatgttacttaatgataattacaaaataatagccaacactattgccataatatcttactagactcaatatcttatttgacattcacatctgccatatgaattagatacaattattttcctcatttttcaggtgatgaaaatggggccagaaagcttaaatttcccaaggtcaggcattcaacacgtacttagtgagcacctactatgcgacaggcattgttttcagcattagtgatgaaagcagaaaacttctatcttcagggagtttatattctattagggaagacagactatcaaaaattaaaacaaatatatataaagccagataatactaagtgttgttaagaaaactaaagcagagtaagggactggagagagatggcatctggagagagatggcataagtggcgaggtagcacactccttagataagatggtcagaagaggcctctctggggagatgacacttgagcagagacctgaacgaagtgaggtgacaggctctgtaatcatctgggaaaagggcccaggcagaagaaacggaaactgcaaaggcccagaggccaatacaaacttggcgtgttcaagaacaacaaaaaggccagtgtagtcagtgctgtgaaagaaagggcaacagtagagggtgtagtgagagaagaaactagggagtccagttatgtatggctttgtaaaccattgcatagtttcatttacgtttttccttaaatataatgaaaaggccctgaaaggttttaatcaagaaagtgaaacactgtgccatttgaaaagattacacaagttgggtaggtaaagaaaagactaaaaggggctgggcatggtgctgtaatcccagcactttgggaggccgaggtgggtggatcacttgaggtcaggagttcaagaccagcctggccaacatggtgaaacccccttctctacttaaaatacaaaacttagctgggtatggtggcgggcgcctgtaatcccagctactcaggaggctgaggcaggagaatcgcttgaacccaggaggcagaagttgcagtgagccgagatcgtgctgagatcgtgccactgcactccagcctgggggacagggcaagactctgtctcaatgaaaaataaaaataaaaaaagaatagactgagagaaggcagactacttaggagaatattgcagtagtccaggtgggagatgaagagaagtagtcagatctaggatctactgtgaagatagggccaagaagattatctgatgtgggtcgtgatgcagagtgtaaaaaaaagagaggtgtcaaggaagactctaagactcatatgagtaacagggagaaaagtctaattattcagctgaggaacattgtaggtgatggggtctggggagaagcagtaagtttttggggcaaatcagcagtgccattttgggtaggttaagtttgagagaccttttagatatccaaacgaagagaagtaggacgttggatacctaagtttgaggcttggatacataagtccaagattcagtcctggggtttggatatgtaagtctgagattcaggcctggggtttggatatgtaagtctgagattcaggcctggggtttggatacataagtctgagattaggactggagtttggatacataagtctaacattcaggactggggtttggatatgtaagtctggagattcaggactggaatttgtatacataagtctgagattcaggactgagatttggatacataagtctgagattaggactggagtttggatacataagtctaacattcaggactggggtttgtatacgtaagtctgagattcaggactggggtttggagacgtaagtctgagattcaggactggggttaggatatgtaagtctgagattcaggcctggggttaggatatgtaagtctgagattcaggacgggggtttatatacataagtctgagattcaggactggggtttatatacataagtctgagattcaggactggggtttatatacataagtctgagattcaggaatggggtttggatatgtaagtctgagattcaggactggggtttagatattaatctgaggactggggcttgcatacataagtctgagattcagaactggggtttggatatataagtctgagattcaggaatggggtttggatatgtaagtctgaggactgggatttggatccataagtctaacattcaggactgggatttggatacttaagtctgagattcaggactggggtttggatacataagtctgagattcaggacttggaattcaggtggctttaaacgtggtagttagctttaagcaacatattttcaccacagactgactgagggtgaataaaggagggatgtctgaggactgacactcaggactctccaacatttaaataccaggaagaagagatgggtccagtaaagggggccaaaaaaaaaaatgccagtggggtagtaggaaacccaggagagtgtggtgagaaagacagaagccaggtgaaaagagtgcgtcaatgatagagagatcaattatgtcaaaggagctgagagatgaagaaagaggaagattgagaactgaccactggatacagaaacatggaggtcactgatgtcctaaagagtgggctcaagagaaatttatgcaaaagcctaaaaagtgggctcaaatgagaatgtgactacagggcattgctgagagaaattaaagacctaaataagtggatataccgtgttcacggattaaaagaccaaatattgttaaattttctgttctccacaaactgatctatagatccaacacaataccaattataaactcatcaagcttttttgtacaaattaataatctcattcttaaatgtgtatagaaattcaaaggatttagaatatccagagcaaccataaaaaaaataaaactaaagttggaggacttaacactacctgacttcaagacatcgtagtaagtctatagtaaccaggacagtgtggtactagtacaggatcaacaaatagatcaatacaacaggatagagagctcagaaatagatgcacacttacatggtcactcgattttcatgaaggtaagagaaaaatccaatagagaaaaaaaatgacttattaacaaatgatggtaaaaaaaaaaaactaaatatctatatagcaaaaataaataaatctcaaccatgacctcacaccacactcaaaaattgagatggatcatagacataaatgtaaaaactaaaattataaagcttttagatatggcttagaaagcaatcaacataaaaagaaaaaaaaacagacttagccaaagttcaaaatttctgttcatctaaagtcatcattgaaaaaataaataagaaagccacagcctgggataaaatatgtgcaaatcatatatctgacaaagaactaatattttataatacataatgaatgcctacaattcgataaaagtgagcaaaagatttgactggacatccacaaaggaagacagactcgtgatcactaagcatatgaaaaagtgctccatgttaatattcaccagggaaatttaagaaaaacgcaatgaggtactgctacatccccaccagaacgagtaaacattaaaaagaccgtcaaacccaaatgctggcaaggatacagagacagcacaactctcattcaccatgggtcacagtgtaaaactacaaccagcttagaaaaaagtctagccgttgtttataaaactaaatatgcacctatcctatgacccagttatttcattccaaagtatttatccaagagaaaagaaaacacagccacaaaaaaagactccattcaccatagtcaaaatctggaagcaactcaggcatccacccgtagaaaaatgaataaacaacctgttgtatcatcaaacaatggaatgatactcagcagctcagaaaggaatggattcactcagaaaggaatgaatgactgatacacatgatatgaatacatctcagaaacattacgctgagtgaaagaagccttacataaaagagtacatacattgtatgattcaattttgttaatcttctagaaaggcaaaaataacatattgtgggaaaaaaatcaaaacagtggttgcctctggcagagcataagagggtggtctggggactaactgggaagcaacatgagggaactttctgtggcgatggtcatgttctgtaccttgaaaagggtttggattgcagaggtggtacatgcatttttcagaactctgaatggtacactaaagatttgagcatttcagtgtatataaattttacttcaaaagagaactataaacaaatagggaaggaaattaatcatatgtaccctgaaatgtttaggagtgagtgtactgatgcctgcaacttactttaaaatgtatccaaaacataaattgaattgatgaaaggataaagggatagatgggtgacaagacgtatgttcaagcaataaagcaaactattgattgtagaatctaggtggtggcttatgggtgttcaccttaacattctttcaactttcctgcatgtttgaaatgtttacaagatgttgttagaagagaatgtggggtaaggaattggagacagtgagaactgacaacttatcagagttttgctttaaagaggaacaaagatatgaggcaaatctggagggagatgaagaattaagaggaggtatttgtaaagaaggaagacattatggaatgtttgaataagaatgatcctgtaaaaagaggaactttaatgaagctagtgggcagaaactatggaagcagagttctgaacaggcaagagcaacagatggggtccactggggtgcaatggatgtcaaccaggaggatgcacgtttgtccatggtaaagagcaggggatgggggacagatgatggatggatgcaagagaatatgggagctgggaaactgcttctagtttcccagtgatataagcagtaagatccatggctgaaagagagagtctgggaagggatgttaggggtttgaggaaagaaacaaaggtgtgaaatagtcacctgggagagtgagtttactagggaagtagggttgccagagagggctgagtatcagtggaggcaggggtggagggtggcgtgattaatttaatgtcatcagagtgttgtgtgtgtgttttccaggaatgctccgtggtttggaagaaagtgtagagttatgcctgagtaactgtgattttaaccagggttgtgttttgcaggagactaggatagaaagaggagagaggcaagtagagtaaccacaacagtggaccaagcagataaggtgagtaaagtggaaagttagactacacagggcattaatggaaagtaaaaaggtggcagagtcaaaggagtggacgtaaaagtgttgatctgaggatattacaagacagagcataaaagttggcagatggtagagctgggatttaaatctaaatgtttgactcctgttttttttattttattttattgattgagatagggtttgtttgtttgtttgcctgtttatttgtttgtttattgagacagggtcttgctctgtcaccaaggctggagtacagtagtacaatcacggttcactacaacctctgcctctcaggctctagtgattttcccacctcatcctcccgagtagctgggactacaggcacgcaccatcacactcgactaatttttgtagtgatgtttttgtagagatgcagtctccctatgttgcccaggctggtttcaaattcctggctcaagtgatctgcctgccttaggctaccaaagtgctgggattacaggtgtgagccactgcgcccagcccaccctcttaactgtaacactctccagcattttcaggactcttgtcttatactctctgtgtctggatagtatgtgtacccatttggtcttttcaagacccaggggtattatttgacttcatattcttaaaaataacttctacggaagtgattttctttcatagaatgggaaatataagacacataaagagctggtgtaatttttgaacccttcaacaaattggctatcagagaaaaatgtatcctcctgtctcagctcaactctttgtgtcttatagttctcactcctaaaaagcacatgttgctgcttggaacaaaacaaataccacatttggaggatttgaagaaactagtctcaaagtaattatttcaagagaatttattttaaaaacatgtaagcactaagtcacctcattctcagaaggaaaaaaaaaaaaaagacagtagcacgtgttcaggcattcagaattttagagggaccgctaattgtgtatttaagaaaccatttgaataacatttaagtacccaggaaaaaaagtccagattccctagcctgaccttccactattaaagtccagtctcttatcattcccctgcacacatgccatgtcccaggcaaatgaattagccccattcttcccaaagaatgtctcatctctgagcttttcctcttgctgttccctcccctggatcaccaccactgcaacctgcccaatctttccatagacatcctatttttcttcaagctccagctcaaacacaggctccaagccagacagtgaccacactcctctagaaccaccaaagctttttacctgccacacataaggcatctatcactttgtatctggtatcatagctacctatagatagcaaatatctatagaaactccccccttagagagaatcatctaatatttgaatctggatctccatatttaccattgtagtggacacctcacacagtgcctggcatattatagtcaattaacagctaataacatacaaatacatattttagacggaatcataaggaaaagttaaatacagtgttaggtgcacctattttaagctcggcattctgtctctgaagtacagacagagtactacaggaatactacagtaagtcctgtacagatccagattttattgttgtgggatactgccaaagtatcctttgaaatgtttactccaatttaaatgcttgtcataaggttggaagagagcctagatctcaacaatttatgtttatgtcttacctctattctgttctctattccgaccgaatacggtatgagttacaaaagtgagccacatatataattttaaattttctagtagccacatcaaaagtacaatgaaataggtgaaaataatttaatgagtttatttaacctaatttaccaaaatactgtgtcatgtcaaaatgtgatccacacaaaaattattaatgagatattttacatttcttgtgtactaggaaatccagtgtctatttttttttttttttttagatggagtcttgctccgatgcccaggctggagtgcactggcatgatctcagctcatggcaatctccgactccctggttcaagcgattctcctccctcagcctcccgagtagctcgcattacaggcacgtgccaccacggcaagctaatttttgtatttttagtagagacggggtttcaccatgttgttcaagctggtcttgaactcctgacctcatgatctgcccgccttggcctcccaaagtgctgggattataggcgtgagccaccacgcccagcctccagtgtctattttacacttagagcacatttcaacttggactggccacatttcaattctcaaataaccacgtgtggctaggggacaatatactggacagtacaggtctagaacatccctgtgggcagaggctgcttctttcagccctgtactctctacagtgatttacccattcaatgggattaaatgcaacaagcatgtaaaaaccaaagtgttaaagcactaaacagtgcttaccacacaggaggggttcaataactgccagcttcctttccttcacatgcagtaggccctcaataaatgtttcttgggttgactttccaaactggaaacagtattataggattaaggccatcaggctccctttattctgctcagcagaataaagcaatcttgtcaccttaatgtaggttcgtggcacattttcctggcagaagaataattacccaccaataaacttttccaactatttggaaatagcaatttctcagaataaataaactattatcctgctcttcatcaatcccagtgaatctgattttaagcaaacctgtaggattcatttatccctggctgaactaataaaagtgaatttctgagtccaggaagataaagaaaagatccagtaagattgtctttctaaaccaaggagcagccaccctcaagtccatctggaaatggctggtaagactgattctgcattatagaatcctgtctgcccagagtcagagagaaatgcagcaatcgagctgtctaagcagatacttggatatccaaagtattagaattattctaatctcaaagaattagacagaataaagaattaggagcactagaatatttttatcataattgaatactgtttgaggactcaaacagcatttcagaatttcttttgctcaaagcaacattactgttcgggatggcaccataaaatttgtaatttaaacttccatgtcagttgagcttctgtgtcgtttaattacttactcaaaatacaaatcaacatttaaagaaatatattttatatataataaatatcacaaaatatctcatctgacaaaactgcaactagaataggtaacatgggaatttccttatgaattcttatctcttatgcaaacattctagccaatcaaatagatctttcaatacgtgcagtgcctccgtagtgatgcctcatgctaactaactcccttcatcggtaagttatcactgctttaaaccttcagtctctgtccatccatttcctgttaaattcctcctagattcactcaattcatccagccagccattcattaaacaaatattactgagttcatatctacagtagagtgctaggcacccagcacacaacagagagtcaaccaaacatggtccctgccctggaaagcttacagttgaattctcttcccaatcaatgcccattctgcttgtccacctctgggcccctctgtctctcaggctacatgcctgtgctgaagtaccaactaacaggtagctgaccagggttttaccgagtctgtatggtacattaggtgtctgtagggcatggtcatctctgtacaacacaggcctactttctggatttgttatgttggaatagattatctaccctgagtattttcccttatttttgtgatcaaattactttctcttggcaatgccttctttttttttcattaagtacctgggtgcccccaagtggatgatggttctctcacattgcaagagctggttgtacaaaatgcagcacccaagaacttcatgaccatattatcaacctaggagaaaaatgttatggatttgtgcaccaagaaaggaatctaaaatacatttgcatattttataactcatttgaatgtcatcatacccagaaaataaaattcaggccatttttcccttgttaatattcatggtatggtgtggtatgtgtatgtgtgttgggggcatggtacaaacaaggaaggttgatacaagttaaagaacagccaccttctatggagcagcaagcatattatcactgaattctcatttaggaaaagaaaatattttttccctggtaatttaatgaaatttagatattattagaaccaacttggttttttttaagaaaaaaaaaactagaaaaatattttgtaagaaaaaaaaaattgtatgattgtcagcctcaagaaaaaaattcagccgggtgcagcagtggctcatgcctatactcccagcactttgggaggctgaggctggtggatcacctgggatcaggagtttgagaccagcctggccaacatggtgaaaccccatttctactaaaaatacaaaaattagctgggcatggtggtacacgcctgtaatcccagctgctccagagaatcacttgagcccgggaggttgaggttgctgtgagctgagatcgcgtcattgcactccagccttgtgacaagagcaaaaatccatctcaaaaaaaaaaaaataataataaattaacttttgtgtttgtgagtgcatctgcacttctttttttttttttttttttttgtaaagactgaaaggagtatttctgggctggtaaactgatgagatgaatgacagagtgagaaacaggcttatcagtttaccaactgctgaaaaaaccaagccaggttcacaaggtaacaacaatacagaggtgatagaaataaatttttccttaatgcatgggattcctggattactcgtatacctgcattcattcagttagtgcttcaataaaccaagcagtttgcctctggttttctaatatcccgtctctctattagcttcccaaataaaaactcaagccaagagacaatataacaacaaataaaacaaggtaacaaacttttattacacatttgttgaattgtttaaaaacttttcatgtttcctgaacactcatccaggaaagtactgtcaagatgatgacgaaactcagtttattcctggacaaaagagctttgacacatctgcttgtggttatctacgttcataaaaacacatcactgtcatcaaaggcttaagacaaagaaaagcatttattaagttctgtctatatatagtacttcaactgccaactctggtaatttgtttgagcttagattctctgcgtcatgagaggagttggtttgcatctgttaatgagactgtttttttgaactgtattcctttactccaatatgtattgcataactaccctgtgctatgcactctgctaggcactgagaattcgaggatgaataaaacagacattgtcctcaaaaagctggcaaactcatggaggaggcagtctacatggcccagccaaaagtctactgtgcacaaacaaagctgtgcaaacacagaggggaacagaagtaattcagcatgctaagaaaatggtggtcagggccaactcaccaatgcacaggatttttctatctacaggcagacaagggaggaagggcatcctattcaaagagctccaaaggagaaaagcacatggcacgttctggaaccaaaaagccctgcagagggcgtgggacagagatggatgtatgtacattgcaaggctggaaataaagttgaaaaaaatgcatggcagccacatacagaagggtcttgaatgacactctaaggcgtttcagatccactcttgggtgatgggaagttcatggagggatttaagctgtagaataatgtaatctaatttatgcttcagaaagatggctctgtaaaactaggtacacgaagtcagcagtattcctcagataagagcccctttgggcagtggccagagtgggaatatctgtatacaaaagacaaaaaaaaggtacaaatgagaaaaaaatatttgtgctattgaaaacttggacatctttccattcattttaaaagcaaattttaagtgctactaactttgatgagttcacaatggctgatgaccctcaaattcttcacttactcttcactgtctatgacagaggagaataaagcagaaaacaaaacaaaacaaaatgcattaataccagttcctgattttagccgataatggtagcatcactcacttgctgccagatatcagaatgaagaaatactaactgctgtttttacctatgtctctctcttcatgactactaaataatagtatgtgatgtggctgggctgaaccacattgcccagaattccccttcttgtaggcttccacgtagggtcaaaggatattctctcctaagaggtggggaaaagaaaggagacagcaacattttgcagcatgcatgtacacacatgcctttacctagttattcaatcaagtactaatctactgctgctgtgaagggattttgcagatgtaaggtatgtaatcagttgattttagttagtcaaaagggagattatcctgagtagaactgaggtaatcagctgaaagtcctttaaaagagggcttaggccctccctggattcagagactccaagcttcagctccactcacagggatccagcctgctcatggtctacctgcctgactggttgccctgtggatttcaagcttgtttagccagtcccacaattgaggaagccaattccttgtaataaatcccttaatgcatgtaacctactaagtctgcatctctggtaaaccctgactgattcatgatgttacggttattactgttgtgaggacacagaggaagacctcttggcgtggaatcacccagaaagacactaaagaatctcactcttgtactagctctctcccaatctcttgcaataatggccaggagaagagaagattgtgagttaatttttcaaaaaatgagatttatgataatttagagatgcacagtgaggtgtggctatgttactaagctctggccaatgagatgtaattgggagtactggaattatgagacagggcctgcaaaggaagctggcatgctcctcttcctctattctctgtctgtaatgtaaatatgatgttgagagccccagcagccatctcagacaagggccacatcctggaggtggcagattggagagctctagagactgatgacttctagagccgtcatgccagctcccaacggactacttctggactgtttatacatgagaaataaagccactacctgggggctctgatacttgtagtgaaacacaattcctaactgatataagaattgttttctttagtcttcctattcccttagcagtagacttttacatctaagttgctacgttatcaggaatagctgtatttaatttcactgctatgtacataggacacattaagtgtttaagaggattagaggagacagccacagtaaaagctttttcgtatttctccatgtttctgtgttttggcaaaagaatatgagaacttttcatagtctgcaacaaatgccttcacaaagccacaaactttaattcccatggaatagaatttcatatggcaagcctgtggttacatccaaatccacttattcaacagatttgtgctgtaaaaaaacctcacactagcctatctctttagataggctctgtcttttcatgttggagtcatctaattttccccaaaccaacaacccttgcacatgtctggggtatatttttttgccgaatgcaaaccacatggtcatttcaaagcctataattcagttcaggagcactgggctttctggatgctcgtgaacataaccatcaagagtgacacacatttctggcagtcaccttgccagctccagctctattgtgtctctatatcacggtgaaaaactgcctgacacactaggcagctgacatgtgtagggaaaaaaatatcaggcctgtgaccaaggggaaaatgaagtgattaatatggaaaacacaacaagaaacatcaaacaggaaaaagctgacacttcctattcctttagcttcaagtaaatgtgttttctcctcacactgactgtaaaaggctggatcgaagtattgacatgatataaacgtgtcagatgtcttcctcacctggggccattcataatactgaagagtctttcactcctttttttttgttttgttttagagggagggagggaggtgaggttaacgtaatcataaccctgaaaagataaacttgggaaactataagcataaacacaatgggccgaagtgttcccagtgtgagtcaccactgttgtgccccagctcctttgttcctgccatttccttcctttcagagttccggaacattcctctctggctggcctggctccctttcccaacaccatcccttaaacactggtgttcttcaggcttctgaactcgacctagtctacctgtagactgtgtctcctcattctatgtcctcacagggaggtgagtctcatagatactcattcatacccacagctttactactcccaatgccaccattcctttcttctctttctcctgaaggcccagtgcctagtgaactgtcctaccagtatctatttcatcaagtcccaaactgaacatagtcatgcttttctaccttgcatctcaattccatcctctttccctgtctcacagcccagccacatatgcaccctgtacctccgttattggccccatcatgcacccaggggccagttccatcctcttatctattccaccttatttcatatactaagagtagtgggggctgggtggccccaaatgagattcttatattctgggaatgcagatggatcaggggcccctggccatccatcaggcattcagtaccacaccagctgatctgcaaggtgagaagggggccctcagacacgaaggtctcgctgagcaaaccaggggacaaaccaggagaaggaagagggcctgtttccctgcccagccccagactggctgaggctgatggagcaagtagctgcaggaagaagtggagaggattgtctttccccctgcctctgtgagtcacagagaaacacagtaaatttaggctcctggtgacaaaaggagtcaaggacatttctgcagggcacataccaggttccagcatctttctagagccccaccctccccccagatttgcaaacttgaaaaaaacaagtcctggcatgtgactccttttggcataaatcctcttcaggaggacaccagctatggctgaggtggagcctcacacacaaagccctttggcccacggtcatcaacaaggaagccaaagcggaagactccccaaggaagtggggctctcaaaacacatgtgagacaatgccaagataccaccaggaatacctgaaggagacttgcattgaaggtcctacggatccacgtgggaacacaaaccagtgaaatttgcgtgatctccactgactagacatcatttgaaccctcatgctggcagggtctgaagacatttcgtaatctgtctccacttttgatccctactgtagctcccctacaaaacatttctacagattgctaccaaggtaatcttctaaaattataactccagtggtattctgggctggctcatataggctcctgagagcagactgggaaattttcatcaagattgggaaattttcagcaattttgtgagtcagttgttaaacacataaatcattaaaaattaaaatattaaaaattgaagttactaaaaattaaattatataaacttacaataaattatattaaagcaaaagttctccatttatcacttctttattacttttctatattttaataatgtctattgtcttgaggttacttatgcctattttatgtgtagtgcagtccccccttatctgtggtttcatgtaactaaaatttcagttacctgcagtcaaccatggtccaaaaatattatatcgctacttttgcactttgtagccattattaagtaaaatacagttacttgaacataagccctatgatactgataaaaccactgttaatctgatcacagagatggccaccgagtgactggcaatgctggcaggatggaatggaggagtgcaagatttcatcacactactcagaatggtgcacaatttataacatgaattgtttatttctggcgttttccacttatgtcacactgcctaggttattcgcctcacttcatcttcacacaggcattttatcatctcacatcatcacaagaaggggctgggagtggtggctcacgcctataatcgcagcattttcggaggccgaggcgcatggataacctgagatcatgagtttgagaccagcctggccaacatggcaaaaccccgtctctactaaaaatataaaaattagccgggcgtggtggcacacgcctataatcccagctactcgggaggctgaggaaggagaatcgcttgaacctgggaggtggaggttgcggtgagccgagatcgtgccactgcactccagcctacacgaggggagcaagaatccatctcaaaaaaaaaaaaagaaaagtactgtacaataagatattttgagagagagagaaaaagagagatcacattcacataatttttattatagtataccattataactcttctattttgttattagttattgttaatctcttactgtacctaatttatatattacattttatcataggtatgtatgtatagggaaaaaaatcatagcgtgtatagggttcagtactgtttgagatgtcaggcatccattgggggtcttggggcatatcccccttggatgaggggagactactggatgtgaaaagactacataatgttgtgttgtgcttctaccgtgcatcttttcccaattcaccataacttgatactggccatgatgagggtagtttcatactgaaattgacaaacactataatcacatcgtttctgttttgctaattgtctaggccttaggaggtgatagagaaaatgttaataaaatgcctggtgcttgtagtagttacatcgtgaataaaacaaaaaactgaggaaatattcctctagtattaaaaaaaaaaagtactggacaattcataaagaagatgttccctgaacaagtaaagttttgggatacacctttgctgcttcactttcaaattatacaataatataaaaagaaaatatcaatatgttctttcatcaattgtaaccatgactaggctatggatacaagagttcaaaaaaaaccaacagaaatctgtctaaatcaattagctatatagatttaatgataaagagtattttattactacttgtaattgtgtgcaacacatcttttgtatcagtacaatttataatagacatatgcgcatgcacattttctggagagctggttgttaaacacttacaagcacaccattatatcattctgattaggtgttcctttgtttaaaatctctcaatagctcccttcattggcctccttttacggactacttcaaatcctctcaaacttgcttcttattcctgcattgccatcgcaaccagttccatgaagaatttaaccagcttcacacaagtgcaaactgacaggcccactcacccctagactcctctgttgctgtttcatgtgtcgcccatgggaacctggcagtcatacatgtgcaatccagaagtggggccgcctttattcaatgggagacaagaaacatggataaaagcttctccctttttttctctacataaactgtgctgagtgcatttcataaaacttctcagataatctcttggaataaagcaaccagctgcctatagcaatgatgctccaatattggttccttgtattaccattgcctccttccctagatgactgtctctggtctttcacccctgctccctggatgccattcccaattaaaccacctggcacaaatctctgcacaagacaccacctatcatcatagggtgggtccaggctccttatcttaggagaaatggccctctgaaacaaggcctccacctgccattcctgcttaatttcctagcacatcacacccagtcacaaagaacacacatactcttacccatttcttgtgttttactcatgctattccctctgcttagaattcttcccaaaagggtgttcagagagttctaaaactttgtaatttagtacaacctcaatattacaaaggagaaaattgaggcccagaatggaaaggtctggcccaaggttttcaatagttaatttagatagagctaaacactgtgctactttttatgggcttctgcttctagtccctaaagtgtccatgaatatctctattctagttttgagagtctactgaattaaatgtgtttcctctttctacttcctaggatatatggacttccatttccctttaaactattgctctttattgtctgagacattggtctctcccaaaagaacagatagtaatttactcttacccaatgattcaatccagttccccaaacatttgctgtccactttttgtaagtatttacgatgagtgcagtgaagaagacgaaaatgagtaagatatgtcccttacccaaaaggagtttatgatccagtgggaaagacagagttgtgtataaatatctccatatatggtgtgattattatgatgtaagaaatagccaaagagatgtttaaattacctgctgtacttgtttaaaatatatacatagagcacatatcaaaaaaaggttgatattcatagtttataaaatgggaggaagagtaagtcaacatactaagaaaaccatagcaaaatgaagagctgagaaagaagactatttgcagatgtaactatttcagagctaatgattgtcatggatcaactaatcaacaaatatacgaatgcctgttatacataagccattaactttttgtactactgtgttctatcatatttcagacaaccaaaaaccctcaaacccttaattacaattacaaagaaacctttaagagtatctagtccactcctctcctgaagaaaccaaggcccaggaggttctttttcttatccattatttcttctgagagatccagccattaccaacactcttcaccaacaattcagactttgaatcctcactctcccttgactcttccctctctctcattttcaggaaccaatcaactaccaaatctgtggcttctgctacagatgcatcacatgactgtatccctcccatcttcatgctcttcttcagcctatccttgcttctggatggggctgcctcaataattcctgattctcccaaaatcactctttctcttcctgcaccatccgtcgcaatgccagagctgcccttcttaagcatagctctgatcatgcttttcctttgctgccaaactccaaaaaccaagaacatgttagtttaactttccagctctctcattcttaattccacctgttcatggttgttcctcccctcacatcacccttactctccacctgtgctaggctatactcccactcccatatacattctgcactctccctcccaacagtagagtgtcatctccaaaatgccctacctgccaaggcttcgaaatcctgcttaacctttctgcttccatatggcttctccgatctgtagttgttcactcatctattgccccacctctccacaccctgtttcccattgcatgttacttgtacttatttcacagcatttaatctttgaattgtgtttactgatgtgtcagctaaaccattagatcagtgactctcaaattgtagtccccaaaccagcagcatcagcattatctcggagcttgttagaattgcaaattctctgcccagcccagacctactgaatcagaaactctagggtgaggcccagccctctgtgttctcctgagccctccagggattctggtgcacagtagagtgtgagaaccactgcactagaccatgaatccccagagggcagttgctcccaggataatttcagaggcaaacttagaaggttgtctttaaaaaaaaaatactatagcatattatggacatttttcttctgaatacatatttttaagtaagcagcttttgaccaaaatatatgcaaatatcctaataatatgaaaaaagctggcatgtattaatgtgaatgaagttttcaaatttctcacttgtttattttgggcctcttatttaaaactgactgaagttggctaaattctttgagggttaatttttttttccctcaatctttagaattttttagagacttattactccctaagtgccatttttccttgtaagtttcacgatggctgtcctgtgaggataattttcaaactcattttccatttttctatgactcatctgtgaaacaatagataacagttaagtgtcactgacccttaaaatgtgaaacctaaagaaacattaaagggaaggaaaaaattctcaggccactgaatccaggtaacaccgctacttaagtaagattgtcctattatataaccagcaatggcaggaaagtgagtcggacaggatcaaagtagactgattaaaatgctgtgggatacagaactaaatgataagggagtgctcagtgaattacaatcacttacacattctctactaaaggaattctaaaccatttttgcatcacagagcaaagggtctagagacctttctaggctggggctatgatacctcccttgcttcacatcaactctcctactcatcgaacatatgaccaattttaaattatggtcaaattttacagactccttgagtccttggccctaggaaatcaggcgtaaggaaactgttgctgtacagaagtcatcatattaagtgctatgacttagagaatatcaagtaaattgagaaataaattctaggtgaaatcaggtgacagtgtcaataatggtcactagcatgagaaagagagaaagactgagaattgaatttttgttttgaatttttggatcttgctttggttgtgttaaaataattctaatcaattatgtgaagtgcttattatgtatgcttaacttgtgcttaattacaacaatgtcttctcaacatgttccaaattaatattgttatcctttatttgattgcaacagaaaactcttcaggtctgtctagccaggtcccaaggcccagctctggacatattacctgaccgtcctgagagctaagccacacacaggcccaaaagaacttggccattagagagtcagccatgctgggatgggcctcacactcttttttaggaggactgtgtcctcagtcaggcatcggagcacaaaggtttcatgggtagcctaccgcacactaagccactaaccaacacctgatttgggggcatcattctggtcccttcgaccagattatctggtctctgagcataattgtctgcccacaactttcatttaaaaagagggactcaggccaggcgcggtggctcatgcctgtaatcccagcacttcgggaggccgaggcaggtggatcacaaggtcaggagttcaagaccagcctgaccaacacggtgaaaccctgtctctactaaaaatacaaaaattagccgggggtggtggtgcgagcctgtaatcgcagctactcaggaggctaaggcaggagaattgcttgaacccaggcggtggaggttgcagtgagccaagatcacaccactgcactccagcctgggcaacagaacgagactccgtctaaaaaaaaaaaaaaaaaaaaaaaaagaggaaaaaaaaaaaagaaggacttgcctgcaactaaaactactttctaaagtgtttctgtgtttgtgaactagcacagaagtgaaacaaggccacctaagtgtactacttttctattttagaccaaaattaatgacatacaaaagaaaatctataacattaaaggaagtaaagggaatgaaatccttttaggacatttccccctctctaggaggtacagcataactcccaaaagtatgggttgtgcacagtgacttctttccaaagagtacagtgtggagagggaggaaaaaagtaactttacaatggaaaacattacacacacaacttcagtgaggtgatcaaagtggacatcaccagtgataagtcatgctgatagtatgtacccttgatacgatgtaataaatatggtattttacctctgtcctctccctccccaaacccatcatcccaatctaatcctgagaaaaacatcataaaaatcccaactgagggacattctacagaatacctaaccagtacccctcaaaactatcaaggtcatcaaaaacaaggaaagtctgagcaaccatgataaccaagggagcccaaggagacacaactatgaaatgcagcatggtatcctgggcaagatactggaatagaaaaaggacatgggagaacatctaaataaatacaggttttacttaataatgcatctatatttgttcattaattataacaaatgtatcatatacctatgtgagatgttaataatagaggaaactgtgtactcctttgaaactcgctataatagcatcacaacttttctgcaaatctaaaacaaacataatttttacttctttattttttatttttattttttagatggagtctcgctttgttgcccaggctggagtgaagtggcgtgatctcggctcactgcaacctccgtctccctggttcaagcaattgtcctgcctcagcctcccaagtagctgtgattacaggtgtgcaccaccacacctggctaattgttgtatttttagtagagatgcggtttcaccatgttggccaggctggtctcaaactcctaatctcaagtgatccacccaccttggcctcccaaagtgctgagattacagtcatgaaccaccgtgcctggcccaaacataatttttaaaaggcaaatatacaatagtatgttttctaaatgagatgctctgattaaatgtggtatttagagatgctccagaagtctgctgtctacatccctggacccaatctctactccaatgccagccacctgtcttagtccactcaggctactgtaacaaaataccatagactaggtggcttataaacaacagaaacttacttctcacagttctgggggctaggaagtccaagatcaaggtgcttgcagatttggtgtctggtgaaggcctgcttccccagaggctgccttttcactaacccgtcacttagtgaagagagtcagaggtccctctctggcctcttttataaaggcactaatctcattgataagggcagagccaccatggcctaatcatctcctaaaggcctcacctcctaataccatcaccccttggggtgaggatttcaacatatgaatttgaggaagacaaatattcataccactgtactgccctgaaacaaagcagtttgaaaatcactatcaaggaaaattggaacatacaatcattataaaagccagcccatttcaggaggcctggcaggattctgctgcacaattcagtcctgcctttggatgactgcattagactataagctgtggggctggaaccacattttagactcactagcctaggcctagtactgtgttagcaccaaaaagactctgtgcttgataaattcttcaacaccatcctgaagaggggctattgcaaatacaggatgaaagctttcactgccaactttattggccttccaggcaatggatctgcaaaaattacttcactgtcagtcaaacctaccccgtgtatctggtgagatcagacaggacgaacatatccaacatgcgtttctggcatgcctttctttttgtttcttgtttttgttttgagacggagtctcgctctgtcacccaggctggagtgctatggcacgatctcagctcactgtaacctccacctcctaggttcaagcaattctcctgcctcagcctcccaagtagctaggattacaggcactcaccaccacacgcagctaatttttgtatttttagtagagatgaggtttcaccgtgttggtcaggctggtcttgaactcctgtcctcaagtgatctacctgcctcagccttccaaagtgccgggataacaggcatgagccactgtgcccagcctatggcctgcctttcttacaaagtgatacacatttccctagtccccatgacactaccaaaaaccaccccggtagaactcaaaaaaggtaggaaacaggagtttccccaaatcagtctcatttatgttacgatactttcatgtttaatcgatccattctatcacagattatacacccacatgacagatgcaactgaaacaagtttttgcaagctctctgaaaacgacaggaggcattcacatagaaagctacagattttatttctcatcagttgagagcagcactttgttccaaattgcagtaatatctcagcaatgaatcattgtcataaaaacagcaacatctgtgaggtcagaaaagaacaattaggaaaacaaatgaatcccttgggaaccagggttcacactaacatcatatatttatataacaacttggaaaggtagtcattcaacaagtagttagtgagcacctactacatgtcaggaaagtccctactctcataaagcttaagttcttgtgtagaaaacccagtaagcaagaaaaagagaaaagaaaaagaatttcagatagtggtgaatcctagcatgaaaataaccctaggtgaaaggctggaacaggatcaggtagcaagcaatgcaatgtggactgtgaagtgaggcagctttcaatggtcagggaaaaaacctttccaaggagataacatttgaccattttgtcattgatccaaatgacaaaaaagaaggaagccatgcaaagacttaggagaagtgtgctccaggcagagggaatagcatgattaaaaggccctaagatggaacaaagcttgatgtgttctaaaaacaaccttcctaacaaactctggagataggcaactgtagttcagaaaggtgagaaacaagttgatcaaggttacacagacgctaaagtagaaatgaaacttagcacacctgactcctctgatagtctccctgcaacacgctagctgccttcctagttagaaacccaggctccaatgaatgagcatgagaaatcaggccaatggggcaaagagtggcccctgattaccaagtttcacaggatcagaatttgagttcaaacataaaaatcgaggctaccatacaatgtggccagggtccagcagcccagatgacctgattctaagcaaggtacacaggtgccagggctggagagcaagagcccacaagaggggcccagaaggcacatggggtgatcatcaaactcccaagggaacttacaaaatactattttgagtcccattcctcaagaatctaaatttattacatatgtgatagaacctggaaatttgtattttaagaagttcccaggtgattttgtttagccagactttggaactactgtgatggagaaggagggaaggccagctcttcaggaggttgcagggagaattctatctctacaaaaggaagaatcaagggttaaattgaatgcagttgagacttgtaccagaccagatcataggcacagagagataagaacattgcataactaagcgtattcctttctccccaaccacatccccaaattcagaatcactgtgacggttgacagaaaagtgcaggagaaatctctttggtcataatgagaaagaaagatggggtggagaagctcggatataccccctgggcaaagccagtggtgtgctgagaaatgcttagcaaccaggtccgggtggaggagaaaccctaactgtagtgtttgccaatttcgatggtgtaaatattcctggaaggccaaggcaggaggatcactaggtcaggagttcaagaccagcctgaccaacatggtgaaagcctgtatctactaaaaatacaaaataagcctggcatggtggtatgcacctgtaatcccagctacttgggaggctgaggcaggagaatcgcttggacctgggaggcggaagttgcagttagctgagatagcaccattgcactcctgcctggacaacaagagtgaaattctgtctcaaaaaaagaaattcctatcatggccgcttccaagttaccaacatgatatcactagaacatacagtttggggaagacgtgcaatagttacagtattttcaccatatagaaataataaacataaatagcatagagagcaataaatttagtaaaataattagtaagtcagaggtgtgggtatttattatcttttaaaaatagttttaacatcacagtgatgttagtgccaaaaatatacttcatccccaaattctgtactcctaccttacctcttacctctttttattccaaagcaggaataatggtgacatttaaaaaacaatatctaaaacatcatcttcatttttttttcctattcttagcccctttggttaaatttctcacttttgggtctgtatcttcagaggaccactgccctacacatctggaaatgtttttctgctccaagtcataaatctccaatcccaacccatggctacctactcaaactctttatttcaaaggactccttcatcagaaattgggcagaaaaagatcaatgaagtgagtacagctgtttacccaaaatgccacagactgtccattctacatctacacattttatttttaagaatagttaaatggcaccatagagcaaataaataagtaaaacgttaattataaagacttattttctggaaatacctatgtattttgaataaaatggattacaccttctcccttcatccatgtaccctttcattcagttcacatctattgtacactacaatggacactggagacacaaaaatgacaaaaacacagtctgtgacctcaaggaccttgccctctcacacggaagacagacaatagaaaaaataatggcaaatccagtgattctaatatcacactacatataaaatccacccatggaaagtggcataaaccaaactagactagactgttatgaagatcccaatcaggggctaagagttcccttgtatcttattgtccacatgctttgttgattagcaacagtttaaacattaagatcccatcaagataaaccaaaggaaagatcatctccaactgcttatgagattttgaaggcatcatccagtggtaacacactgagatgcaaggctttttgtaaagaattgacaaaggtattagctccctgcttcctatctgtggccctctgccaatgcctcgtctctgcatttgtttctcccctccctttctacggctttccttttccccatgtttattcctattctccttcatctaaatgtgccatctgtaaaagcctactttgaaaaagatcactgttaaattctgaacccttattttcctgttcttaatataaagttcataagtttatggcctcagaagtctctctctctctttcttaacaaaagaactgactaaactaagttatttttatttccatgttgcttttggctggttttcttttgtgcgtcagaggcttccaaaaggttcccaactctagatccaaaaagttcaaaaaatgattgagtacagaataaaatattgccctcatccagaggggagctgagggtcacgggcattaggagcaacgggggaagcaatccaggattctggagccctaggaagcaagacctgccatgacccagtcggccataatgtgggcccttatttagcagattagctctagtatggtcataacaattattaaaatattgaaatgcttccctctggaaatattgcacataacacccaaccccttccaaatacacctggcctcccagactctcccaggatccctggcccaatctcctcacaatcaggagttaaggcctggcccagcagaggatctccaggaccctgccccagtgcttctaccctttgacatacccatgctccaccttaatttcgttttccgaaaaataaaggacttgaacagattgtctgagttgcactataattgcaattatgtcaaagaacaaggacgaaatggaaataaaaaaacctaaaaaaaagtttgttaagaggatggaatcacaggttatgtttttttctagacagacagcagtgtcaaaactctgggtgcaagctgcctgggatggatccccagctctaccatgtgctagttgtgggatctcactatgcctcaaactgcctcatctataaaatgggcataggccaggctcagtggctcatgcctgtgaatcccagcacgtttggaagccaaggtaggaggaccacttgaacccagaagtctgaaactagcctgggtgacatagcaagacctcatctctacaaaataaaatacagtaaaacaaacataaataaataaattaaacggccataataagattacctactttacagggttgttctgagggttaaatgtattcatgtttgtaaaatgcttagatgagtgcaaggcacaaagtaaacaccacgtaagtgtttattaaataaataattcattttattctgtcgttgtaatgtttgctcaataaatttaaaaattaagaaagtttcacaacagaaaaaaaacactgtgacactatgaaacacttacgtaacatacacttttgcttaataacccagcactaaaacagctggggtccagattttacactgcactgtgaatttagggaaactaacacactggaatgtgttcccactgaagcataagatgcgatttgtatgattctctttgtaatcagaaatgtcacaggcttatgggaaagttaggtttacatgtttctcattttaaccctgcaacaacttttagccacaccctagcaaatacattttattttgtggtgctaagacttaaaggattgtaaacacaaaaccagaccttgcagagctacagcttttcttgtgaacacaatgactcagcctaactacaagtttaaagagacatatcttatgtgttgggtcccctagtatcaatctttagtaaacatctgggatggacaggaaattgctacacactgcttttagttactaaaaaggcaacactacctgagctcaagcatagtttagataggtactatttgcactgctatagaggacaacactgacaattgttatttttctgatagatactcaggagaggaaatgatcaataacaataattcccttacgtgttccttcctcttgacagctaaaccccacaatacccttagacacaagtttaaatacatcacaagcttatcctcaaacagtaatgtattaggtctttcctgctgtagataagatttgttaaacagtctggctatggctttttaccttttctcttttaaaagtgcatttctcagctgggtatggtagctcatgcctgtaatccagcactttgggaagccgaagtaggaggattgcgggagcccagctgttcaagaccagccctagcaacacagtgagacgccatctttataaaaatacaaacaaaactggccaaggatggtgatgcgcacctctagttccagctactcagaaactgagatgggagtatcacttgagcctaggaggtcaaggctgttgtgccactacactccaacctgggcaacagagtgagaccctgtctcaaaaaaaaaagtttaaaaggtgcatttctctaaagctacgagaaggaactcaaaccttgcttagtgataaaactaaagcctgcaacacaaccattatcattaaaatgttattaaaaccctgtaagaaagatgaagagtcttgtggatggatggtggtgacggtagcacaacgatgtgaatgtatttaatgccactacatgtacacttaaaaatggctacaatggtaaattttatgttgtacatattttaccacaacaaaagtgaaattataagagaaaaaaaattttttaaaaaaacatcctgtaagagaacatttatacactgtcggttggaacgtaaattagttcagtcactgtggaaagcagttgcagatttctcaaagaactcaaaacggaactaccattcaacccagcagccccattactgggtatatatccaaaagaaaataagttgttctaccaaaaacacacacaaattcatatgttcaccacagcactagtcacaatagcaaagacatggagtcagcctagatgcccatcaactatggaccggataagagaaaatgtggtccatatgcatcatagaataccatgcagccataaaaagtaacacaatcgtgtcctttgtagaaacatggatgcggatggaggtcattatcctaagcaaattaatgcaggaacagaaaatcaaacattgcatgttttcactaataagtggaaggtaaacattgggtacttatggatatagagacggcaacaatagacactgggaactactagacgtgggagggaggaaggagagcaaaagttaaaaaattatcaggtactatgctcaccacctgggtgacgggaccagttgtacccccaacctcagctgcatgctgtatgtccatgtaacaaacctgcacatgtaccccctgtatctaaaataaaatttcaaattattaaaaaaaaaaaatagggtcgggtgcagtggctcacgcctgtaatcccagcactttgggaggccgaggcgggcggatcacgaggtcaggaaatcgagaccatcctggctaacacggtgaaaccccgtctctactaaaaatacaaaaaatcaaccgggcgtggcagcaggcgcctgttttcccagctactcaggaggctgaggcaggagaatggcgtgaacccgggaggtggagcttgcagtgagccgagatcgcgccactgcactccagcctgggcgacagagcgagactccgtctcaaaaaataataataataataataatgacagtcctacttttcctttgtaacaaaaataaaagttacctataagagttaaaggtaaataaaatttgtaattttaattaagaaacactaagtaaacatacaacttccaagaagccgggttccccactacctggttataagtaagtctacaaacctaaatgagcattgtacagcgcttactatagttcataattattctgtcatcagggacaaacattgtaaagacactttttcctcaaagccttagcattcaatttttttttttttttttttttttttttgagacagattcttgccctgtcgcccaggctggcgtgcaatggctccatctcggctcactgcaacctccgcctcccgggttcaagcgattctcctgcctcagcctcccgagtggctgggattacaggcgtgtgccaccacgcctggctaatttttgtatttttagtagaggcggggtttcaccatgttggccaggctggtctcaaactcctgacctcaggtgatctgcccgcctcagcctcccaaagtgctgggattacaggcgtgagtcaccgcgcccaggcagcactccaactttttatatggattgttaactgtactggttcttgagaagccagactgagcgcttatacaattagtccaaagatccccaaacaacatttaaaggctgtctacaaattcaagctaaaagactgtgtacaaattcatttgtgtgtcacaaaacatttaatactgaaagagattcttattcaaataggcagtgtgtaaatgtggggtctgttaacagttcaaattgcagattcctttccttctttaagttttcattgcaccaccacgaactaaaccatttaacatacctcagaggtctctgggtacctagtctctcagaggcctttggaggcccacgaaggcttatcttaactaaaattggcagggctggctgataaagttaacggaactccccattttggaggcagacttagtaatggtcaaacgaagaaactgttgtggtctgttcttaaaaagctactagtatttagtgcttcacagaggaagtaaagaaagcaataatccgagatgaggaggagcaaatacaggcgtggcggtagttcaggactgagtctacaagggcggttctcaagggcgtcacaaaatcctatggaaggcttggaggacggcactcctggatctgagccctacgtcccaaacaccttcaatcgtattgtgaggaagaagaccttttacacactccctgctgctggcccccggccccctcgccccacctccgagtggtcacatcacacggcgggagccgcggtcagcagctgtgatcacacccccaggaccgtgctctgcgggctgggctcgaagccttgggacgcggcacttcctggttggtacgggatgccggtcccatcgcccccaccagcccagtcatgccaccgcgcacccgaaccaagggcgcccggatgacctggggacaccacacacactgcacccgaagccctgtggcggcgaggcggtgcatcctgcagaggacgcctgggcttcagcctgagcctgcgcggctctgcgctccaggcagccgcccgcgcggcaaaagtgcgtgccagagttgtcagctttcaccctgcaggaattccacccgaaggcgtgcgagggaggcccttggggatcgctagggagtccgccgccgactcactcgctgaaatcccgtccaagttgggcggggagcggccagctgcccaggttgggcggaggagggacggagggcgagggcagtggaaacccggctcccacgggcgcccggtgatccgggtctcggcgcggctcctacctgcagggcgaaggggccgctagcacctgcgcgttggcggcggactctcagggctcgggtgcctctggcacagctggagctcagcgggagggaggg

SEQ ID NO: 2366 - DNA, 210091 bp, Homo sapiens; identical to SEQ ID NO: 2365

SEQ ID NO: 2367 - DNA, 486385 bp, Homo sapiens
atgattgaaatttgttggatttatttctttctaaagtttgtacatttacatgtatcatatacatattttaaatccttcactattttgcgtgatttctattacataaaaaccatttaaatgcaataaattttgttgccgtaaaacaacaaaatatccccaacttataaaaacacaggaacaattatattcataaacatttacacaataaatgtactctatatatcacagcttctatacatatcagatgactcacttgtctacaaggtttagatttacttgaacaacagtgaaatagggtaatatttatatacaactattttaataaaaaataaagcaattgtaaaatgtaaacttaattgtcaaaatattctttaaacactttaacaatatccacacaaattactgttcctttcaaaagaagaccaccacaaacgccatcgttttctagaagacggcatttccagaatctggtaggtggtgatgaggaacaggtttccagtacgtgttatagtaccgccagcttacccaaaactgctaatgccgacagtttcgccattgaaaaggagcaggctgctattttgtcactaattactttcacaatttgcaggggacatatggcaccaggactgcaatagaactgaaatgattggtggagaaaactttgaaggtaaagaaatgttccacaatgccaattagtttgagccacagtgaatataactcagttattataataggctggaaaagttaaaagcttcttttatattaaaagatacaaattatcgcctttctgcctgtcctatggtaatcaaggctgacaatataaattctccgctagtgtacatttagaaatgggttcctaaagcttgagatataagagactgcagggaggtggttaggcctttacctaacagctctgatctggactgaacaaagctgctaagctagcacttgagtattcctcgacccttcccctagaaaggaaacgttagccatttccaggaatctgggtgtggaggcaaagatatcgtccgtccgtagttagaactcagggtgccagtttgttttttgcaaaggtaaaatacgtggtgttaacttcactcagagaatctttgtcatgacgtttgttcatgtgccacgctcagtgactcagtcactctcggagttgataccttgcctcagcagggtcacgctatcaggacacctggatccctaaagcaggggaagtggcatttgaaacccaggctgtccttgctgctcagtagaagcctgagtgaagtggcggccgggggagaggttcctctttgcagagatgatgtgttatcaccactctctgcagggctctggtgttcaggactcagagcagtgagcctcagacctgcagtgtggtccttaatcgagccttgggctgggactcttctaggagcgcctgaagacttatttatggcgaccgatgggaaaatattaagtgaaactccaaaattctctccattaaccaacattttcaggaattgaagttagggtgcttatttctataacactattcctaagagcttagctctctgccctgcaaagggaaatgcattttagttcggttcctttccatttccatcctcgctgttgttgctgatggaaaagtgctcaactgctcagcatgttcagtcggagctctcttaccagtaaagctcagaggggagtgtggacaaggcacatcagtgctcctacaggaagtgcctccttgtttcttcacttgtactcctctctcaaaggaatgatctgcagagcaagcagctctgccaccttggaaaatgatgcacaccagcttctgggacttcacccaggctacggagagatgctggagagctgctgcttgtgaattacaagaaagccttcaatttggtggtccacaagaaagaatgtgatatggatcccctcatttatgtgttaaaaatataatgcatctcaaagtcagacactagagctcagattccaccctggcccttggaaaacatctgtgatgcagtttccaccccctctgttcatcacctctttagaatattctggctctttgcatcttaaggtcttatgtttgtataacttaaaacattcactgtgtgtgcatgtgtgcaagcatgtgtacacatgtcagaggtcccagacatgtcaacttttctccttatacacctaaggggacagtcaactggttctgaatctcaggaggagaggactaaccacatgcatggttaccctaaatggaaagcaaccactttactgtcccctaagcttcaatttggtctaattactcttgttcctacagttttacaaaagtatcttaacagcattaaaaatcaatgtgcatatatatactctctctagagtagatattattatccatatcaaatggttacttggctttataaactccatggctttatgtttaaagtccaaacatttcaaatggttaaggcccaaaaatgaaacgttttgcttctcctactccttttctacatgatttttgaatcaaatggctgtttctgcagatcacaataattcttagaaggaaatactctcgcaaaactaagaccctgccaatcattcacagagccagtccactgcacgtcaagaaccaattaggaaaaatgatatatttgcaaaaatagtttgagactatagagttaattaacaacaacaaaaaaatgcctcaagtgtaactaccaacacattactgcagcctggagctgaagttagtctcccaccccacaattcaaactctctgaatcagctacaaagacacgaggcagtgtgtttaaacaaaagacactgcactcagccactcactcaaacacactcagtcactgctttaaatataccaaacatgctggttaataaaattttagtctctagttacctatttacactctataatataagcagtaagctcaaacaactaaggccagtggctcttctttggggagaggcaggaaaaagagacctaagtataaaaatatttaaaataaagtttaaacctggtcctgaaattcttttacctgtgacactagatgctaatttctgcaactgcaaacctaggatacagtacccaatcctgggatgccctgatatactttagtgcttgtgatatttcttccaagtcaagcgagtacggatgcggcaccacgagagtggtttgatctcccgtaaaacatacacaaatacataaatgatatggtgggtacttaattcttccgaaagctatattttttatggactaattacaacaacaataaagaacgtgtgctttaaagcatcacattttgtaataagcccaaaattgtcagtttgactttaagtgctcttaatactaaagttactaagactgcacaggctgcctttttttttttttttcttttctttctgtatttcccaaattacagggagctatgcccttggtattgcacacagtacactgcaaaagattcacaaggttagttgaaagtcatttttgccctggtgattcaaagctcaaagaattttctagcataaagtcttattaaaaattttaatcaaaatattatttgagtttaagtttaataaaacaataccactatatatactctcaacaacttcattatataatcagtcctatgaggttgtacttgcttttcatatcacactgattaaggacaaaaataattttgatgtacatgtaccatacactgatatgcaatctacacactgatgcatttacatacatacaactataaatacccacaaatacaacaatggcaggtgacagcattttctttgatgactgacatactgcctgtaagaatagtctccaaaagcctgcaatactacagatacacacacaaattacaaaggatgaaccgaagagacttaagaaaacctactgtatatacaattatgtaacttgcaaaattttcctgctgttgcattcaagtcaaactgtcatgcagattcaagtatttaatgacattctctctatgaagacattctctctgcatgcaatgggccaattattgtcataagcagaaggctgcccacgtgggttctggatactgtaggtacaaaaggagaatgcctttggatttcagtccttcctttatggatgagagatggaaaaggaatctgagagaaaaatcagtgacaaagcccctctctattgctatcaataatctatcacggggttattctgtgatgatttgatcatgtaagatgctataagactggtggaaagaaatttgctgacatgtggcagagcagtggcatggcctgggagacaagatggccagaaagctgtggagcaaggtaggaggcccagaggcgcatctgcctgcaaagctgacttaccattttctgtcagaataacttagatgctttgagacaaaagcagatactatttaaactccaacttggacaattcctcataaactagacttcaggtttaacaactcttaggatgccactttggttctttgttttacagtgctaattttacaattggaaaaaattctgtcatttgaaaagtcaagggatgactcactgctgaaatgaagagaggtggctcccaacctgctgaaaactcgaccaagtccacgggagttaaattacagagattcaaacctgcaaagctaaacttctgtgaattcaggatgcaacatgcttaactgatgactgcaaggaaaaatgccaaaggaactcaatttcaaggacaattaatgaaacccaaaaggttttgttagtaagacaatggagaaacttctttaacgtcaattttcttccaattgtcaatgattagttaaaaagaaaagagtgcagctcatgacaagcaggccctgcctctcatccttcccagatctttacatgatagagggagcaataggcaaaggacagtagaaaagctcagtgtaactttgtgtttaggcagtaagaggcctctttccctgctggttgcaaaaattcttccacaatctcagaagttctgtagcttggccacagggtgaaatacaaacctatcttagccttggaaagccacccagattttcctcttccagagtaaattcctcatgtcacttttgcccaggggccagtcctcattttctagattaggataacagttggagacgcatagagggtcttgtgtttgccacaagaccactgcaccaaaaaatgctttctatcctctgcatctaagaggaataaaaaggttacacataatccagggactacatttccatcagaggactctctcccatcatggttttgctgagattaattaaaattcacaaaagtattgctcagtttaattagacactgctgagagttagcaaaatgatgtttcaaaaaagtgcacttcagaaatgcctacgggctggcgataaagtaaggactctgcatcccagtaattaagttttgattgctaatgaggaatcccagacacctccctgtaaaagccagcatgcgaggtggggacaaacccctaaaattcagattttatacatgggccacctgtatggtcaattttgcaacaacactatgaccaaggcattctgatagctgtcaagattttctgtactagaaattaatatgaagtgtattgacgtgaagaagaatgatttatcatatggaaggaagtcccaaggctcctgggcgctgaggtgggcgacggaggtgggtggcgtaccttcagaggaaagggaaggggtgctcccttgtaccgtgaattgggcaacaggcttggagcagctgtgaaaggaaacatcctcaatttcttctggctagatgccacaggaaataaattatcccaaaggaaaatgtggttggctatgggccagactctcagaatctaggcaaatcagtgactgtttcctcccatagcataaactcttggcctccttcatgcactcatgacagacagcaaccttcagaagcctcagggaagaggtgttctcagcccatgcgctaaagatggacagcatcatgctacggcagtctgagatcctggctcacaaaagaacctttaaagttgtttttaaagataaactatgcaaacatggtatactgaagcttcaaaagagcccttcgtatccaatgatctattagcctatccagaagtccctggagttaatattagtgactcatatgacacggacagtgctatagtggtgctgatgctagccgagtatttcaacactactctaaatgtcagaaatactgtagcaaggtaccattcaatgtatattaaataagtaaaatacatacagacattctatatacatagatatagactgtgggcaaacacattcaagccactcagggaagttcctttttctttagttactgaagcttgtagatgacatggtctaggtacctctctcccctcggcttagtataaacatttaggcagaaaacaaatatcctgataatttagattatcaggtagaaagacagataacttgcttgtggatatgttggattcagtgagaggctacaaaaatcaatctgatacatgggccatattggtaactatcctgtttgttttgcagttctgaaacataaacttagttactgcctttacccaaacaaggcagagagttaaaagtgaggtttttttttttacaggtgtggcaaaatacttattacaaagaaagcaactgcaaccctagagaggggtaagccttctctgggcaatagtcatggacatttacagaggggaaggaagtaaacgttaataaataattctgtaaataaatgctagtacatcataataacataccacttagacactaccatggctttacagcaggttttctctaattcactggaaccatgctattcctgtagagcagctgattctttggtcatagtaccttcaacaaataaactatagaactagagaaactttctaagggaggaaaaagaaaaatcaaagtgatactattagttctgaagttgtgccacttgcggagattttaactttagggattacagagtttcaaggttaggaaatcacaaagctctaggtctcagtgggctaaactttcactcctttctcttcctctacagaagaatattctgtttatcaccctgaacttcaaagggactgtaactggaacaagctcatgactgcaaagttaatagaaccattttgagtagacagaaagaaaggactgaaaatagatgaagtatttttaggagaaagttgagtagtagcagagtgaagtggctatcaaggagactgagacaagaataaacaaagtcactttgcacctgcaaccagaagattcctcagttttccaaccataattcattctgactactactttcagatatattttaaagaaccaatatccatcgtggacaactgcagctacgttttccttccttattttgtcttaaggacacaagaaaagctgtttcattttagtattaatttgttaggaaggaagacctcaatatcacaaccaggacacaaccccatgcccacacacgcacacacacgcacgcacacacacatatgtagagtaagaaaaatctattcctggatggaaggatatcaacgatagagatgatggatttctagtctagaccctgtgggagtgaggtaacaattcctgcagactgagcacatgcctactgctgcagctcctcaagggccgattattgcccccatcctttagcaaacaaaattaactgggtatcaatctttcctcagccttcaaaggcaaaatgactccacttcctctttcccttgcttggctgaaatggaatcagcacttcaagcaagctaatgtgcttccctaagttctcaatcctacgatcttcacgcttcttttccctgcttccagcagggtccgatctcaacaacaagtgctaagctgcacatgaagctgcctcatattggagcaactagattcccagcactgtgattcttactggagcatctgtgagtgctcaattctacctctgtgactgggcaagatttcacatataaaggcgtatattaactccagctagaatttactaaaactacagtttgtccagttaagtgtttcacaatggattaaattctttaaccttaaaaaaaagtttaacagttgatatgagaatacataaaacaactgagcagactgcaaacaagagaaaaccaaaagagaagggatacataattcattctgaaatcacgatcccctcctcctcacagaaaaggtgcattagctatcaagttgcaaaaatcatcaaagcaaaagaaatcaagagcaaagacaatctgtacagaaactaacaaaaatatacaatagaaaaaattactaatgcaccgttttgtcacagactttttttttttaaatatattcacggattaccagaaagatcttgaaaaaccctattttgctccatgaccagcacttcctggccgcagatggactctaagtaactttttgcttaatgcttggtgtttcaggtcggtgatccttcctctctgacacgttacgcttgactttggcagtgattggagaagtatccgggttcagcgaaggactcgagtgcgacttcttcagtcctgcagcctcgctttcatcgttactcagtagctctttgcctccttccttgagaatgctgacatacatttcatagcgggttttctgaaggcaaagccagagaacaacggtagtcagaaaactgttcaaaatgcacgtgtgcagcacacttgtgtattacccacctggagagtgtgaatggctgttgaagacttcgcttcatttcccaaactgacaaattacttgggcacttactgggcacatgagaggcaactacagagactgtcttatgtagataagaaattaagttagaattttagttctcatttgttctagattctgacagaatgtcaacttggagttgctggctaccagatggaacaccatgaatctagaacactcaggcatgagaagggtctaagttggaggagctgtcacctctggttttcggcggctgcatggctcttgtggctctgtaccaaagtcacctgagcctccccaggtagtccaggcctcacaagaaactggcttggatatggttgtttactctttttctgactccctgtaaccctacaaaggcttgccttgagggaccattccgtggctaatctcctggacagtcagtcccctatgagaccataccaccttctagaagctgctctgggtttccctccgttgcttttctgcaaggattacccacttctccggttattatgaacaggtgctgctatgaacagtatgaagctggcagaatttcaagttattttctgatgcttttccaaatcaacaatattcattaccaactatgtactgagtacctactatgtttcaaacagttccttgattcctccgtctcttggatatctaagattttttttttctttttccatggctctggcactttttttttcttccagtttctatcccaatcaatatatagaactatcatatatgttgcaaattagagaagggtctcagattcttaatttgacacattctggtaaagtaagtattccaccatcctgcctcaacgcatgaagaatttatagaaagcttaaagtgttttatttctaaaccaaagaacatgtcagatataaactgtcccaacaaaggcaggcaaattctgttttgactatacatccgtcttagggatttttctagtcagattggggttttgtacgtgtcagttttaagttagtaatttagaagtgctaccttttcaagctgcttcgtttaacaatgggaaaaagctgctagacattcagtatgttctggggttggccaggattcaagtggggtgtgagcgctggttgccgatgatgacatttattgagtaccaacagcttaacacaggtcattcacacaatattcatacacaactgataacttaccatccctgctttacagttaaggcaacaaaggcaaagacaagttcaaagtcaaagtaaggaagaaatgaaactcggatttgaaccaaggcaatctgagttcaaaacccacggctcttaagctatattacctccattgatatgaaaatatagattatatgtatatagattttaggatgactcctctgacagacactgttgtttggccagtcaaaggccattctcaactccttctactctcatgtgcctttcactacaaagactgataaaaccagagatacttactttcccagtctctcttgtagctaagttgggccatgtgatattgtgaccagtaagacgtaaggaagagtcttttggggggcttctgggaaagagattttgctttctgataaaagggacagactttaaggagaagtcactggtgttagcctctcattcttttttttttttgagacagagtctcattctgtcatccaggctggagtgcagtggcatgatctcagctcaccgcaacctccaccgcctgggttctagcaattctcctgcctcagcctcccaagtgtctaggattacaggcgcacaccaccacacccagctaatttttgtatttttagtagagatggggtttcgccatgttggccaggctggcctcgaactcctgacctcaggtgatccacccgcctcggcctcccaaagtgctgggattacaggcgtgagccactgcacgtggcctagcctcttactcttattccctccttaacatggacatgactcctaaagctgctgccccgtgacatgggcagtaggtatgaggaaataggacaacatgctgcacctgaggaaaaatggaaagacggagagagccatgttgacatgatgagctggatccaaccctaaggctacaacctctggaatcatgttaaatatgaataataaatatcctatgggttaaaccactgtttatcaagtattgttatttgcagtttaaagcattactaaacacacattccaatttcaataaagaagtaacaaaatacagaatagcatgctaagcattatctcagaaggccacatgatagtttcataaggtttgctagtaaaaaatgtcatcagtatcacccatcagtagatgcactatgaaatcagaggactgaacaagataatatccacaggacataaagattctaaacgcctcttcattttatgaatttattaattaatctactcctaaactgccttggtggcaagattaaaaaacagaaaagaactacccccaacagaaacaaagtttggtaaaatagtctaaaggtaagtttaaaaatagattcaggaaaccagcgtaaggcatacgatttcatgaagctggagcgttgacacaatgaaaagagaatgaagaaaaattgtttagatcacttgaaaggggacaaaaggagaaaagatgatagggacagttttccagtagtctttgaataaagtgatactactaggaaaatccacctgaaaaatacatgaaggaaagccatctcatccactcattttacagctccagctgcaaagctattgtcttaaataaattacatcagtgtgtcaatcaacaaacaaaaggcacagcacagaggtgtggcagtgcatgagtcatcagatcagaagtaaagacaaagcagaaaaaagggggtgagaggggccagaaaacaaagcctgccctgctgttaaggaagccttcgagggttgatgagtttgcaaacgccgtgccccatttctgacttaaaaaaggcttatagggacacaggttacaaaacccagaaatgtagctttgcattttaccagtctctgagtctagattttactgaaccaaaccaaatatacctcttcaaaacattttaggaaaacgtaactttaacttcaggactaaccagcaggtattagttttagccaagtatctctaggattacagactcaaccacatatgtaaatgctatccagaggatttgaggacaaaataaaattgtctcagaataaagaaaaataactctgaatgatgctctggagagcaagggcaagaaacataactgaaatttctctcttcattgatttcgcctcatattctctttctgggcagtaggaaggtcatatttcttaactatgcaacagcatcatttggagactttatttcctttcttcctttcagagaagatgtgatttgcatcttttttcctaagaccgattgtgaaatttaagttttaaatgaaagctggtgtgtaagaaaaagtaaaggagcagcaagaagtatattagtaaattactttttttttttttttttttgagacggagtcttgctctgtctccaggctggagggcagtggcgcgatctcggctcactgcaacctctgccgactgggttcaagcaattcccctgcctcagcctctggagtagctgggactgcaggcgtgcaccaccaagcccgactaattttttttgtgttagtagagacaggatttcaccatgttggccaggatggtcttgatctcctgacctcatgatccgcctgcctcggcctctcaaactgctgggattacaagcgtgaggcaccacactcggccagtaaattactttttaaaggtttgacacaccagctcagagactgaaaacaatgatcagtgttcaagtggtcatcatggacccaagaagctcatcaatcatattgcggcagacggtgtttcctgcttcctgaacagcctcttctttcgtactaatggaactgtgcgctttattaagaatgccagcgtgcccagccccatgagaggaattatggtttaaagcaggcgtgatgacccttgtctctgttagtttccactgctgccctgtggcctagatttggcccctgacatgtaagtagaagtctgctaggacagtttatgaaagcagcttcttttgctattctgatagaaggtggtaggcaataaggtattttaaaattaaggtacatacattgttttttaagacataatgcaattgtacacttaacggatgactgtatgctataaacaacttttatatgcactgggaaacaaaaaaatttgggtgacttgttttattgtgatatttgctttattgcaatactctggaactgaacctgcagtatctcaggtatgcctgtgtctgtaaccactttcaggttctaggaaatgattagcactctagtacttagggagaaagcttagggataattcttaagtggtgaagaaggaaatttgacaataaaagctttgctccttcactcttctttttctctaatgtctcacatcctttcagtcagcaggttttgtccatctatcttcagaactgcaccatttctcagtacctctcccatttctagtctggaccgagctcatcaccttgcgcctgggttcctcccacagtcgcctgactgctctccctgttccctccttgccctccacgtgcactcctttcaaaagacactgccctgttaaaacacaagacagagtgtgtcagctctgcccaaagtactccagtggtttctcatccttaattctcatccttaaaacccttctcaaccaggaatccttaaaatgccctagaaaacccatgggccacccctttcccgtggcccagtctctcagttctgtccctgggcttgaatctgcctccatggcacacactcctattcgaggacctgtggaacttgctattctctgtccaaaaagctcttcttccaaaagcccacaggacttcctccctcccctccctcacctctttcaggtgtgcactttaacatcactttgacactgaggccttccctggccatcaaaatctaaaactggaacacctactcttactgctttatgttttccttagcacttctccccatctgtcagccttatattttacttgaaaaaaaaaaaaaaaccttttgatttcctcctttgccccccaatactagataccatcacatgagggtaaggactttgcgtttgtttactaatatatccccagggccaagaacacacagtggacaaggaataagcgccactgagtgcatgaacagaaagaggaggaacacatttttccatacacggtagaaaatatattttgaactcgtaatatggcaaatccagaaaaagaaaaataacacggatacccacgttgatggcagatgcctgatgtgttcctaattcaggatcctctgggaacacacctttatcttcagtatcccaccgttccaatgatgtttttcacaaaaatgctaaggtctgaccctgtcagtattgaagctcataagccaccacatgacaaaggcttgtccacttccactgcatattctcttgacctctgttgtcaagatgccacacgtgtcagatcctcaacagtgcactgaggtatagcctgccttgcttaggactggggctttttctctctctttagagagaaacgtaggttatattacacttttgaggttcataaaacatagacccattttctgagaatctttttttttttttttgagatggagtttcgctgttgtcacccaggctggagtgcaatggggcgatctcggctcactgcaacctctgcctcccaggttcaagccattctcctgcctcagcctcccaagtagctgggattacaggtatgcgcgccaccacgcctggctgattttgtatttttactggagaacggggtttctccatgttggtcaggctggtctcaaactcctgacctcaggtgatcctcctgcctcggcctctcaaagtgctgggattacaggggcgagccacctcattcggccctgagaatctcttacgtagtagtacatgaaaaatagactttattgcccactgtgagcttcaaaataaagtgagaaactggaccactgtaggtggactccagtgagtcctcatttggataattactaggtctcattacaattcattacaacatgaagagaatgctctacatttgtcttctaaaagcatacattaaaaagataaggatttgtcaaggattatttatatctggaatctacttgcctgatcattctcacatgaaattgacatgtaaagtatcaggagctcatttacctttggatacataattccatactaacctaagattctaagttctctgggtcagaggatattagcctcatcaacatgaattcaggacggaatctgctgttggtactaaacaaataataacaatattcaagtattatatcttcgctttgataattttttatagccagatggtagaaaagggaatctgaaacagcaacaatatgttttaactaatataatttcaggccacaaagtaatcactacacaaaaattaacatagttccagatagggcacattaaaaatgagatgggatgtttaataatgagcccatggaaagcatggtggcggtaaaaagaagagtcttgcagtcaagtagcctgttgttgacaatgcctctaactaataagactggccttaattcattctctgaaattgttgtttagtcttcataatgtagccctttcaggtatgtgtctttcatttacaaggacaaagacagttccagaaaaatgcgtgcctcagggtcagttttgctacctttggttatgttattaaagattttatctttgtctctgcagattcattctcaggtcaattctaaataatttcagagccccacactcagcttccttccttaggaatgctccaacagggtaaatagagttccagcagtgtaagcataatataattccactatcagaaaaataacttgggatggaattttaccaaatacaactgcaatggcagatctctgctgacaagaatctacataccgttttcttggacctggcccattcagtgagctctctctcttaattaactaaaatttgctgttttgataaagccttttgtgaccaccaagagccaaaggcaactcaagtgtttaatggcgcctttgtctactcaagtaaaattctttcttcagtgtgtaacccctccttattacatttttttgctgtatttctttattaagctgatcttcgattatctgtaaaaatacttcccaaatatggccaggcgcggtgactcacacctgtaatcccagcactttgggaggccgaggcaggcggatcacgaggtcaagagatcgagaccatcttggctaacacggtgaaaccccgtctctactaacaaaaatacaaaaaaattagccaggcgtggtggcaggcgcctgtagtcccagctactcgggaggctgaggcaggagaatggcctgaacccaggaggcggagcttgtagtgagcttagatcacgccactgcactccagcctgggcgacagagcgagactctctctcaaaaacaaaaaaaaaaacaacaacaaaaacaaaacttcccaaatatgtagggaaaaaatcccttttcactagcatcaatgtctacgagggataaataaaaattatcgtgtctaagaccatgtaaactgctacttgggttgaatgttaattgtgttttgaaaaaaattacaactattgatattctttgaaaagtagtttaatcatatccacacatatatttacatggatctcactgaacagtttctctctagagccctgcataccattttatagaataatatctccttttgacctctgatacatgaatacgatagtaacaacctgaatgaaaatacagctgggctgcaattttaactgactgctcctatttgcattcagacctcactgctctagcaaccaaatcctgaatacatatcctccttacatttcgttttctcatgcagacagggcaaaaggccatcttaagacaaaatgagcagaaaagcaataatctcatgtacacagcaatacactttgctcctagatctctacaatggaaaacaaagaaacaaaccaaaaaaaaaaaaaaaaaaaaaaaaaaaccaaacaaaacaaggagcttctgaaggaactgcttattcaagtaaggactgctcatctcccttctgcgtactacgagatgatggcagaattgagttgcagagactctccttgaccaggtggcccacccaccactacctactgacttaagaaagcatctgcattcaaaacagagttcctgtatgaaagctatgctggaaataacatttttaaaaagaaaatgttcaggtttttttttttttcttttccctatgctactcccatgtcaggcttcagagtacagtagtaacctactgcctaaatatagcaaataaccacacatttttatttatatagttcgtgttcgtggctttctgggaaatccaaagaaagtgtgaattccgttcttttgattcattctccctttctgccctattgctctctaaatgaactctgtgactttcatttttttaaaaattaaacattaaaaagcttactttttaatataatggtacaatcagagctcaacactagcacagtccaggaggcctgggtctgtagaaagtgttctgagaacttcatttgtctgcattctgttcccacacctcgccccaggaagctctcataggaatctgctcttgactgtggactcagctctatcttactcttcagtgcccctacggagtttcctggacaggcccttcagagaggaaggagagctgagtgaccatcagtagacgctccccacctccaggccctgctattcctttcctcagggtccaaccagttgccaagaccaggagtagaaagcaggtgcttttacctttgaataacaacactgttgtctttgtggagaagaagaaggagatatgagttgttaagaagagtatgcaattcctgttgaaaactcattttaaaatactatgatttctctcattctttacactgtttctctagctctcaaaattctttaaactcagtctgtataagtattcagcttttcatctcttttttgaaactaaaatgaacattctgtaagtctacaaagcttacttagaaaataccacacattttattttctaggtggaaaactcaagaaataaattgtccggttccaaaccacaaacagagcaaccttacgaagatctgccacccacaaggcctctggctctggctgtttccaaaggtcccacccagcttggccttgtgatggttttgactatagctgagtataaaattaaaaaagaaaacacaccctgatttgattaatgggattaccgagtttgttgttcaacaaaatggaaaaaaaaaaattagcctctgaaacacaaggatagaaggttaagcttccacttacccaagataagtaatctgggctaaagaggtactgctatctgggtaagagactaaattttgcctaaggataaaagtttgtcactcattaagtttttccctatgtaatttacatcttctaaaacaaaaaaggtagcttgttatggcaacattttaatatagggcacgtggttaatcttttggtttacactttgcttttccttctgattgtactggaattccccgaagtcataccgggtatccctcagaagcacattcccagagttctccatgtcagcttgtgtgtcacactcacagctccaaaagggctaatgccagtcttaatgggacagggtcagttcttccaggaaatccttaaagtgtgatttgaggagcagctgaaggaactatgatctaaactaccttccccagtgatctcctaagacatttcatcacctacatttatttattccttttggacctgaagtagtctatttattcatttatttttgagatggagtctcactctgtcgcccaggctatagtgcaatggtgcgatcttggctcactgcaacctccacctcccaggttcacgcaattctcctgcctcagcaagtagatgggattacaggtgcccgccaccatgcccgcctaatattttgtatttttagtagagaaggtattttgccatgttcgccatgctggtctcgaactcttgacctgagatgacccacctgtctcagcctcccaaagtgctgggattacaggcgtgagccaccgtgcccagccttgaagtaattttaaactttctgaatttccagtttaagtgatcctttaaatgggaagtatcataagtagtcatcttaccagtccatgtccaattttgagcttgtcttggtaaagcgccttccaacccaaggagtcagtgagccataagttatgtgtgactatgagacatgccaaatggggctagactggattgagctatgctgcaggtgtaaaacaaacactaggttttgatgatttaatatggaaaaaagaatgtaaaatattttggacatataatgtaaaaattttaaaatctcactacaattaatttcacctgtttcatctatttattcattatgttgagaatatttaagatctattatcctcaggaaatttgaagtacataatacattattattaaatacaatcaccatgttgtacattaggtctccagaacttatgcatcttatgactgtacatttgtaccttttgatcaacatctacttatttccctccaacccccacctcaacccctgatgaccaccattctaccctctgcttctttgtgtttgagttttttagattccacatataagttgcacaggctataactgctccatggttcggggataagaatgccagggacatatttgctggcttgtacctccagctggaggtgagagaacatggtggttctgctggctcaagagcaggtatgcctttggtgggtcatctgggctgtttctctagacaggggcaggagcttgcattaattcagccagcctgggattaatttgtctcgtgtgcaggatctgagtccacagttgttcctgggccctagcactgggcacccacccatgtaagcctggtggaatgacggtggagacccaagattggtggcacacagaggctaccaaccctcagagcaggacacactctagcagtggatctggtttcaaggtggtgccatatcatggtagcttacataaagagggtaaagtgagggatgcacaacttgtgctcctaatctgaagcaatgtagctgtgtgaactacaggcagctccccaaactaggctcagggcttgctgcggctgtggtatactcttgtagtaagaactgcaggtctcttcagtggcaatggaagctggtggggatcttttgcttaccttttcccctcaagggggtagtccctcttgactccaagctaatctcagcagggaacatgagctggcagaggcagggtgccccatcaccctcactatgctgccttcctgggcttctgaacactacagggaatctcactactctcttgctacactttaatgctttccctctgacactctaattgagtttcagttgttttttgtgaggggcataagtggcaggtatgtgtaagccatcttgcagacatcacttctcaactccctttctttcctgctttcaagattctctatgtttaatttttgacagtttgattataatatgtcttggtgaattcctctttgggtggaacctgattggaggtctttgagattcatgtacctggatattcatatctttctctagatttgggaagtattcagtctttaaataagtattctttaaataagctttctgccatgttccctctcttgcccttattacagtctatgatgcagcaattggctctgttgatggtgttccatgaatcctgtagatttctttctcccttccttttcattctttttccttttttcccccatctgattaggtatttttaactgacatgttttcaagttctcagcttctttcttctgcataagaaagtctgctgttgacactttctattgcatttttaaaatgtcattcagtatatgcttcagctccagaatttgtttgggttgttaaataatttctcttaattgaacttttgttcttgtattgtttccctgatttcattgaggaatcaatgaactcttgtattcttatctttgtattctgtggcctactgagttttcttaaaataattattctgaattctttttcaggcaactcatagatgtccatttctttgaaattggttactagaatattattattattattttttgatttttacaggattgtgttacttaacgtcttgcactgctgtttttgcattagaagaagcagttatcttcagtctttactgtctttgggtgaggaatactttctccaaacagccaagctagggattttgaggctctctcagaccttttctatggacatatctactctatacttctcatttcaattagtgggtaattcttacactgtacgtgttctcttgatcctgcaaggctgagtgctgagagcctcccatttgcgtgcccttggccagtgtcctctaatgctcaaatttgtgtgccctctctgaatcccaccgaattgagctcagtgactgtatgacaggtagtttgcacttgctatctgcagtgcatgcattgggagctggcttggggtggggatgggagtgtgaggtgcatggagcatttggagtgcctgtggaccacctgggggaaaggatctgtaggtgaggcatcccatgcagcttggggagaactttctgatggaggtctacagagtagttagaagcctccatggcctctcttccctgctttcaatctttctcaaccactcagctgtgctggttgccttaatattctgagtgggatgtcaaacagtttagcctcttaggcagcatcctacacgtctcagggagccagacactcactcattacactcccactttccccagtggaagaaatcacaggtcatggttgcagggggctctcttggcagtgacctttctgccttgaggtaggggtgacatagataaagtgaaactgttcttcttatactcattattctgtctattctcagtttttttttttttttttttttgagacagagtttcactcttattgcccaggctagagtgcaatggcatgatctcggctcactgcaacctctgcctcccgggttcaagtgattctcctgcctcagcctcccaagtagctgggattacaggcatgtgccacaacacctggctaattttgtatttttaacagagatggggtttctttgtatttttaattgagacgggtttcaccatgttggccaggctggtcttgaactcccgacctcaggtgatccactcacctcggcctcccaaagtgctgggattaccaggcatgagccaccacgcctggccctattctcagattttataatctaatggtgtgctaaaacttctccactggactcatggattcccacaaatgtactcttgtctgtggtatacgtctaaatcaatgcttctgcagggagacgacaacagaaagctcccattctgccatcttgctgatgtcaccctatttacctgtttctttcaatttttaaatgtagctgctagaaaatttaaattcacacctaggtggtttacatttatttctaatggaaggcactgatctatatcacctgacattcctgaactgaaatatttttgttttatgtttaacactcatagaaatctttgtgaaggtgacataatctaaaacaaattgctgttaatgtgtcattctcctaaaaatacagagttggaagggatcttatcagctaattcacccaatcccatctcatttctatgacgaggaaactgaggttcagaaaggataaggtcatgccaaatacaccaattacaagactaaaatggattcccaatctagtcctttttctaattttatgatttttgtctctcagctttcttgtccttttcctgaagataatacctttacccaatagagtgacccttatcagagcaggcatttcagtaaatgattgatgaaggagggatttaaggacagggagtcatttcaaatcacatgattggctgcttattcttccttctcaggaatggccctaattctttgcaatcatctactaaaaatgtggctcaaagaatcctgttgctaggctccgcttctcttcaaaagcagctgttatcatttaaagattaaaattcagagctcttagtcctctttcattatgtaatacaaaatgcaattccaaatgacaaggcaaggatcatgtctgtattattaactggactcagggtataaactgttgatcttacatctctagcttttgactcataattgtaatacagaatctctttgacttgcaatagggttatatcccagataaacccattctaagttgaaaatatcgtaagtcaaaaatatatttacaccacctaacctactgaacatcattaacttagcccagcctaccttaaatgtgctcagaacatttaatattaacttaggtgggcaaaattatctaaccccaaagcctgttttataataaaatattgaatacctcacgtaatatactaaaaactgtactgaaagcataccacttttgcactatcatcaagttgaaaaattgtaagtcaaaccatcttaagtcgggaaccatctgtacttagtatcccacgaaaaaaagaaaagtcttcaatttcctcaataattctattaacctacactatctcagttccagatccagatgtataatcacctctgtcatgtcttctgtaaaggagatagcatttgattccacgctagactgacttactaagattgagacttttgctactaatcttctttaactagtttaacagaatttctcccttgctttcgctaggaagaccaagggaaataatggctatctttgcacttttatgatccagaccacttgcagcttaattgctagaaaattttgtttcagagggtgggtttgccttgtgacagttggcactgtattgagatatgcctctgcactgctcctgtgaaagcaaaagtgacctagataatggcccctactatgaaaattgcttccccaatgttgacaaataaaaataaaccatctgaggaataaggctaggatcacaaccagaaagtgttctccaaaggaaatatatcaaactacccaacgctactgactatgcaacaagatactcaacagtaaaatgaaaggtttactatctgaaatttatattatctgtgcttccagatatgaatggttatgggcttccctaatgactttgaatagaatgtattctttttttgcacatatatcaattttggaaggaatcatgctgttttaaatgtcaccaagaattagaaattcagaaaaaggtgcatcatgcttcaagaatgtcctagatttttaagaaaatattctgtcccaagaaatttataagttttgttatagtggacatttgttgtttctaaaattgaatttcctagccatgtggttggtgtgggctctaactgccttaagccataagcatatgctactctgggtcgcaattcaggagtgggtattcagctgaattcaagcccattaagtcaagtgacctttattctaagtctttggtttcagtcatgagggaagtggacattctcttttttcctgctggattggaacctgaaaacacatataccgagaagtatcttccttccaagcatgaagggactattaattccaagcccatgttcaaagatctaactaatacttaatacatataaaactggctgcagcctctagtacagggtttgcaaactcaaaagccttcagggaccagagcaatgacacttactgtagaaagttatcagatgtgatatattaataacaggcaatggtgagaaggacaagacctgtctttcctaaacgcatttaaattacaatgaaaacaaatacagtattatgttggccaaagaaaacacgttgacattaggtgggctggcaacatacaattcattggcattgcgtcggctggttttctaacaggctttacaatgacctgaaagccagctattaacctgaccttcagcaattcccctgtagtaaatctcttgtagcccagtcatggatttaataggcttgggctggtgtatcttttccctctccctactcaggtccagcttaatttaaggagtatgttaacatctgtaatcatcttaaacgttgcatctgtaacatcttaaatgttgcaggaaaaatatcttgaaataaaaagcgtcatctccttccagttgctgttgtttttaaagctgaagaaacataaaaccaaaacattagggccaactgcattgctgtcaagggaatttctctaatggtgctgtgtcttaaggggcccaggtgttttccagaacagctcaaccaactgtgctttgtttggagccttgtaaacttttacattgacacaaaacatcgatctgccccagaacttgatctgtttcccaatatactagaagcacagggatcaattaaatatttttaagtaaaatgggaactgaataaaatagaaaaaagttaatttataaggaaatgtggctatttctgatatttatttcttgaaattgggaaatgatggtgagtttctcaatgtagacttgtcatgcttaaagcctcttttagaagtaagattagattccaaaccacagcttggaggttaccaattcagtaacatcccttcgcttagagttaagtcaatgaagagagcccattctgagtaaagtttgctgctttaagtaaaagtgaacctcttttctaacaggctaagatggaagtttccttgctctctgtaaatttttttttaaaccctgtatttaccagaatttctgattatttactgtcagtcagagtttggacagtttctaaggcatagaaagagaggtaaatttggctcaccatgaagcactgtttgtactcaaagcaacctgggatttaaacaactggaatgcatacaattagtaacactcctggtgttattactaacagcttaatattctgccaaaataaaagtatttttccttaccaaggacttgtgaaaatggtaagaattgctttgaaaccaagggaggccctgttgaggaggacccaccataagaggaggtgagagcacccattcatgcctatgatcttccctggtgattaaagctcctcttcctgtcactgcccatctgtgggctcccactgaactgcagacactgctgtctgctctcacctgggtgagaacagtcaccaggtttgttttcatgggagcttctggtcctgttaaaacaatgaatactaaggtttctcagagaattacttcctctgatgttatcttttatatacaataataaaatttcacgcatgttgtcaacaaacgtgcgtcaattagtcagtgttccagaaactgggaaaaatggtcaataactcttatatctgctatgaagcggcctgctcagggaatgctgcttatgaagcaaaggatgctgtgcaaagactctctgcaagcactcacgagagaaaaattccggtggctgcaacaatagcaaagtggactcaatatgatatatgacttcaatgttaatttaaattactgaaaaacaattgttcacttcttaaaaagcactacttatacaaaaccccttttagatgacagctgaaattttccctctttcatgacataaatattagctgtaccaagtcagctatcctcgcgcctttctgatagacacaggtgaaggagcttgacagacaagtcaacctgcttgacatattagcatatgggtctgattttaatgagtcctggaacgcagtctgcaagctcgctgaggtgacgatttgatgaaagcaagacttaatccctgcaaaacttggtctaacttcatgtcagggattgaaaatgctggctcttggtgggttacattttcagaaaagaggtagcgctgtcgactcaaaagtagggagggctcctagcaatggcaagctttccatggccttgcagccaccccccacctcctggggacaggctcttccaccttcggcatcaagggctccagcgaggtgctgagtgctggaagcagggactgaggtgctgggaaatttaattagcttgtgtgaaacaaaacaggcctatggcttaaagccacttcagaagtgtgaagaataatgattgctttttgagaactcccatttcccaagaatgaacaagcctggggaaagatgagctgcctagttttttgttgttggtttatttttattttttattttattttttcaagcattttgctggtaaggcttctacggtttttgctaagaaacgtttacctttaccaaaataaatagttctcttagtagagttctccgcccagagcaaggatttgcttgaccatgaagaaaactagtacatggaactgtagtggaagtgtcatttttttaatcaaatgctacatttgataacagaaatattataactcagagactttttaaggcttctatgaaattgtatccaattcagcaagcacacatagcaaggcctggaaatgaacttaggctcatagttttgggtagggggaggtattacggaatccgctacaggtaacaaagacagatgaaaataacttcagcttaaaaaaattgtgccaagtactgaaacagatgaatcccagctagtatatctggatcaggtttttcataggaggaatttgggctgtacctcaaaagacgaacaggactgtcagaaatgaagatgatgggaagagcatcttaggcagaggaaagtaagtgaacaaaggtataaacgtgtgtttggggagagtaggcagaaatgtgactaccgtagggaggccagtgtgggaaagacggacgttgtggaaacgtggagacgccaaatcctctccagtgaaagaaatgagactttcttcaggaggtaactgggggaggggaatcggggaagctgtaggcagctgtcaagcagaggaatgccgtcatctgggttgaacctcagaaaaacaaccggccaaaggatttaggatgaacggaaggagagcggagtgagaggagaaagccagggctcagcagaggaagtagttataaagcaatacaaggaagggacaggtgtgagacgccacagacactgatcgctaggatgtggacacttagaagattttaaatttcaagcctgaggaggaaatcagataagatgaaaacaaaggagaggaacaatgagaagtaaaaggggccagagctacaatgaaaaagaacagctaaaggcagattcagcacacccaccagaaaaaaaaacaaaaacaaaaaacaacaggtcaaattagtcgataattaattctttttattttgtattgcatgctacctactttaaaaataaaaagacactttaaatgtctgaaggcagaggctaagggactctaaccctgacattaatttggaagaaaactgagccatggaaatatttggaaatatactgttttcaacttgggtttaaattttacacttttccatgccatagcatatggatcctcaccattctttttaataagcacactcactgtatagatggatgtgccacaacttaatttatcaacccccttctgaagggcagtgggtgacaagaagaaaaacgcatagtgttgccgaacagcaagaatgtgcagggaaaagctgatgcctcacatcaactatgtggctcatttcctcccttgtgctttttttgactccaattctgccggaagagacacagggatacagaaagcagctgtccaccctggtgtgtccctctactgttctttttcttcccctcacagcgggcgcacactattccaaccaggcaggctatttacttttaagtgtataaactggcaggttactctttgatgtttgcttggcacttaaacagaatcacaaacaagaggggccaccatgaccttgccaggagctcccaaattagagccaggggcaagacacgcctctctcagtgacactgcaaagaaagataccgcctcatggacagatcataagaaaactcagaaatcagcatttactaacatttgggtgcaacacacctcaaactccagatagtggtctttcagtttgtactcatcgacgtccttggctttgaccttcttgtcggggggatatgagcggtgctcggccagctcggtggtgatctgcttcagcttactttcatgtgacttcagttgctcctcctgcaggaaatcatgatgccatttagcgttcaaaaaaaaaacaagtcaataacaaagcacagcatactttaaaaaatcccctgtgctgaatgactttaattcactaaaacagcccaatgtgcctctgctgccacatccttccagctttctcacgcccctgtccacatatttcatatattccttcccgggatggcaatcaaggccaacctctttaactaggtcccttgtcataaaaccaaatggcttccgagctctttatcaggtgtaaatgcccctgagttgggaccaggccttaagagatgccctgacaggcatgtcaccagctgaacagttaagcagctagcatggaagctgcacaccttggctttcccatttcatgcccactcagcaatgctgccagcttttccatccatcacaatgaatgaattgtaattgtctatgtgcatattttttttcctttttgaaagaagcagagctacgaagaaaaatttcttctctgaagcttaccagatgatattctaaaacatgcagctatctcgcttttctcttaccaaagcagcagagttcttagttccttcaacttgattggcccaaagcaacccgtcaattaaaatgtatctacctatttagcaattattgccttagtagcattattataggtaccgtgtaccaatgcaatatggttgatcctacatcaaaggatttccattctaagggtaccatttatatcaccttagcaataggctacccaaaaagatatgttactgaaccttctgccagcattttaaaaacattcttggaattctcttgcattcttgaaaatgtatgactccttactgttctagtttcacatgcaaattatccaaatttcacaggtacaataagataaatgggtaaaggcaaatgaaacagatctgactaaattaggtgataaatgtattttatataacaccaacataattgtagaacacaaaaatcttgtagaatgaggggaataattttttacataaacagaaaatgaataactatggacagtaaattacaaatatataatattgttgtaaattagaagaaaacgtgtccagaaattatgagcgtcacatataatatcttacggacttttgtaataatgtacatcttaaaagccaaacaacaaaaacaaaatccaagtcaaaaaccatcaaaacagaagaaaacaatgacaagtaaaaagcagaggacacgaatggaaaaatgaacaagaaaggtagcatgaacacgtggagtgatctaaaaatgacaagattcatttctaaatgccaactataacaaaacaaaatgaaacactccaagaagtcccagaaaaggacgaaggagaaaagaaacctattttgagattttagaaaggcgtctacatctccaaacctattatttgtatactgataatgctgaaagtcaaaaatgcttcaggtagcttttatttacaagttcttactcatctattactttcaggcaaggagactatcaactatgttatggattgaatgtgtccactcaaaattaaccttcagtgtagctatactcgaaaatggggtccctaaagaagtaataatggttaaatgaggtcataagagtggggcatatatccaataggattagtgcccttataagaggagacactgtgtgcaagcaccaatggaaggccatggtggccatccacagccctaggggagagccctcaccagacaccaactctgctggcaccttgatcttggatttcccatctccagaactgtgagaaaatagatgtctgctatggaagccacccaatctatagtgttttgttatggcagcctgagctaagacaaactatatcaatagtttttatttctttcaaagttgttttcctttgtgtatttattgcaatatgtaaattacctaatagacttcttgacaaatgatatttagtgactggaccacttcaaaaaataaaagcatgatgtattttccttcttttctaaaaaaagttttaaatatataaaaagtcatattgaatgatatatgaaaaacacccatgaatctaacataggaatttaagaaataaaatataaataaatggaaactccctacacatgtacgtgctcatctcattccttttcagtgttattcatatataaagatatgtaaccataaaaatacagaagtgtagccgggtgtggggtgcctcacgcctgtaatcccagcactttgggaggctgaggcaggtggatcacaaggtcaggagtttgagaccagcctgactaacatggtgaaaccctgtctctactaaaaatacaaaaattagccaggcgtggtagcacgtgcctgtaatcccagtgactcaggaggctgaggcaggagaatcacttgaacctgggagatggaggctgcagtgagtcgaggttgcgccactgcactccagtctgggtgacagagcaagactccatctcaaaaaaacaaaacaaaacaaaaccagaagtgtattctctaggttttatacttgatataaaaactaattaaaggctttcttttgtaatttttttttcactcaacatgtttttaagatttatctacatgtatgctctagttcctgtcttttaaacattgcatagtaccccactgcaggacacattacaattttgtttaaggatatttagcttgttttcaggtttcctgttgtgggattttttttccctgttataaatgatgttgcaacagacattcttacacatgtctcctagggaatctgagcaagagtttttctatagtgtgtcacaaagtgttggcatttctgggttttagaatatgcgcatctttaagatgactgttttctaaagtgtttttatctgtttacatttccacagcaggtctgaaagttctctttgttttacattcttgtcaaaatgtgatgttattatacttgtaaattgttgctaatttcataggtaagaaatgataagccactgtgatttgaatttatatttccctgaatatgaatgaggatgagattttgttcataggtttactgggtttcctcttctgtggattactggacccatttttctattgggttgtttgccttttaaaaaatagatttgtatcagtatagttatttataatatatatgttaagaaatcaaactctttctatttgtggttaggaaataattagaatccaataattagaatccaatgatagaatccagtttatttaagaaaaaataggattttaggtaatttggtaaaagaatttacaaacttctatttttttttactttggatctatgcaaatatgctttcagatgtttgcttcttctaaaagctttagatttaggctttccaatcttgaatattcaaatgtctctttttctgttgaacaaatcccaatttctacttattttaatgaggaatacaggctagaatgacaatatgtgcaacatcttatgtttttcactttcctcccaataccagggcttgctcgggtttgttcactgttaccaagctatggtacgtaaatctgtttctacagcagcataaagggctagtcatttaggctatatttttacaaaggaactaaccgaggaagtgctgatgttcaatgagaaatgcttcactactatttcactggcttcataaggcaggagtcaataaagtaagctcaaaataaagcattttaaaatcacatctccttaaatctgtccattttgaacagtgaaatagaaatgccaagtggctcttacggacacagcttgaccatgcaaattattccagtgctagaatcccatgataagaaagatacacattttacacacacacacacacacacacacacacacacacaaacaaaaaaacaacaacagcaacaacaacaaaaaacaatggtaaaaaacaacgggagagaggctgcagccatggagatgtcacattctcagactcaggacaactacatttgtaatagacacgatgaagaaagacaaagtaggaatttgcttttttattcccccaccttttgtctttgcttttacagttctttagggatgcatacatactgtttttagaagacaatactagcaaaatagatttcagagatggcagaaaaatattacatttgacaaagaaaaggcatggagatagaaaataccacaaactcataaaattgttttaagttaggaagtgataatttttaaaaaatgaaattgaaaatactagatacaagaaaagttgttgtggttatatgtcaatagatttaaatcagtaagacctttcataatatatacaacaacattttatctaaaaggcaagttttcgaagtcacttaggatttcatttacttatattaggggttaatccccaaagtatataaggaactcaaaacaatacaatagcaagaaaacaaagcaattaaaaaatgggcaaaggactttgctatggtttcattgtatccccttcaaacttcatatcgaaacttaatcctcattgtgtagtattaagagatggtgccttttggaaagtgattgagtccctcatgaagcggtaagtgtcttatagaagtgctggagtgatataggttagacccttttttgcccccgtcttctgtcatgtgaggatacaacatttatcctcacaaatgctgtcaggaaaatctggaaaactgtaagaaggctcctcaaaaaactaaaaatggaattaccaaataatctagcaatcccacttctgagtatgtagccaaagaaatgaaatcagtatctcaaaaagatgtggcattctcatggtgagaccatgccgtatcttcttcaagaagagggaacagctcttggctgcagcattattcacaatagctaagatctagaagagatctaagtgtcctttgaaaaatggataaggaaaatgtggtatatatacacaatggagtattatttattcacccttaaaaaagaggaaattctgtcatttgcgacaacatggacaaacctggaggacattttgctaactgaagtaagaccggcacagaaagacagatattggatgatctcatatatggaatctaaaacaattgaactcatagaaataaggagaatggtggttaccagaggctgggggcaagggactggggacatgctggtcaaaggatgaaaaatatcagacaagaggaataaattctgttgtgtatcatgatggctagagttcataataatgcactgtgtatttcaaacttgctcaaagaatagaatttaagtgttctaaccataaaaaattgatatagcaaaacatcacaattatacctggaaatacatataattattatatggtcaattaaaattgttaaaaaaatatttaatttttttcctatttatatagtacttaggttttgagaacaatttcagaatttcctttaaaatattaagctctaatgtcatctctatgaagacagtattgcttaactgatcaggcaatgggaacaggcaacttggctgttgaagatcttgcagtgtgagtcaagggctgacttggagttacagtccttctcccccggtgcaaagcccaggaccaagggccagaaattagctttttatctttttataccaagtataagatttacatagtacttatcatggagagaaggatgagagagaagctgtgaaaacttaaaggaaacaataaaatagaaatgcagatggctccaagagggaaaggaggaagaatgagagagaaggcagagagaatcgggaaacagagaacacatttatccatccgcgaacctcaccgagcgcccatacagcaggcactgtgctgggtgctgggaataagaagagggaacagccacagtggctgccaccagtcttttcctccaagctgtgggatacagaatcctagatgttctaaggtggaagagaacctggccactgtcctttctaccctctttgtcttagagaagatggagatccagagagttcaagtaattgctccagttcagacaaaaggacagagtggcagaagccacattctcccaacttctatcatgaagtcaccttggaacagccttctgaaatccaaagggctgtcaacaacatagcttcagcacattgtcttacttgacagatcaatcctgaactcagctttcagagctcttggtaaactccactgctgccgggtctcctctgctatagctctcaaacgtgcaggctggactcagggttactcaccttgctccaaattccactcaaaacctctgttacaggctgggcctggtgactcacacctgtaatcctagcactttaagaggctgagatgggcggatcactgaaggtcaagagttcgagaccagcctggccaacatggtgaaaccccgtttctactaaaaatacaaaaattagccgggtgtggtggcatgcgcctttaattccaattgcactggaggccgaggcaggggaattgcttgaacctgggaggcggaggttgcagggagccgagatcatgccactgcactccagcctgggcgacagagtgagactctgtctagataaagaaaaagaaaaagaaaaagaaaaagaaaaagaaaaagaaaaaacaaaaacaaaacaaaaccaaacctatgttactctagatcacaccacttcttcctcttctgcattacggcagcacttaaatgtctacgtcatatgcttagcacaaaatataccctgacctttgtgtgagttttatctcctttaccgattacaagctcttaaaaaggcaaaaaaggtcacttttttccttcccttaaatcctccagtatccagtaaagtgttgagcagagagatagtatgtggcagcttttggtttatagacattacctgcctaacatgaacaaataccttaagctctcagaagttgagggccaaggcaattgtctcacctgtttttataatgcccacaaaacctaacatagtacctgctatacaggatcttcggtaaacagtagctgaacaaatagatttttttttttaagtgaagatacagaggggagggcttagactgtttcctttgtgctgtcttaaaggagacagatgattttcagggtaatcatgtatctagggatccgcagtgcaacttagaagtcaaattgctaaacactggaaactgttcaaaacgaagtggtacagaatttagaatacagaacacctgtctttgagtcagtttgagggaggctcaatccaaaagattgtttcataatttcatgtttaagacagctttagaccttaaacacagtatttaatgagtataagcaaaatagcttccacatgatttaattacttgttttattgggtacttaatatatattaaatacagacctcgaagaaatgaatttttaaaaatctatccattcaggaaaagtatgggtaacaattaaggccacatcaaagagtttgaatgtgaaaaaatgaatcagttaagggtaagtgacataattagaatcatattttagtcagaactgtaaagggtggatcagaaggacataagattactggaagagagatcacaagtggttacagaaatcatctgggtcagattattccaaagtggggtgtgtgtagcccaggcaagatgacccactgcaaagagttttaaaatcagtattgagatacaattcacataccataaaaacacccctgcatgtctaacagtgctgaactcgtttatgagttttcaaaaattttaatagctccttaggcactgggaaaaaatttaaagttttcttcttcttttttttttttaatctaagcactacaaaatgttaaggtttactaatatttattactgggattgacagtggaaaatgtagtttattttctttaaaaaagcatcatatattaaaagatatctgctgaaatatttagtattgggataaggtgaatagtcaaaaaagtgagtagaccagtgatctaggtagaatatgacaaaaatctgaagcagtaggtgtagaatatgaaagacattggccaggcacggtggctcacgcctgtaatcccaacactttgggaggccgatgcgggcggatcacctgaggtcaggaggtcaagaccagcctggccaacatggtgaaaccccgtctctactaaaaataaacacattagctgggcatggtggtgcacacctgtaatcccagctacttgggaggctgaggcaggacaatcacttgaacctgggaggtggaggttgcagtgagccaagatggcaccactgcactccagcctgggtgatagagtgagaccttgtctcaaaaaaaaaaaaaaaagatatttagagggtagaagtgacaggactttatgacagaaactgtggaaatgggtgggtgggggcgcagtgaaggaagcaactacaagaatgacctcctcccctgaaatcccactgcccgtaaggtcagctccactcacctggctctgagcaccactgccttgtggtcataccacaggacaaaaggaggggtgggggttacttcagcgtgagaatcaagcataggactgctttgcttctgatcagtatccatcttaagtctgaccaaaaaagtatttagtacccatggattcaaacttttataagacaatggttggaattctaagaaaaaagacctagatatcaggaaatgaagatgtcctggggcaccattctctaaagaagcaaggaaagacctagggtaggcacaggttcctacagtgtagggtttaagtgggatctggagccacctgccggcctggagtggaaaagaaacacacatgtgtccctgagcccagcctggacctgaacgacctggtggggctgggaaatgtgcattttctgcaagtcccgacatagctgttgtgcacactgaagtttgaaaagacttctctggtgggcagaaagggaggttgtgagcagactgtgaacagggccggccatgcatttctgtgtttggagagctacaccagaaggagaagcaaaacttgtattttcaaacaagtctttccacccccaatagaagaaaaatgtgctctggcagcactgtcatgaaaaacaaagaaggcgactcctcctacacagcagagttgttcagaaagtaccacgctgcactggcaataatcaattttaatgattaaggctaatgtgttttgcataaaagacaagaataaattaaagcaaagcccacaaatgacagggtgacaaacactgtgtcttgaaaaagcaccaaacaatcttttaattgaacgtctaatttttccccacactgtttatctttctttatcaatgtttccagcaaggcactcacatttttatacctgtattttgtaaagtaaaattatccaaaaaattgtggcatttaggggagtcagagccaggttgtgggagtatggggaaaaaaagatagctggtctcacggcttcacatccactggctaaagcagtggttctcaataggagtgggttggattttgaccccagaagatatttggcaatgtctggagacatttttggttgttagaactggggggtccctattggcatctagtgggtagaagctggggatatcgctaaacatcctacaattcacagaggccctcacgacaaagaattatccacaccaaaatgttaatgctgctgcgctcgaatatgcctgggttaaaggatgagagctagtctttgaggtactggaggaatcctaggggcagccagacatcttccaggatttgctggaggcacactatgaccccagtatagatatccccaagagcctcaggtgctactccaaatacatgcttaattttacatatgtgtttctcaaagctaaaaatcttatctttagaaacaaaccttatgactcggcaaagaaataatacagagctttggatagaaaaatccttgctgggcagggtggctcacgcctgtaattccagcactttgggaggccgaggtgggcagactgcttgaggccaggagttcgagaccatcattgctaacacggtgaaaccttatctctactaaaaatacgaaaaattagctgggtatggtggcgggcgcctgtaatcccagctactcgagaggctgaggcaggagaatggcatgaacccgggaggtggggattgcagtgagccgagatcaagccactgcactccagcctgggcaacagagccagactctgtctcaaaaaaaaaaaaaaaaaaaaaattccttaaaaacattctagaaccatctcatttttctagatggaaagctgaggcccacaaagcaaatgctgggtgatgcaattcagtggggtggcggagatcatctcatttctttccaaataaattaaattcctgaaatgatacggttaccttgtcttacatgatactgcaggatatttctttttggttattaccttcttatttaaaatcttcaatccctaattgtgattatactacatatgcatgtttttgcatctctgtggatttatgtccaaaatgaaggaaaacatttttaaaaattatgcattctatttttggttccagtgtaagtcatctgttagaaataagagtgcctaccatgataaatgtgtgtgcttgcctgttctggggaaaacacgcaaacagatgaacacattcattttcacgtacatatcacttactagtatacagtccctaaataggaaagcagtacattttttaaagtataaagtaaacagaactgtagattttagtgagggaaaatcaaggaaacactcatatgttgctctaagttacattcaccttccatgaatgacatgcttattatcagccctctttagttcaactcaccttctcccctggatcttttatagaactgaatgtgagaaagacccaaactactgaaaaagaacaatgggaaagtccaccgtaaaattaatagagcaaaactcaattttggaaggtttttttttttgcttccagttacttgattttttccctccccttatatcgtgtaatgtgatttaccttttatgcgacatgctctttatgtggtatgctgcttatgttaagtatgcatatttaaagcagagaaatgcatttgctttaagagttcatattttagttggatagatggagatgtctgccaacataccttctggtcatcagtaagagcattccttttcttttaaagttgtagtgtacttattacccttaaaaattcaatgccattgtgtcctgcaagaactgtacagtaatagtaatgcttacaagtaagcattcaatatatgttaatgataattatgaattaaaaacagaagaatctttcctgaaaccacagattcttccttcttactactagtctttctgtttttataactatggcaacacttgagcacattttcctcctccacttccttattaccttccattcattcccccatcaaagaaggccaatgtggtttgtcttcccatgactccaccaaaatgttcttgctaaggttatccaatgatatagtttggatgcttgtcccctccgaatctcatgttgtaatgtgatccccaatgttggaggtgggacctggtaagaggtgtttgcgttatgggggtagatccctcatgaatggcttgatgccacgcttatgataatgaggtagttcttgctttattagttcaagtgaaagtgggttgttaaaaagagcctggcactttcccttcctctctctcttgccatgtgacacatctgtttccctttccccttctatcatcatttgatgcttcctgagattcttaccagaagcagatgctgatgccatgcttcgtgtatagcctgcagaaccgtgagccaaataaacctctcttctttctaaatgacccaggctctagtattctttatagaaacacaaaatgggctaagatacccagtgacctcccagccactaaatatcacatttttaaatctaaatcttcatggaaccttttcccccctttcttggcacaacattctccctgtttgtattaaatctaagtaactttttggaaaattgcttatcaagtgccttagtctgcttctgagctctggccactgcaggaattggagacagaaagaagaaaatgatccaagaaaggagtctaagaagcaaggggggaaatcaagagacagtgaggtgagactccagaagcaggtcagacaccacagtccccagctgtccaagccacaatgacagcctgtttcctctacttccatgagccaccagaagtgtccattctacactttcaaggtctctcaagcactttcactacgatccatttcttctgcagctaccttggttatctctcctctggattactgaaaattcctttaaaatgggcctttctgcttctagtagtaccttcttcttcttttttttttttattatactttaagttttcgggtacatgtgcacaatgtgcaggttagttacatacgtatacatgtgccatgctggtgcgctgcacccactaactcgtcatctagcattaggtatatctcccgatgctatccctccccactcccccgaccccacaacagtccccagagggtgatattccccttcctgtgtccatgtgatctcactgttcagttcccacctatgagtgagaatatgtggtgtttggttttttgttcttgcgatagcttactgagaatgatgatttccaatttcatccatgtccctacaaaggacatgaactcatcattttttatggctgcgtagtattccatggtgtatatgtgccacattttcttaatccagtctatcgttgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcaatgtagaaaaatcacaagcattcttatacaccaacaacagacaaacagagagccaaatcatgagtgaactcccattcacaattgcttcaaagagaataaaatacctaggaatccaacttacaagggatgtgaaggacctcttccaggagaactaccaaccactgctcaaggaaataaaagaggatacaaacaaatggaagaacattccatttaagttttcgggtacatgtgcacattgtgcaggttacttacatacgtatacatgtgccatgctggtgcgctgcacccactaactcgtcatctagcattaggtatatctcccgatgctatccctccccactcccccgaccccacaacagtccccagagtgtgacattccccttcctgtgtccatgtgatctcattgttcagttcccacctatgagtgagaatatgtggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacgaagctggaggcatcacactacctgacttcaaactatactacaaggctatagcaaccaaaacaccgtggtactggtaccaaaacagagatatagatcaatggaacagaacagagccctcagaaataatgccgcttatctacaaccatctgatctttgacaaacatgacaaaaacaagcaatggggattccctatttaataaatggtgctgggaaaactggctagccatatgtagaaagctgaaactggatcccttccttacaccttatacaaaaatcaattcaagatggattaaagacttaaacgttagacctaaaaccatagaaaccctagaagaaaacctaggcattaccattcaggacataggcatgggcaaggacttcatgtctaaaacaccaaaagcaatggcaacaaaacacaaaattgacaaatgggatctaattaaactaaagagcttctgcacagcaaaagaaactaccatcagagtgaacaggcaacctataaaatgggagaaaattttcgcaacctactactcatctgacaaagggctaatatccagaatctacaatgaattcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaagtagtatcttcttctaacaatttctcatattgtaatgagaataatttttaaagcaaaaatgtgatcacattactgtcctgcttaaaactattattattattattattattattattattattgagatggagttttgctctgtcgcccaggctggaatgcagtggcatgatctcggctcactgcaacctcagcctcctgggttcaaccagttctcctgtgtccacctcccaagtagctgggattacagtcatccaccactgcgcctggctaatttttgtattttttactagagacagggttttaccatgctggccaggctggtctcaaactcctgacctcaggtgatctgcccacctcggcttccaaaagtgctgggattacaggcatgagccactgtgcccagtcttaaagctattattttaaggatgctgggaaccacagcagcatccaaaatcctacacacgacaaacaaggcctttcatgatttggcctttgctgacctctgcagaggtacatttcttgctttttctcaacactgtgctcatgtcacagttaataacttgtgtgtggttcctgcatccagcgctctcttctctaggccttcgttcctctgatggctctttttcctatctcgtcccacacctcacctaactgcctctcatcctttaagctgcacattaggtaccacatttcctccttcacctccaaggccaggctagataatgtcccttccttgaacctccacagctctctggacttatccttcctgtacttctatcaaatcattttacaatgacttccttatttatatttgccacaccttcagcagaggatctggccttcatctgcctttctatctccagggccaaaaatagtctctgatgtacaacaggcacacaatacatatttattaaattaatctatcattgataattgctccctctcttgccatgggacacatcttatgatatcaaagatgtatagggagctagttaataccaacacttggtcgatcatagtaagataaaactgtctctatgtaataagaaattcacaaagacatcaaagtagcttccaaaatctttaactagtcaatggcaagggggtactacagacaggtttaaaatgagcaaacctagctggtaggtagtgtccttagaagagttttaagtgaaaaaggacatgataaaatatggcttttagtaagattaatctgaccacagaaggaggcttatgtaaatacacttggagcagagttctggtatactttatcttcattagcttggaaaatccaaatgttccattcagctctgctctgaggggtagggcaggccatttcccattgtaatatgaaccgtggattcctgaaaatatttttgtatttctagcactaaacacatcctggaatatggtaaatgctcaataaaaatgagctaataaatgaatgcaagaaaagcttgttaccaagccagattatgagctggcagttaaaacaaacaaaacatcaagtattgctcataatgaactaatataaaccttagaaactgaatcaaagtacgtgtcctactaactgagactcaattatgtcagcttcctacatgaagtgtaaaacccagtgtactgcatatctgcctcatttatatgatacgctctcacagggcaaggtctcacacctgcccccaaaacatggactactatccaaagacaaatatttatcacattattttacaaagtactttttcccaaggtcaaagcactatcaagatgattacctgagacagttttgttgtagtggcaggcagaagtgggcggctaaacttcttctgagagccgattgctgctggaaatggtggtgcagaaaatacagctgccacacaattgattttgtttatccacccttgcatttcctctgggctcctatgagaaatagatatgtttatatcaggatattgccatgtctaagtagcatcacactttgcctatttcacgttactgatttgcaatggcatgtgaaaatcatttactcctcctggtacaactaatccctgacaaaacttcattagagatgaacattgtcattcgacgatcaccaaagaagctatgatcatcacagtgccagactgtgattctctccctaggaaacagaagggaaaaaagagaaacacttgacaataaatattgattaaacccctactttctgtttgatacgaggctaggccaaaaataaattataaaatttactcatctcttctaattgtactgtttaattttaaaatctaactgaggaatgcattggtagagggaaggtaaaaggatttatctactttggaaaacagctgacaggttcttcgaaagttaactgtgcatgtatcatacgtcccagcaattctactcctaagtaactatccaagagaaataaaaacatatagatatgccagacgtggtggctcatgcctgtaatcccagcactttgggaagccgaggtgggcagatcacgtgaggtcaggagttcaagaccagcctggccaacatggtgaaaccccatctgtactaaaaatacagaaattagctgggcatggtggtgcacacttgtagtcccagctacttgggaggctgaggcaggagaatcacttgtacctgggaggcggaggttgcagtgagcagagatcacgccaccgcactccaggctagggtggcaaagtgagactccatctcaaaagaaaacatacagatacacaaagatttgtatgttagtgtttatagcatcatcattcctgagtcaaaaaagggaaacaatccaaattgtccagtaaatggataaacaaaatgcagtaaatgcacacaactgaacagtatttagcaataaagtactgacacacactacaatacagataaacttccaaagctttatgttaaataaaagaagccagacacaaaagaccacatcatatattagtctgtttatatgaagtgtccagaaagggcaatactgcagaggcagaaagtagatcagtgggtgcctggggctggaggtgagaatggcagtgactacaaaatgcgcacggggatctctttggagtgatggaaatgattcaaaactagattgtggtgatggctgagccattctgtaaatatgctaaaaaaatcactgaaatgtacatttcaaactggtgatattttatggtacgtaaagcatacctcaataagactatttagaaaacccacctgagaggaggtgaaaatcatctgatgtgatcatatttttaatttatgtgtcattatatccagaaagcccaagattcacagcacttaataaatatttgcaaactcataaatgaatggtagaaatgatcatgaatcaggacagattatctaccatacacataatcaataaacaaaaagtaaaaaaaaagtcagccaaagtcatttccttcatcaattactctgagagaaaccacacaaacaaacctgagaccactctaaatgtcagctcctcacggcaccctctctaggctgatctctctggctccattattatttcaatggactgttttttgcatcaattctgtccaaagtaattagatctccttagttattacatctggtatttttgattgaaaaaatcagggaacagaataatttgaaagtttctttatgcccaatagctgtaattatacatccagctatgggtccctgtgtgatgttaaccatcccattcctacactcaaaaaccccgggcaacttgtttccttataacctccccctaaaactggcaattcatcccatttccttgctcacagtagaatgacatcttttccttctagtataatcatggactactagagctcagaagggaaacaaaaaaataaacatttacatttattgaacagttcctatgtgccaggcactgtgtgaggtattatacacacttatctcactgacttctcactagaactctgtaagataaacgttatcccccacactagtgacgagctgaggttcagaggttaaactatgtgctaggagaaagagctagagaaacagtgttatctaggtctgttttactcattttgcgataaaacttgtctactaaaaccctcatattttattgatgaggatactgaattctagagatggtaagtggctgactaaaagtcaaagggctactttgtaacaggtaaaaatgtaaatcctgggtttctatttttttttactctaatcttcttaggcagttatttctctaatgtaagcagttgatgactttgattccaactcaaaaaatttcccctgcagagcttgattttgttccttgcaataaagtagtgctaagtgaactaaaacacaaaatcaaataaaaaccaacaaaacatactgagtttgaaaaagcaagaccctccagtcggcagttttaagtttaaacacgtttggtttcttctcatagtccgtggccttggatgccaatgcgtggtgcacactcacagcgtttttcaagtcctcttcagacaaggccttttctggcttgtattcatcctatagatggacacaaagaaaataaaggcaaaaatcacgatcagatttcaacttaattttttaaaagcaaaaactaaaaaaatagtttttaggaaatccaagtaagtgaatgaaaaaaatgaaacaaacggtgagtaaaaacaaccttataaatgttacagaacattatgttgtttgaaaaatttgctgagaatgagaaaatacatctacccaaggcatttttttaaaaatcagtttttttaaaaaactgatatacaataattgaggtaaatagctaagtaaggccaaaggcagaaataaatatctatcgtacacattttataatgaacagaaatgagacttggaccaatagtgtgatttggtttcaggattaaatggttaaaagcacaaccttacaggtaactgtcaacagaattataccgaggataaaaacaatgccattgtgttctttgctctgaagatattacatgttcctgttactttctgtttagactaatattatcaaaagaaaaatgaatagtaaaataaaataattactccagctcttctgctgaaagaaaagaggaaaatcaataatcaggtgaaagcttagcttgttatcaaaaactgaaaaataggtaaatgcatatgctaccaactgttagatattttctagagtttaaggcctcccttcctccttcccatattttatcaaaaacaagataaacatgcattctgtaaaacacacacgtgtacccccgaacacacacaccacatcaccttctaattagtagtaaaagcctaaagaaagatattgtctgttttcttatcagtctgcttttacaaattttcacaaaaacaatgccagtcctccatacttcccctccctttcatttatcccctccaaaaaccaagcagttcaaatgtactattgccatcaattcaaattgagtcaaaaataatccttcatgtgacaatgctgtgaggcaaaggttttccctctacaatatgatgtaaataccagtggtaatataaagattatccacatttataatattaaacgacaaaattgttactttgggattgcaacaagtcttactttattaagcctcccaggataagaagtgctattgacaatgacagtcttctcgagtggtatgatgaataaaggagaatttaaaaaacaaatacaaggtatttatatgtacctgttactaattcccactaattcataaaactataatctagttatgttttaagatctgccttgtcattttttaaatgagatttttctcagtaatttagcattccaaatattcacaaatctccttccagggaaattttcatcagagtaggaatttcaactagaggtagcatgactacaaaacccctctggccttataattacgctataacagaacccggcacatgtggctctccacgcagtgtaacttagattccagacaaaaacatgaggtaggtaaataactggaatgaggagaaatgatgagggccaaaatcacttgagggaatttatatgccacctccatttccatacatactgatcccctaacacacctaatgattgagtttgcacaaaggttagcctagaaatttgtgtgtactttttttttttttatattctaggtccatgatttaagcttttatcttaattcctcttccctattttctttgaattaatattttgttgttgtttgaatttcttaagatgattacctagttcttttgttttccatatttcttctttggttaagaaagaatttaaggttacaatttttcctctgagtatgggttacactgtgtagcagagtttgggaaagaagagtattttttcattgctttctagatagtttgtagttttaattttttatctcttctttaatcttagtaatatcaaataatgtgcttctcaaatttaaggtaaagttttagttatatattattagatattcataattttattggcttatgaccagagaatatggtctagaaaatctattttccccaaatttggtaaggtttttcttgtggccaatcacatgtttgattttcgttaatgttccataaacatacaaaaaatttattctttgaggaatgaatgtgtctttatattcaagtttattgactcggttcctctgcccttacatcattttttctactagtttatccccttcagacacgtatattaaccttttccacttcaagttcttgttgcatttctgataagttttatacatattttagttgctatgttgtctggtgcatttaggtttataactatcatcttccttataactatgtgccacttattacttaaaatgttcttctttatccgtttaatgcttagtcatataagatggaaatttaaaagagtctttcttttacgaaaatgctctgtttatctattcctcacccacatcaacaagataagactttgaaaaatgttttgttctgcaatcttactaaaattatcttgtgttatgcattttctgtttcaagaagccttattttgaatttagattatacattctgagtctcccctcatagatttaactgcatctatgtttcctcgctcacctgcttctttcttttttccatcttgacctctctcctctcatacctttgctattttctcttctctcaagtattttctttaggtaggtggtatactgttttattcttatcctcaagtatctttcatttctttgataggtatagaactggatatagaacatatggctgcagtcttcttcattggttttacttattgtctggagatgctattctaccatcttctagcttccagtttaatacaagtccaatgccaatctaattattttctctttttcttgtttttttctcttaggaatcacatatgggttttcctttaatcttaggattcaggattttttgctaggctatgccttacttttcttagccatccatttagtctgaaactaaaaagtcccacccttattctcccttatgtaaccattcacttgggttgataattgctgacaaaactaataaacatagttgtgcagactgtagctaagacagatttaaggtctccagctacggctgcatccagtgccaacctacaattcttttacatctccatgatttgtgaaattcttcctcagctttttgttacaataccctcctggtttctctcctacctctctgatcattattttgctatctcttcttcttcatgcccttctatgtaaccgttgggatggtttgaactccagatatatatcacaatgtctaacaaactgctacaggtgaataggaaacacaaaaccaattggtagctattactattgaatgacttagactgtctcatttggagccactataaatattcttcgagtatattatctgctgatatcttcatttaaaatcaagctcaaaggatgacattcttatgctactcttaaaaatgcaaaaaaaaaaaaatttaatgctacatttattacagacccaggaaaaagctaacagtaattgtcaccttggaagaactgcaccattattttaaaagaggactctattccaaggtagtttcctaaactctaaggtaaactgccagattaccttatactggaaggagaacactatatacggcatcagtggaagacaggatctatttaattagggctaaactgaagttgaaaaattttaagtctaggaagcttccgcttttctagttgataatacaattttaccattttttcttaaaaaggcaaaatgcaaaccttaaaatattttcagcattctgaattcctactagaaaataaagctccaagtccacacacacacacacacacacacacacacacacacacaaagggcaaaaccaagagtagagtggaaacattagggttgacaattggattaaaaaaatgactttatcctactaagttcattctgacatctttatttttcactaaaggagaggatagtgtttaaatggtagaattgggcaggaagaaataacggataaatcatcgtaatcaaaccatttcaaaccaaggactatttgctgtgcaaactaaatgtgaaacagtgagcaagataaatccaatcaagaaattttctgtaagaaaagaaaatgctccacgacatctaattactatccattttctcaaataaatgaggggtgaaaatgatgactaaaaacatgttactctctcgtgttccctgcaatctacatcgttttatgtaacaggattcattagagcactccaccatcccaataaacaccaagaatgtgatttcacaatgctatttattttaaatccattaaaagcatgaaataaaaagctttttttccctgagaaacttgttaattaaacctcttgtgaagttgaatcttaacacactaacataaacatcatctacatatgtacaaaaaattggcatcaagtctgaaaaattgtactttcaggtaatataaactacaatttggaaaatgaccaaattgtaattaaaattcttatcaatttaaaaagcatattaaagactccagttttcaatgtactatttacttcatgcctcattaaataggtaaaatagctacatgtacttaaaacaattttaaacacagttgaaatggtcttgatttccactgagagaatataaaaagggaaagtgagaccacattgttacttggagctatgtggaaattaataaaaatgttagtaattaaagcaagctgggtcctaaattgtctattaattcatggttttgaaactggcattaaaaatgttttttataatttgatgaatatcttttttaaaaaatgctaagtatgtctgattaggcgtctttctaaaactcattcagcttcgtcctaataactatttcaacatgtaaaagagcacagaaccagcagtttcacaaaaggaaataaaaacgccatgagctcacaagaaagcaggatgagtgacaggagaccaggccagagatggacctgctccgggtgccacagtcttgggcacatcagctccagactgattgctgtcatcacagtctgggaggccttgaatcctcagtggcttccttctgtgcctgaaccaagccctcccctgatgcgacccagtaaacttttacaaaacctactggttttgtaaaaaccaaaaagtttaattccaattaaacttttacaaaacctattggttgagcctaggaggtcaaagctgcagtgaactgtgatcgcaccactgtgttccagcctgggtgaaacagtgagaatctgtgtcaaaaaacaaacaaaaaaacaagcccccaaaacaaaacacaaacaaacaaaaaccccttataggcaggtggaacaaaatctctcttccgagtaagccagagaataaagatgattctgcaccaaggacacagttcctgatctgtgatagtaaatgtacgttttagataacgaactgatttttcacttctaaagacagggtaaaggtaaataaattcaggtttgaacagctgctttctagaccctaaagataaaatcacatagagattcttgagagcctgatctgcagactacaataatcaagaggtgaactctaagtaattcactgccatgcactaacgagccacctacacccgtcgctcttaaccattccatcaatcatctctagggcagttcagttttgtaacaaccagaactggaacaagaataacatcacaagccttacaaaaatactttcaagagagaagcagagactggcagggacagacacaaagcccatgacagaaactgagagagaaactctgaagctttgtgatagcaaaggcttgtcaaagcacttggctagcggatgactcactctgtaacgaagtggatatgaagttactacccaaatgtcaaccatgatggatcatcagaaccaacaggaatggaatcattttaatgtcaattaaaatgcacattcaattcatagcactttctaatttttaaagcacatatgaactattagtattatattaaaataatatttgtcttttcttccatgaacgcttcacattcccatagtaataattaactaccaatagggcacacattttttaggtactcttgggctcaggggcactgcaagtactagaaaaaacacagataggagtgtgctcttacttagctataaaacagacagaaacactgtaccataaaagtcctattatgccagatcatgactgatacctggactctggaacagttttgaaatgtgcaaatatttaaatcagcccctatgctggtgttgtatatcacaagctctatctcagagagttatagcaagtagaaagaagtgttcacccgaatttattccattcaccctgtgttttctccaaccttcacctatacacttggtttacatcatgttaactggtgctttttcaccaggtgattttaagagtccactagccattcattgcataatactggtcttctcatccacactgtcaggacaagtgttttcagggaccagacgctatgtttatttctcacatagctcccaacatgacattttgtaaagggatctgacattactatcgtgatactccgtggatttactctttgcttgaaagtgaaaggcatatgtgactaagtaacattaaggaagtggccagaaaggaaaatgaggcaaatggtgatgaggcagattgtgtgtaactcagagaagcaaaacaagagctctggataatgtaagaaactgtctgggggaaaggaacaaagataaggacttactttactttagagttcaatcaacaacaggaaagaaacaagattcaatggaaatgagacagacaccggggacttattattttcaaaagtcacaggaaggggaatatgagaaaaagaggagtggagtggatcaaactggaaacttctgggtgagcttctcgagagtagttgtctatgtcctctctgcctctgcatcctcaactctccaatctgccttccacgctcaccactgcactgaaactgctttatcgataatttcctacttgctgaattgacgtggcactctccaattccctatcttaccttttcatgacaggacacatttcaaacatctcttaacatctctggtaccagttttctctctggcttagttttcttcctagctgtctggccacattgcacaggctcctcctcctttctcttcctcctagggcacatatgagtatatggtccactggctctgtcctccatcttctcctcactcttggagtgacatcatctacttgcatggcttaaattaccaattttttgttaatgactgttcagatctgcatttctggccccttcattggctccagatcaaagtatgcataattgcttactggacacatccatttattattccacacactctgaattcaacacctcaaactaaactctccaagtagagctatgtttccccctccatcttacccctgcccttgttcaagttaatctggtctctgtgtctttgatagaacctgtttccaagtcattctccaacctgcagccacactgatctttttttttttttttttttttttttttgagacagagtctcgctctgtcacccaggctggagtgcagtggcaagatctcggctcactgcaacctccacctcctgggttcaagcaattctcctgcctcagactcctgagtagctaggattttacaggcacgtgccaccacgcctggctaatttttgcatttttagtagagatggggtttcaccatgttggtcaggctggtcttgaactcctgacctcatgatccacccgcctcagcctcccaaagtgttgggattacaggcgtgagccaccgcatctgacccagattgatctttttaaaatacaaatataaatgctgtgcatggtggctcacacctataatccctgcactttgggaggtcaaggcaggaggatcgcttaagttgaggaattcaagaccagcctgggtaacgaagtgagatcccgtttctacaaataatagaaaaattagtcaggtgtggtggtggtcccagctactcagggggctgaagttggaggactgcttgatcctggttggggtcaaggctgcagtgagctgagacaccgccattgcactccagtttgggtaacagagtgagacctagtttcaaaaaaataagtaaaataatcaggtcactccccatttaaaacatgtgatagctccaactgctctaagataaagtctcaactctttaacatggttctctaggctcttctgcctcaaacaccactgaacctgcagttccccaaacacgctgtatcacatctaagtatccatacacgtttgtctctgagttcccttatatgactagcttccatttgtgtttttaagtgtggggttagatatcactttcttcatgaactctttcatgagcttcccttctcttgctcaggttaagtgcccttccatatgtgtttccatagcaccctcctctctttgtagcatttctcaaattgcactgaattggccttttgtttgttaatttcttcagaatgaagaagaaagctcctttgggcaccgtatcttgctcacaatcatatctctagtatacaacattctagaagacgggcaaagtcctaatcttatatatgcactcattattgacttgcttcctaggtaaatttatggccctctgtatcagaaaggtagtttactagccaaagttcagctgatactggatacttaagccatattttaagtgtcaatctgagagatataaaataggatgccaacagttccacatacttcatggtttctgggaacaatagacctgaaaaaggtctatgttagaaaatctcaaagtttatgtactcaactaatagaagatacgagacattttccagtgaaagagtggaaagtctcatatcccagtgaaagagtggctggagccaggcaagtgcaatcagagaaagggcaaagccatcattctttattcaagtcagaggctgaaggaaagttaatgcacagttgctgtgcagtggccaagttagttgaagctgggtgaagtcataacagttagagacctctccccacaacagcattttaaacttccagtaattacaaggctctcacactagagtgttcatatttacttaagaagacactaatgggaaaaatattagcttggctagtaccatctttacaatactgagtaggttaatcaactttagaacgccagcttttcaatttaaaaaatgggaacagtatccttctatgagattgtgaagctcagatggaagaagtaacctacaacctattatactaacaaaccagtctcatttctggctaaatggccaatgaagcaagctggctcaggcaatctgccaagccgtttcctacatttgtgatgtataatgctctgatctgggagtggttattcttttagatatgaaatatacagaaatgctctgcagggctatgtgggctttctttaatacgggaatactgctcttaaatgtctcttcaaaaaggtggggggctccttgtgcttatttgtttcatgtttttgctacatggaacgggtatgtagagcctatggcttattttttcataaagggactatctaaatatccagggttgaggtggtgagagggagagggagcggaggcatgtgtctgatctttggtaaaatttctctaactagaagacaagtatgtagaagtcatgtcatatatataattaatgtctatgggaatgaggaatggggtgatatggtatttttgacctgtgtttatgccacatcgctagctccagaacacgaagccctctgccttgcctggcactagtgctaggaggatttatggaggcatttgtctcctatctgaagtggaaacaaaggtagaagaaattacttatttttcaataaaggtaccagggaaagtaagggcctttatttggatggttgagaaggcctaactcttaatcatttcatacacagactgctgtaggaagattgtgaaaagggaggaaaataaggtctgaataaagccagtcactttatttttattttatttttgagacaggctctcactgtcacgcaggctagagtgcaatgacccaatcttgactcactataacctctgcctcctgggctcaatcaatcctcctgcctcagcgtcctgagtagctaggaccacaggcaagtaccactatgtctggctaatttttgtattttttgtagagatggggttttgacatgttgcccaggctggtcttgaacccttgggcttaagcaatctacccacctcagcctcccaaagtgctgggattacaggtgtgagccactgtgcccaaccacaccagacactttattccttatgagatgactaataatcaagaaaggactaaaagaaaaaatactctcatttcttataagagtcgtcaggaagggaaccaatatttactattaacctactgtgcaacaggtgttttcatgtatttaatcatttctttatatcaaccatgcaacatcatttcccctcattttacacagaaatgagttgaggttcgcagaggataattaactgctccaaatcagcaattagttaagtgacagacttggagtttgacaaggcatgtctacttactggagtatgactcttcgtaactcttcaaggtgtgactcttcttttggaagagccttttaatgctcttccaagagatatattttcctagggggatctgaggaagctggggagagcgatccccagcctaacaaagctcttactttaatacctaagaggctgccgacactgtgcccatgtgttcaggaggcatgcaacatatgggagcataaacacagggcggccacaaccttaagaggcatgagatattatttattaatgcttcaacttcctgtaggagtggccaaaaacctttgcaacaagccactttggctgggatgggagtagtgaaagaggttgagcgaatggagactgtgaggacttggcactcgctcctgtgtaatttcagctgtgcctagttttccttctgatgactattgtgacttttttgtttatttgtttttcggagggggaaagcctttactattactctccatttgtaatgaagaaatgcgaattgaattattcttgaattgttctatatgggtaaaaatcattatacgctattacgtagttgagaagtcttgatgaaaggcttaaagtaactgatgagcaactaataatgaaatgagaccctaaacagattgttattccagtgggtggggcagggggtggtttgtgtatgtgtgtggtatatatgtgtttacaatgaagggaaggtggtcttcaaagccagccattatggacttccggaatggctggaattgccagccattatgaattctttcgaagaccaatttgattcatttaatcagggaagcagtggccctgtttccttctgtctcaggcagtactacccccctcatttatccccaaggccgagacgttggcagccgcaagggggaaaatggagggcactcaggagggaagttaactggaagcccttggacaggattccttgatgctgagaaatgtatatggggtagaaaggtgtggagaaagagagaatggatgtagagcctgagtgtgctagtgaggcccttaaggatagacgccggatcctgggatctttgcatccccatctctggcaaagcccctgttacacaggaggccaaatgagtgagcttttgtcaaactgaatgacactaactttgggccagggcttttttctcctctcctcacccaaatagtgggggattggctgaagaagggaagaagaaggagagacatttctgctatactggaatcctaggagtgtaaatactggcatcctaagagcacagagcggagaacaacatggcactcccaggtcacatgccccacacaggtcctgtgaggagggctgcttagcatgggggacactatgccacctaagtcctttgagtacctgagtataggtggcagcggcaatgacctctcactcaaagagcttgaaattccttgagggaagaaaacagttctttcgtaaatgggacactttatgacattgtgataccatctctttaattttcgtgataccttcatcatttgaaacataatttttttcatcatctttctactgcttgctactccccctccagcctataatgcaaatgtaaaaagtagtttgccactctttgaatatgccatattctctcatatctgctattttcacccttctcttgctaaaatgctttttctcgcctgcctgcctggcaaactcctgcttatctttcaggcatcagttcaagtcatgttaattcctcagggaggcatcttctgacctttgcaagtatgcttagggggccttcttcagtaagatttttccacgcctctattaattcatctcattgcttagtgaatgctcaatttatctgttttcctcctattttgtgagctctgtgtaggcagggattgtatcttagttgtctttggaagcttagaattttgcacagtacctgatgtgataaatagctttgggaggatataaaacccaaactgtataaaccccaaaccaccttgtaatcatataatttactttttgtgtagcatctgctatcacatgctggtagattaggcttccaaccagggggacggattaaccagcagtgggacattagtaactccctgtaggatgcacacatcaccaggattagcccttaacacatgctacaacctggccaaggggaagaagtttaactatctactactcctgtttctgctggatggctcgataccccaaagaacgctatgatgcaaaagtctgctcagcagcaggcagtatcctattaacctaagagggagtggcatttccagatgtagatgcccataaggtcttccttcttgtacagtctacctacctttttagtttttagttttacagattaagaagaaactacagaaccaggtagaaaccacacaatcaggtagatatagccatacaagacacagaactatgaagtttaagcttccattgattgaggaattagtctctaggatctgtgcaaggtttccaggaacatatattagttctgattttttaaaaaagagcattaagaagagagtggagactggttattaaacatggccacccttttgcaggcttattctcattgtaagtagatagtttacagctatgctagcattcttatgatttaactgaaatagcaacccgaacaataacccatgattctactattcactcttcataaatgtataatttccttactgccaggcttttctctttataaaagcaatttcacccaactttgcccaaatgcacatttgccacactccagagctatcataaatccggagaagcaaccttcttggagctctaatccaagctgatgctgaagcttcaaagtttacaaagttgttcccttgtcaatactaacccattctccatcttgatgactcaaactcccaatacatttatctgagggagaggacagtgatgtaggaaaagctggtacctttgaaacagcatctttcttggcatcactcctctcaaatgttgaatgtgagaatagtgttctcttcccaggcccaccctgagatggagtgggtggaaatccggtggctaggtattcagagaaacggttttgccaaaggcagctatgccccttaacacagattttagacaaaataaagaagtgacccaagagagtggaatttatgctggggaaatggctgtgatatgtgaaatttaatttcaaagggttcttccttgcagagacaaaggtagctaaaaggaccagtgtgggcccagcatgtacacacatgctgatctggcagaggccagagtagctgacttataaactagaagcttataggactccacaggaaaacaagcttatagactccataggaaaataaagacagtatgagatagccagccacctaagagcatggataatctccaagtatcaacaactgcctccatttctcccttgtcatgaccctcaaagtaatgtgagaattttagaaggatgcggcaaatcatttactttgtgatctttgggtttcagctaactccatatctctttctacaaagcctattttcccaaaaagagatcatggtctaaggtgaagcattccatgctccaatattccttacctgatgtattccaaaaggaagatgacaaaagggtttgtgttagatatggtccttcctaatttggacacttgaaaacagttcagataaaaaataaaacaaaaaataattataaaaatgttgtttacaaagctgctctggtaatatgtaaaatgttaatgaaagatatgggtttccagtggcagggtctggagaaggggtggcaggcaccagatccagccatcaaagtggcaagaagcagccctgaaatgagccaaggagatgggcgaggaggcgagggcttctaagcagaaacaaaaagaaaagacaaagaaactctggagctgaaagcaaaggctgtgggcaagggtcccctgcccaaaaggttgatttaagaaatctgtccacaagtaagttgttctttgcgtctgaggtgatggtgatccttgccttccgttcttacttaaacatctgtattccctgccataacatattttgccacctacagctaaaatgaagtgctgtcttggaatctgttgaacatttaaaaataaacttttgtaaaaaaacaaaaacaagcaaagaaaacaacaacaacaacaataaaaaagcaaaaaagatacagtatagttgaaatataaagtcctttaaataaagatctgggtggacaaaggaaggctagttttaaaaaagaataattctttcaatctcatatatggcattattataatattttgaaaaatttaaaataacaataaatcaaatgtattccttcccagtctccattccaaagcagttgatcatctcagtggtgcaagcgtgcataccatgaggggtcgccatctgattcagtactgcggatagtaaatcaaacgggaggcctctttgccagagaaacacaggtgtggaaaggcaactacagcagtgtgtaaagagtggaaggacatgtgttcgtggacaaacaccaaaaacaagaagttcaaaatgaatcctttcagatcctttcctctgaatacccatatgtcaataatacactgaaaacagacatgttgtcacaaacttctgtaaggaatgacattaggtataatctttctggaggtaatttagaaatatgttttcagaactgtaaacagttcctaccatgtgccccatgacacccctaggaatcttaagaaaataaaagagatatgtgcatgtgtgtgtgtgcagtgttattttataaatgaaaaactaaaaaagagtatgtctgaaagtgggggaaaagttaaattatgataaatctatttaacaaaaaatactacatgcatttaaaaatgaatatgtttataaatgatctagggacagaagaaacaaaaccataattacatatcatttcacagtcaccaaataccagattgatgaaaaccaaaaatgtttctaaaaaacttttaataagaaactgtttatgataacatacagagtgaaaagaataagacgccaaaactgtgttatactatgattccacatagatttaaacagtctcttcctgggagtgctgttagcaagacagcagaataggtagtcccagctcccatctccccaataaaaatattgagtaatcaatgatttatggaccaaaatacctactaagacaataccaaaatccagtgaagaggttgtagtaccccaggagagcacaaagccaagaaacccacgctgaaacaggtaagaagagtgatttcatcttacccacatcaacccctccctgaagctagcatgcctcagcaccagaagagaatgccctggcccctgacatctctgatgggggaaaggaaagaggtctttgctattctggcttttcagagggctgcctgggtaatggcttaatcttggttcaattggaatactgagggaactgcaatagtgtggatacctgggcactgctaagaacaaaggaaagtggtgggtggttcgctgcagtcagcacagcttgatgcaattgggagaaaaggtggtcaacctgaagcttctactttgggagggctgaagaaaggtagagtgtgtggccctcatttcagctcttcttggccccaagggactaatttctttctcacctcactcacagcactaacagaactagcatagcttggaagcctgaaggacacttagaacagagtagagagacaggtggcttgctgtggctggcacacttagtgtacttgatttctcccttgggagggagagagagaggagcagagtatgcatccagcattctggctttttggagggctatctgagggagtggtatctgactctcctgattcagggaactgatggcatacacttggtggctgcttagaacaggggacagctgggtagcttcctgctctaaaatcagataacttgcagtgttgcagacagacatcaaagggtgcaaggattatgggctcctgaaaaaggattcagagttccctaaaatctgttgcaaagatgactggtgaggggcttctgctgtagcaagccagtctctatactggaagaggtggctgattcttcaaatgtgcagatcccaatacagctacaagagacagaacaaacaggaaaacatggttcaatggaacaaaatgaatttccagaaattgaccgtaaagaaacaaaggtataagaattacctgcataaacactgtaaagatgctcaacaagctaaaaaaagatgaataaacaaaatgagaatatcaacaaagagaaaatatttaagggaactaaatagatattttcaagctgaagaatatagtaactgaaatgaaaaattcagatgagaggctcaagagcagaaaacaaagaagaaagaatgagcaaacttgaaaacgggccatttgaaattatccactcagagaacaaagataaataagaatgaaaaagagttaagagagccttatacacatcattatgcagaccaacacattatggaaatccaagaaagagcagaaagaagaaagagggcacaaagcttatttaccgaacacttctgaaatctgaggaaggaaacagacatccagattcgagaagcctaatgacaaccaggattaatggaaataaattacactgggaccaatgaccaaattataaaaagtcaaagaaaaacagaggactttgaaagtagcaaaagaaaagtgattggtctgtgtatttctcagcataaatgatccagggccagaagtgactgtgatgatatgttcaaggtgctcaaaaaaacaaacaaacaaacaaacaaacaaaaacacttgccacacaagcatattacatccagcaaaactaccctttaaaaatgaaagatatatagaccaatggaacagaacagagccctcagaaataacaccacccatctacaactatctgatctttgacaaacctgacaagaacaagaaatggggaaaggattccctatttaacaaatggtgctgggaaaactggctagccatatgtagaaagctgaaactggatcccttccttacaccttatacaaaaattaattcaagatggattaaagacttacatgttagacctaaaaccgtaacaaccctagaagaaaacctaggcaataccattcaggacataggcacgggcaaggacttcatgtctaaaacaccaaaagcaatggcaataaaagccaaaattgacaaatgggatctaattaaactaaagagcttctgcacagcaaaagaaactaccatcagagtgaacacgcaacctacagaatgggagaaaatttttccaatctactcatctgacaaagggctaatatccagagtctacaatgaactcaaacaaatttacaagaaataaacaaacaaccccatcaaagagtgggtgaaggatatgaacagacacttctcaaaagaagacatttatgcagccaacagacacatgaaaaaatgctcatcatcactggccatcacagaaatgcaaatcaaaaccacaatgagatatcatctcacaccagttagaacggcgatcgttaaaaagtcaggaaacaacaggtgctggagaggatgtggagaaataggaacacttttacactgttggtgggactgtaaactagttcaaccattgtggaagacagtgtggtgattcctcagggatctagaactagaaataccatttgacccagccatcccattactgggtatatacccaaaggattataaatcatgctgctataaagacacatgctcacgtacgtttattgcagcactactcacaatagcaaagacttggaacgaacccaaatgtccatcagtgatagactggattaagaaaatgtggcacatatacaccatggaacactatgcagccctaaaaaaggatgagttcatgtcctttgtagggacatggatgaagctggaaaccatcattctcagcaaactatcacaaggacaaaaaaccaaacaccgcatgctctcagtcataggtgggaattgaacaatgagaacacttggacacaggaaggggaacatcacacaccggggcctgttgtggggcggggggaggggggagggatagcattaagagacatacctaatgcaaatgacgagttaatgggtgcagcacaccaacatggcacatgtatacatatataacaaacctgcacgttgtgcatatgtaccctagaacttaaagtataataatatatattatatatatattatataatatatattattatatacatattatataatatatattattatatacatattatataatatatattattatatatattatataatatatattattatatatattatataatatatattattatatatattatataatatatattatatataataatatatattattatatataatatatattataatatataatatatattctatatattatataatatataaataatataatacattatatataatatattatataatatataaataatatacattatatataatatattatattatttatatattatattatatatatacaaaagaaagaaagataatattttcttaggtaaacgaaagttgagagagttcatcactgctggacttgccttacaagaaaggctaaagggagttcaacttgaaatgaaagaatgctaaacagaaacaagaaagtataaagctcaatagcaaaagtaaacagagacaggacttggtatccgtgggagatttgttctaggacccctgatggacaccaaaatccatggatgctcaagtcacttacataacatgacacagtatttgcatatatcatatgtatatccttctgtacacgttttacatcatctctagattactcatgatacctaataaaaggcctacacatcacttcattggcatagattcaacatagtactcagcatgtagaaaattcaagttttgttttttgaaactttgtggaactttttttttctgaatatttcaatctcaggttggttgaattcaaatgcagcaatcactgatatgcagtgctgagcatatgtaggaaaaatatacaatgctttaatgttgtaatagtggtgtgtaaatgacttttaactctggtatagaaattttaaaaaaagtattaaaatactttacctataaatatacattagtgggaacagaatacaaaaggatataatttgtgacggagtaaaagtatagttttggcatatgacctgaaatcattatcagcttaaaatagatcattataactgttttatgtaagccccatggtaagcaaacaaacaaacaaacaaaaaaaaccctaaaagatacccaaaagaaaatgagaataaagaaatgttattacaaaaaaaaaaaaaaaggaatactaataagagtgaagtaaaaaagtgacaagacagaaaataaatagcaaaatagcaagagtgtttctctatcgataattactttaaatatgaatggattaaactcccaatcacagctgggagtgtggttgaatgtattgagagagagagagacagagagacagagacagacggagggagggacagatgcagagagagagagaaaaaaaaacccaagtataagctgtctacaagagactcactttagatttaaagacacacacacctgaacatgaaataatggaaaaaatattgcatgcaattggtaacaaaaagagcagaggggtagccatacttatattatacaaaataagtaaaaaactgtcaagagagaaagaatgacatataataatgagtcaattcaccacacagttgtaaccattattagtacatatgcatctatcatcaaggcacgtaaatatatagagtaaacattgacaggactgaaggtagaaattaacaatagtaggagatttccactccccactctctataatgtacagaacttctagacagaagactaataaagaaacagagaacttcaaaaatgcaatacaccaaatatcctagcaaacatatacagaacattccactcaacagcatgagaatatatattcttctcaagtgcacatggaacattctctgggatagataaaattctaagttacaaaacaaatcttaccaaatttaagaagactgaaataataccaaatatattgtccaatcacaaagaaagggaagtagaaattaaaagcagaaggaaaatggagagttcacaaatatgtggaaattaagcaacatgatcctgaacaatcaatgggtcaaaaaaaaatcaaaaaggaaattggacaataatttgagaccaacaaaaatggacaaacaatatgccaaaacttgtggaaggaaacaaaagcagtaccaataggcaagtttatggtaataaacacttaacattagaaaagaagaaagatttaaataaacaacctgtttttacaccagataaagtaatgcaaagttagcacaggaaagaaacaataaagattagagcagaaataaacgaaatagagaaatgaaaatcaaagtcagcacaggaaagacacagtaaagattagagcagaaataaatgaaatagagaaatgaaaatctaatcaaagattagagcagaaataaaagaaatagagaaatgaaaaaataaaactaaaaatttcttttcaaaagatcaacaaaattgacaatcctttagctggactaagaaaaaaacagagaacactcaaataaataaaatcagaaatgaaacaggaggtattgcaattgatgccacataaactaaaaggattctaagaaactgttatgaacaattatacaccaacaaattgggaaacctagaagaaagggataaattactagaaacctacaatctaccaagatgaattacggagaggtagaaaatctgaatggatctgtaataataaggggattgaatctgtaatgaaaaccctcccaacaaaggaaagtttaggagcagatggcttcaccagtgaattctacctaacagttaaacaactaatgccaatcattctcaaactgttccaaaaaattgaagaggagggaacacttccaaactcattttatgaggccagcatgaccctgatatcaaaaccagaaaacagtactgcaagaaaactacttgccaacatccattatgagcataaatgcaaaaactctaaacataatgctggcaaactgaattcaacagtacattaaaaggatctacaactatctgatctttgacaaacctgagaaaaacaaacaatggggaaaggattccctgtttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattattgggtgcagcgcaccagcatggcacatgtatacatatgtaactaacctgcacaatgtgcacatgtaccctaaaacttagagtataataaaaaaaaaaaaaaaaaaaaaaaaaaaaggatcatatacaatgaccaagtgagatttatccttgggatgtaaaggtggttcaacatatgaaaatcagtcaaagtgataaaacgcattaacagatcaaatgataaaaattacacaaacatctcaatgatgcaggaaagcgatgatattaatatcctttcatgatttgaaaaaccctcaaaacagatacagtttcaaatgatcttatatgtagaaaacccaaagattccccaaaaacctattagaataaataaattcagcaaagttgcaggatacaaaatcaaccatcagttccatttctatatgctaacaatgaacaatctgaaaaggaaatgaataataccatttacaacagcatcaaaaactattaaaaaatacttaagaataaacatgatcaagaaggcaaaagacatatacactgaaaactataaaacactgctgaaagaaattaaagaagacacaaataaatgaaaagacattccatcttcagggattcaggattcaaagatttaacattattaaaatgtccatactgcccacagcgacctacatattcaataaaatccctgtgaatatcccagtggaattttttacagaaaaagaaaaaaaaattccaaaatttatatgtaatcataaaagactctgaatctctgaataagccataaatcatactgaaaaagaagaacaaagctgtaggcctcacattcctgatttcaaaacatattaccaagctacaacatcaaatcaatatggttctggcataaagacagacacatgcatagaccaacagaatggaacacagagctcagacaaattcaacacatatatggggggaagctggaacccttatgtactgttgttcaggtataaaatggtacattgctttggaaaaccatatggagtttcttcaaaaaactgaaaacagaaccatatgaccccacagtcccacttctgggtatttatccacaagaaatgaaattaggatcttgaagagatatttgcaccccatgttcattgcggcattactcacaaaaggtggaaacgacctaagtgtccactgaacgatgaataaagaatatgtgctacagtaggctccccttatctatccatgtgggatgtattctaagacccccagtggacgcctgaaattttgaatagtacgagaccctatatatagatgacccttaaagagaatgggcttgaactgtacagatccactaatatgcagactgttttccatcaaatgaggactaataatatggcacttgtggggcgtgaaacccgagtatgcagaagccaacttttcttatatgtggattcaacagggctgactgcaggacttgagtatgtggggactttggtatttaaggggcgtcctggagccaatctgttgtgtgcatggagggatgacggtatactatgttttctcctatacatacatacctaacataaaatttaatttataaattagtcacagtaagagattaaccataataactaataataaaatagaacaatgataacaatatgccaccatcactgttctctggggctagtaagtaaaataagggtcacttgaacacaaacactgcgatagctggacagctgatgtcatcacagagatgtctattaagtgattaaaggatgggcatatataggatggctatgctggacaaagggatgattcacagctggtcaggatgcagcaggattgagaaagatttcattacgctactgagaacagcatgcaacttaaaacttaaaatcgtttatttctggaattctccgctgaaaattttttaacatcagcaaacaaactgcagaaagtgaaaccacagataagggagactaccgtacatacatatactggacctcatgtaattatttcatcgagttttgtggattttttatctgctttacttttaccttttgcaagtaaagaactgttcccttcagtacagcataaaaggttttccatcctcgttttcctcttggagctagaaagggggaaaaaatgtaaaattttatttgacatcagcattttagaaagagaatctaaatgatcaacatggtgacagtgtttcaatattctacctagctaccgaaagtaataacaataagaactaaaattttctgagccttatggtgtaccaggcggcattctaaaatgttttccatatacgatcttaatatttacaatgctcctaccaggttggtgctatttctctcttcttacaaaactgaaacacaaggcaataacttgctaatggtcccacaactaggaagagtagaaggctgaaaaaccaggtagcatggctgacaacagactgggtaagcacaggaagcatactggaaatacatagcaatccaagagaaagcttaaagagctcatgtaccagagcctttatagcttcttcagagactctagaaatcacgaagtagtctcagaatatgaaaggaccacttttggcatttctcccatacccccctcaaccagagtgcaagtttaaatgttattactcctattgcaacctgtgcatatctctactgaggatcttgctgtaatgtactattttcgtctaaatgtctctttcactagactatgtatgacttgacaggaggtatccttcatctttagaattcaccaaatcgagtatactgcaagacagacattaaacacaatcatacaaattatccaaaataattaattatttcagaagtccttagatttcttctgtttatatttttctggatatgaattctctactgacttgtataaactcttacaaattgttctaaagcaaaaagcaatagattagcaaaacagtttaggatttattatcttaatacaattaaaatctataactggaaaatgttattgcttgaatatcatttttctaaacatgtctgctgaaatagacagggagagccatttactcatgctcttgtatcaaacatgtggctgtctgtggtctgtctttaacctggatacctgattacattagaaagtacattattgtcaaccaaatcctttaaatctcttttgactgaatactcaagaattcttagacttggaactaggtgaatagccacttacagaacacaggcaatcctgccaacaccatgctgagatatccacctggcaagaaaggattcaaaatatccaccctgcaggtttccaagggagataataaatatcatcccttctgcctccactaggtgaggcttaaaggtatactaaaaatacatataaccaaaaaaaagcataccattatttccgttataaagcaaaaaagcaactaagataaacagataaccatacatcacatataaaataaatattcactacattgttcaatagatgtgaaattctgatactgccaacatgagcactgcgcacacagaagagaccagggctgagagggctgctgcagagcagggcctcaggtggcacagtgtgcaggaggcacctgacttgaaagcagaccagctggtttccagccccttcacaatctcacctggtctgaaaactatcctcccacccaccagcccctaacaagtcactctactgctgtacttttgcttcattttaaaatgtgggtaattcctagaactgaaggcaaagcattggctaatgctggaatggaacctggagaaaatatttttgtttttaacagaagagccataggtcctgaagtacaaaggctttccccgagccctaaaactaatttattggcatcttgcgatccctttagttcaaaaatctacacatctacgtttctactttcgcagtagatcaattaatccaagtacatgtttacaaaattttaaacagctctttctcattactacactaagcctactacaaagagattccaaagagctctccaagcgaaatgtgattttaaaagtcacccatgagtgactaatgcccactaagtcagttacttagtaactgacttacttattgtactcacttactgcagtctacttttctatttcccacagaagtataaaacttaaccttatctttggccagttacaatttagtaatctaacacatggatgaaacaacctataatcctcccaaaaagataactagggagcaattattcaacggtatttagttggtgtgctataaaagcactgctctaagtgctctgacacttattaatccatttaactcacaccgtaatgctaagagtaaggtactattgatacttccatcttacgtgagacagatgggtgcaatcaagcagaattcaggggaagaagggactactgtgcactaaagtgggctgggaaggctctctagagcaggtgcaactgctctgatttgacaaccacacatacagtgccgctgttgccactggacccttggtgaggctcttcaagcaaaacacaatgagctggatgctaatgaatgacaagcactggtcctcatcatgaggactgtagaaggagttaaagtgatttcacagcacgtgtgttttattaaacacacagaggtccgtaaagagttgtaacttcacataatgaacttgatgagaggaagagtgaaaagattactgacaggaaacctaatgcagcaactgacaggctttaactacaagggctgtggggaatcaataggctgacatcctttaatatccaggtatcttccgtgagaaagtgtttactgagtttgattaaaagacaccattttacatgtgagcccatcttttcactgcagtttttactgtgcatacttaaggtccaaagacaatcaattgctttccttcttgaaaatacaagaagcttttagggttttgattccaacaatctgcctctaaccttactttggcttttcttttttttaatgctattgaaacaggcatcattgtttttctataacatgctactgtcagtttaatgtttacttttatctttattgatcacttctttctgtacctcagattgctttttggaggccattttcaattacttcttgaagtctatcctttagaagttcctttagtgaggagggtcttttggtggccaatcttctatttttgtttgtataataaatgtccttatttcattaaaaattccaagttgataactgctttttcttatgaagacattatttcactatcttttggctaacaccattgttgcaatgttgatagtgtttagatctgtgtgcccacccaaatctcatgttcagctacaatccccagtgttggaggtgtagcctggtgggaggtgattgggtcatgtgggtggtttctcatgaatggtttagcaccatccgcttctcgtgacactgagtaagtgaatgctcgtgagatctggttgtttaaaagtgtgtagcacctcgcccagtttgcttgctccttctctggccatttgaagccctgttcccccttcactttcagctatgactgtaagtttcctgaggccttcccagaagctgaacagatgccaacatcatgcttcctgtacagcctgcagacccgtgagccaattaaacctcttttcttataaattacccagtctcaggttttctttatagcagtatgaaaatggaccaatacagaaaattggtactgtcaagtggggcattgcttataaagatacctgaaaatgtgaaagctacttttgaactggataaaaatcagaggttggaagagggtggagggctcagaataatacaggaagatgactgaaagtttggaaattcccagagactggatgaatggttatgaccaaaatgctggcagtgatatggacagcaaaggcaaggctaacaaggacacagatggaaatgaggaacttactgggaactggagtacaagtcacttttgttatgccttaccaaagaacatggcttgcactgtgcctttgccctagggatctgtgtaactttgaacttgagagtgatgatttagggtatctggcagaagaaatttctaagcaggaaaagtgctcaagatgtggtctggctgtttctaacatcctatgctcatatgtgtgagcaaagaaatgacctaaaactggaagttaaatttaaaagagaagccgagcataaatgtttgaaaaatttgcagcctggccacgtgatagaaaaaaaaaaggcctattttcagaagaggaattcaaacagactgcagaaatttgcataaattaaaaagaagccaagtgctattagccaagacaatggggacacggccttgaaggtatttcagagaccttcacagcagcccctctcgaggcctaggagggaagaatggtttcatgggccagagccagggcactgctgccctgtgaagcctcgggacactgctccttgcatcccagcttctccaggttcagccatggctcaaaggggcctgggtacagcttgggctgctgctacagagcatgttggccacaaactttagtggcttccatgtggttttaagcctgtggctacaaagaggacaagaactgaggcctgggagtctccacctagatttcacaggatatatgaaaagtctggatgtacaggcagaagcctgctgcagtggtggagccctcatggagaattccctactagggcagtgtggagggctaatgcagggttaaagccctcacacagagttccaactggggtgctacctagtggagctgtgagaaaagggccattgtcctccagacctcagaatggtagagccactgacagcttgcaccatatatgcctggaaaaaccgaaggcagtcaatgccatcccatgagcgcagctgcaggggctgaaccctgcaaagccacagagacagagctgtccaatgctgtgggagcctacccctcataccagtgtgccctggatgttagacatggagccaaataacaattttttggatctttaaaatttaatgactggccttctgggtttcagacttctatggagcctgtagccccttttttttggtccatatattccttttggaatgggaatattttcccaatccctgtatccccattgtatcttgggagtaactaacttgtttttgattttacaggttcataggtagaaggaactagctttgtctcagatgacacttcagactttggatttctgagttaatggtggaatgagttaagactttggggaacgttgggaaggcatgattgtattttgccatgtgagaaggacatgatatttgggaggggcctggggcggaatgatatggtttagatctgtgtccccacccaaatctcatgctaaattgtaattcccagtgttggaggtggggcctggtgggaggtaattggatcatgattcatcaatggtttagcactacctccttggtgctgttctcatgatagtgaatgagtgctcatgagatctggttgtttaaaagtgtggagcaccccccttctctttctcctgtggccatgtgaagtggtgctccccctttaccttccaccataattctaagtttcctgaggccttcccagacactgagcagatgccagcatcatgtttcctgtatagcctgtggatctgtgagccaattaaactactttataaattatccagtctcgggtatttcttcagatgagtgtgagaatggactactacagatttctaccctgagtctaaatgctatgtctaagcacaggtttctttaatttacacagactgctgttctttgagcttcctgtgtattattttgaaaaacctgtagacattataactttgaataatgtctctcctctatcatcttcatgattgtaacctgacactccattctaacttctcacttcattccacttgtgacttattcactctttcatattctccatctctctgtacttgtgtgctaaatgctgtgtaattttatcttcagtactggtaggccacctagatccaaaaatgtcctgaaggcttagcatccccagggttggccacctccccacatttgtactcatgctttattcctggcctaacaggatttccctttcattgttacaggcttatccattcagataaaagttatctaaaaatatttcatctatcagttttagatgttttattatgggagagtttcagaatctgtaggccatcacattgcaaaaaatagattctctattgcatttttctttccttctttttataagaagggaagaatttatgcacaaactttgttatctaggaagaattcatttggagcaggatgcaggagatattgcagagtgagaacaaggagagaaactggaacaaggggaaccagtaaggaaattattacagtaggtgagataagagaaaaaggccagaacatgaatagaggcatacgatacattaagataaaatggaaggaaagggaaaggcattaacattaactaagcacctacactgcagcactctgagtgttgggctaacgttatacctatacgttctatgtgttccaaacaatcttttcaggtaggtattattgtctctgttttatattttatgcccccattattaactatatttacaattctgaaaggtagagtatgcccccaaggaagctacccatctaaggatttcaaagctactgtacaggacaattaagtaaatattttctaaagatacattaagaaatagaaaatatccaggtgacaattctttgcagtggtcggtctgctactcctgtgaggtgggcactgaaggcaggaagagagatgatgagataagagggaaatataaccaggtactttctctaatctcactcaactataggaccttcaaaggcatccctgctcatgactacagatctcagaacagaggcacagtctctgtgcctgccccctcaggtgctcccagctccacatttctgcagaatagttatctaatattactaataattacagaagtagtaatagcacagcaaatgattgctgaacacatactgttttaggcactgttccaagatttgacctgtataaacaaaagcccgtaagtctatgagggatccacggttataacctccatctcacagatgtggaacctatgaccaccttcctctcacctcctatgaaccggcagcacttgtttctccatagcactgggcgttttcactctggtttccatacagagaaaggccagctaaactagattcgggaggcaatgtcttggataaatctgggatctaggagtgatattaaaattacttaagagctgaggctgggcacggtggctcacgcctgtaatcccagcatataacaagactccactgctacaaaaaaaaaaaacaaaacaaaaaaaaaaaggaagtcaggtgtattagtacattctcacattgctaataaagatgtacctatgactgggtaatttataaagggaagaggtttaactgactcacagttcagcatggctggggatgcctcaggaaatgtacaatcacggcagaaggggaaatgattatgtccttcttcacatagcagcagcaaggagaagtgccgagcaaaaaggggaaaagccccttataaagccatcagatctcaggagaactcactcattatcatgagaacagcatgagagtaatggcccccaacaattaaattacctcccaccaggtgggaactacaattcaggatgagatttgggtggggacacagccaaaccatatcaccaggcatgctgatgcatgcctatattcccagctacttgggaggctgaagtaggaggactgtttcagtccaggaggttgaggctgcagtgagccatgatcgtgccactggattctatcctgggtgacaaagtgagatcctgtctcaaaaaaaaaattatttaagagttgattcaggagctaccttgagctgttgggaaaagcactgttccagtcagattgaagggacatccacagtaaatggtctgtaccagtacacagtctctgagtatcagctctggcttgggggctgcttcctgaccagtatgggtgaaattaagaagtgaatgaaaccaacaagctgctgtgatcgttattctgagtcaaactcacatacacatgaagaccacatttctgcaatagaaaaattggcagttcctccaaagatgggtgatattggagccatcactgaatcttaaatattacaaaccagttattattttctctttattactaatttgaagaaacatatttggaaatataaagtacagtgaataatattttggctttagttattaccactgatttttgtaaaagtgaaatgcttaacggggaatgaaaagacagtatcacccctctttcataaagaggaagatataaaatatttctaaacaataaaatattcattaacgagtaataatggatttatgccagaaaagtttttttttaatccaccaaaaggtataagcttcatgcagaagtttatatttgcatgctatactctccaacttttcttctcaactgaactggaaatggattgtgtttaagattttactgttccaattttctatttcattcaaatggcagagcatttgttcctacatcaaaatcttgtcctgttttttgaccactcatctctctgggtgccctgatcatcttttttttccttttcctcatgtttactatcagaaagtcataatatggatagaaagtcataatatggatagaaagacatagtatgagcattgcctattgttttcatttaacatattaatctttacttcctgtctgttgtcttgaaaatattctcccattgttccatgtaaaatgacaaaaaaaccattttattcccctcagagtagagagagagaattagccatatacacattaatgagaagtaatttatttttcagggcctcaccaagagtcttggcgtgaaggccgacaatgcaaatcctgccaggccaagaaacaggtatgtggggatgaggtagttctaatgcaaaatatcttgaatttcctgaggttaacggagaaagatattcacaatataaagcaatcccaatgatggcattccaaaataaacccagcactttaatgaacttgaaaacaaagatatacttagcagaagttctgtactaatataagtgagacatcatctatactagctgtaaaaagcacaaggcatttttaagactgttctattttctcagtgatagaactaaacaacttaaagtatctttaaaacaaaatccttaaagtatgtagcctaaagcatgaagaaacaggctaccttgataagaagggagttctgaagttctaatcaatgacacagttgaagatacaactcacgcagggaggagtctgctttctgcaattgatgtgcaaagaatttaaataagttcatagatgacagactcacagatgattaagtgaagttaagggtaatcctgtatattaacctctaactttcttttacaaaatatcctcaggcatcacaagatattctattacatcttaattaatagagcagctcaggcacttttagattactgcttgaagcaatcaagtccaagctgagcaaaggaaaatttaccactgggctatgagtcacacagtattccagtattcagcaagtgacagtattaattatccctggtttatagcagcgtggtagcactaaaacagtactattactactatatattcctaatcacttatctttgaaacacttaaggcaatttacacattacaaaaaaaatcacttaatccttatagtctttctcttttataaaaggatgctttgtcaactctattttataaaggaaaaaagtagggcagccttgtaggaactgttaaagcaaactaaatatggccttaggactctatacttctttatttgagtccttgtggatgaactgcaacctaacttaataggtagacaagattgaaaacctaacttaggagtatgcacctgtaacaatacctgagtcttggccaatcccagtggttgtacttcaaccactcatacactgctgagtgttcgaactgtattcaaataaggtacgtgctgagctgtaaccaacccagttgtttctgtacctcactgctgatttctgtatgtcacttccctttgtttgtctataaatttgttctgaccacgaggcatccttggaatctctctgaatctgctgtgattctgggggctgcctgatttcagaatcattcattgctcaattaaactcctttaaatttaattgggctgaagcttttcttttaacagaacctatacctattgcttttcccagaaaattatttccttttcttatataatagcaaccaatgcatattttgatagagaataagaaatgaaaacaaagagagaattggaagaatattctattcaaagtgttccctagtggggtgctgttcattctggatgtggctctattcctataagaggtctcaagacttttaccctaaaatgttctgaaatgccagaaagtatcataaactgggagctaggcacttagattttattcacaccatgatgcccactatttctccgcttttggacaagtaatctaaacatctctggttaaaaatctatacaatgaatctactacgatgtgccataattactttataatgttgttgagttaatctgggtacataagattattaggacacataccctacccctaaataatttacatatacaggcagtaacataaacaatgaaagttaatttaacatgataaactgtataaactaaatggtagcatggcactaacctaagacaatcacagtggggattccaggaggtaaaacaaggaggaggtcattaattctgcttatgaataggatttagaggttagagaacactttaaatgagggtgtaatttaatgtaggattttggaaaaaaaaaaaaaaaaaggtttttcttttaaccttcaccttttgtacagtatgttagcaggaagacatggaatcaaaatgtggatcccaattttggaagtctcaaaacattgcaaatgatcatcatcctttagcaagacagcctaagaacaacagttaaaacacataattttttattttttaagaggacacattttagaaccagagaacctggtttgagatactggcttcacctgagtgaccttggacaagtcacttagccagtcctatgctttactttcttcctgtataaaacagtttttctgagacttagatgagttaatatatgcaatcctttggattttttttttaattaaagatactgtctgctaaagaaaatgcatcaaattttcatgctaaaacacaaagaaagactttttttctcacttctgtgaaaataagctgtgaaaataagcaatttaaatctaagttgctggaactttattagagccttaagggaatgtgattaagggacctggatggatcacattaacaggcagctgtaacctaggaagctgtaagctttgcttctctgattgtttgtctgattatagattagcctttttccttatctacactgttttgtaaaatgttgcaaatgactaaaaggcagcagggaagaccccttcttgcttaactgttgatcttcattacagattaatttccctcttacctttctcacacaaagacttgatgatgactatcacattgtctaaggtggaatgttaaatgaactcttttaaattgtgaagtaaatgataacaagctgtaaagaagaaaaacaagctgtacggaaaagaaaaataactaaattattataacccacaaagcagccttacataaaaaaaagttacaatcctactaaatttctttgtttctgcccatatataagcaagaccttaagtttttacttcagagcactggcctcatttctctggagtccatgtttcccagattcttgcttgaataaactctaaaattggattctgatgctttcagttacttcaggttgacatttcattcatgtattcggaattttttttgtaagtcaatgtttgagaacaccgctttaacgttactgatgcatttttttttttcttttgagacggagtcttgctctgttgccagactggagagcagcggcgtgatctcggctcactgcaacctccacctcctgggttcaagccattcccctgcctcagcttccccaatagctgggactacaggcgcccgccacccgcctggataatgttgttgtattttagtagagatgggtttcactatgttggccaggatggtcttgatctcctgacctcgtgatccgcctgcctcggcctcccaaagtgctgggattacaggcatgagccaccgcacacggcctactgatgcatttttaacagaaacacttagcacataccacccttaactgggaagagagctaagtgtgacacatttactccgattaatatatttattgttttcattttgtcccaagtcctgtattgacattggagatatcaaacatgaatgcaaacaataaaagtagacaatagaagagacaaaagctgttggagaactttctacccaaaagatgagccacagagtcgctcagatctaacttaaaaacaagtatctttccccacttggccaggagacggtttcactggcagccattactagacgtgcaggaagaatttacatggcttgggctgaggttggaaaacaggtcagaacacaagagcatgcatcattagctaagggttaccggaaacgtgtgtgggaagcaacaaatcccaaaatgactctcactacatcatttttttcaggaaaaatataaacaccagtgatagagacaggaggcagccaaggacccctcctgcccccaacacctgacgaaatgccgccttcaagcctaaaacagcatgagggatgaaaaaccagactgccggtccggatgaagcccacccttttccccaaatgattctttctgaataacgcccatctgcacattgggaggagggggtggggccttgggaagtttgcactgtttgcaggggggaggagcctggtctctctcgtttctgtgtggtaaggtgggatttaatccctgagatggagagcctgttagcaggactcttatctcactttgctgatgcgtatttcctttttcatttctgcctaataaattccacttgtcacccttctacgtgtctgcgagcctaatctttcctggtcgtgtgacaagaaccccgttttttttcctgcaacgctagagtcacagaattattttttgaatcttaatgaatgatacctcacattctctatggctagaatgttcctctcccagataccatgacttggccccttcacttcagttaggtctctgctcaaatgttatctgtgaaacatagaaaacggcatcactacagttcagggctctaaagcagaatccattctcagggctgcctgcaccactggcaaccttgcaaaacaacccagtaccttgccttgaatctttgaagtgcacctaaccaccacaaccatgatatcctgaaaaacagctgaatttcaccagcgctgcaactcctaaacagcaacaataaatgaactatggacttgtgctaagccggccgcctccacccatgataattccttcaaaacaacttgtgtaatcctttagtttcctttgaaaaaccctcacttggtttggaacacaatttggcttacagccaaatctgtgtctcctgaattataattcctaagggcccaataaatgtcttgtcttactgcattgcggtctggtttgtcatctcttcttagttgacatgcctcatcctggggtttcctctaatcactctctgcaacataggacgtgtatgcttccttcagtatttcctaaccttgactttacttttctttgggtcagttaacagctgtgtaacttatcacaaagtttttattaagcttctccagcattagaataaaaccttgaaggcaagtacgttggtttgttgctgcaaccacagagcagattaaccccttctcccccatcccccccccaaaaaaatcagatgtcctaaactagcatgtagatggcatcattcaacaaatattaccgggaatttttttttttttagtgcttaatcttttaggtaaaacgcaggatgcttaaagagaaaagaggaggtagaataaaactgtggtcgattattccaataagacattgaatatgggaataaggtatcagtaaacacccaggcttaaaaggaacaaataaggcttaatacattactgtgggttttcatgggttaattaaagaatgaacatttgtgacaagtgacttcaaacttctatcaaacaaatgacatttcatatacatatttttttcttttgagacagggtgattacagctcactgcagcctccaattgccaggctcaagcaatcctcccacctcagcttcctgagaagctgggactacaggtgtgcaccatcatgcctggctaattttttttttgttttgttttcatagacacggggtcttgcaatgttgccccggctggtctcgaactgctgggcttaagcgatcctcctgcctcagcctccctaagtgttgaaattacaggtgtgaaccactgcacaggcctcataattctataaagtatatctgactgaaggaatatgctggagaacttgctgtttttaataatcacttcaaaaagttaggcataacaaaaatttcctgaaattcaatgttagatatgaattctaaatttcttttcaaagaatatgtcaatatgttcaattctttgccgtctacttttaaacttaacttcctcgtaaagcaacctttttcgattacctactccaccctgactcattccaattacctactccaccctgactcattctgatcacctgctgcaccctacattccaatcacctgctccaccctaactcattccaattacccccaacctgctctgccctgactcctgccaaagcactcacccagtgactctctttaaattagtcaatcggaattagtttagcctgtgcggtctaaccctagccaataagggaatgacacagcagcaagggccacgggcatcagggataagaaccccttcccctcccttgtccaagtatgcgctcaccattgttccatctgtaagggcgcacccttctatatagaagtaacgtgtcttgctgagaattaaaaagaaaattttatatttgagtgatattttcttttgcagcactgaaactttatatataacatttgataagttcgtttatgtgaaaggtgtgaacattgatcaagaaaatcaagcatactatgatttttttcataatatctagagcagtttctagacctttttacataccttttaagagcagggtgttaaaataaatgtaaggttaaatcatcgcagtctatctgagaagggcaggtaactgctgaatcagacaagtgggcttgtcaagtgacagcaaatcaggtttcctcaacctctgaagcaccccagaagccagggaaggacagagcgaagaccctgctgtgcacgcatttctacaactagcaattcaaataagctattgtaattgtaaaacagcccaaggcccacgggcatctttaaaatgcctccgggcaaaaacagctgaaggtcaataaaaataactcaaagtggctgatgagcagcctccagacagaatctgttctccaaggaatataacagcctcacttgcttttccccaacctaggagctccaaaagtgacttcaagctttgcctactgataggtgttcctggccctcattacagggcgagggctctggcttaccactcacgcgcaggagccagaaaacggtctgctacagactgcacctgaggtgatgctgctccacgatggcctcttagcttttcccaactcagaccacgtttcttccatttatcagatgtccagtgcgttcaagtgctcttcactgaggaaaaccaaaatacccgaccctacaatacatttctttgacatatttttgagatggcctttcagaggccctgcaaacagaagtagctctgcaaagctatcttttgtgggggagatttgcatctgtggagagaatctgtattgatggtggccaggcattctccgaggccttccctcgtctggatctaggaaagattaactcagtgtctgacatctttaagggtctgaaagaaacattcaccatctattctcgctctcatcatgcctaggttttaccacctacttgtgagatttcatttacttaacaggaacacctttgctagccaggcctcatcttcctctcttttcttttctttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccaccacgcccggctcattttttgtatttttagtagagacggggtttcaccgttttagccgggatggtctcgatctcgtgacctcgtgatccgcccgcctcggcctcccaaagtgctgggattacaggcgtgagccaccgcgcccggccatcttcctctcttttcataacctgttttgatccaagcccccattctttctgtaacttcaattataaggtaaaagtttctctactccattgagggtcgtgtaatcaatctatgattttcccctgtgtgcatgttaataaatttgtacaccttttctctcattcacctggctttggtgagttgatttttcagtgaaccttcagagggtgatggggaagtttttttcctggatgacccctacagtatagaaccttctaatcattttactatgtacacacatgcaaaacaaactgagatattatatttgttaattttaaacttttctactggccgggcatggtcgctcatacctgtaatcccaccattttgggaggctgaggtgggtgaatcacctgaggtaaggggttcgagaccaacctgaccaacatggtgaaaccccatctctactaaaaattccaaaattagctggtcgtgatggtgggtgcctataatcccagctactcgggaggctgaggaaggtgaatcgcttgaacttgggaggcgcaggtagcagtgagccgagattgcaccattgcactccagcctgggtgacaagagcgaaactccatctcaaaaacaaacaaacaaaactcttatatttatatatcatacattgtaagcccataataaaattctaagctcccaactgcctgaatgaaccctactcttggtgaaggggattccaaaggaacttgaaaaaccagtttaggacatgacagaaagggggtgttggacatgcctcattatgccctcctccctttggagtttaggcacaactgaccagcactaacactaaaatggagatcccgacactgacaaaacagactcttagtagcactaagataccaatttcaacctgactctaatatagcatcacatgatggatagcaggtcctaagggaaatcaaagtattgtaccccaaaatgcattttctttgacatattttgaaatgatctgcaaagccgtctctagtgggggaaatctgcattctatagagaatctccctcccttgctaaatcttttctggagagtctagtatcttttaaggtccagtaagagacatttgacatctattccctctgaagtctattatttagagacttcatctatataacaagaaccttggcttccaccccaccaccccctcaacttaactcaaatatttatttatgctgactataactcttcagataaagcttaagtctttcaagcaattgacaatcaggaaatctttcaatccgtctatgacctggaagcccctgcttccaggtgtcctgcccttctgggctaaatcaatcaatgcatgccttatatgtgttgatttatgtctttgcctataactttggtctcccaaaaatgtatacagacaggttataacccaaccaccttgggcacatgttctcaggtcatcctgaggctacgtcatgggccatggtcacttgtatctggctcagaataagcctcttcaaatattttacagactttggcttttttttgtcaacaatatcatttttaaaaatgatggcaaatgatgaaattctattgctgtatctatcatattttacttattaaacattttattggccattaaactgtttctaaaatgatgttattttgtaactaaaataacaactggattccttctatgtaccaggcagtgtactacacaccataacaggtattagccgtatttgattgctctcaccttaaggtttttgcattttttttttctaatgggatattcttttcttttctatttttgtaagacggagtgcagtggtgtaatcatggctcactgcagacttaacatcctgggctcaagcaatcctcccaccttagccccctgactagctgggtctaggggcgtatgctaccatgtttggctaactttttattcttttattttgtagagatggggtcttaatatgttgctcaggctgtggtggaatacgcttatccatgacctttgtgtccaaagatatcacggaacttccttttgtaattcagttctcagccgagtaacaaggcatatcctctatctctactcctcctcaccaagagtattactggcatactgcttgagctcaaagtgttttttaaaaaataaatcaatgatctatcttgcttcaaagctcaaattcttaggtctatctagtgtaaacaaataaaaaatcctaagccctccaaccaactgcatggaccccctcttgaccaaaagaaacctaaaaaactgaatgcctgccacgatgggatggaagttcagatgcacctccttatatccacttccttttcaagttcaggcccgactgaccagcattacggttaaaatgcagatcaaaagactgatcaaaacagactctgtgtggcaataagataccagattataaacaagacctaaggccactggggtatgctggctcatgcctgtaatcccagcattttgggaggccgaggcaagtgcatcatctgagataaggagtttgagaccagcctgaccaacaaggtctgacccacctctactaaaaatacaaaattagccgggtgtggtggtgcgtgcctgtaatcccagctacttgggaggctgaggcaggagaacggtttgaacccgggaggcagaggttgtagtgagctgagatcacgccactgcactccagcctgggcaacaagagtgaaacctcatctcaaaaaaaaaaaaaagacctaaggccgtgtggccatgtgaggcaaaggtgaagtcacaccctaaccataaaatttcactaaatggatttttattaacctggtataacgtggcttactccccaacctgactctggtatagcatcacatgacagcagaccctgaaagcaatcacaatattttaccccaaaataaatttctttgaactattttgaaatgaccctccaaagccgtcctttgtgggggaaattaacatctttggagaatcgccattgatgcagccaggccttccctttctaggcctttcccagatgtaggagagattagctaagagcccaacacctcaaaagtctgaaaagagacatttatagtctgtttctctgagggctgccacccatgaggctgcttctacgtgataagggccgtggctcccagagcctccttaactcaagcattcctgtctactcttcaagtcctcagacaacagcttaactctctcaaccaataactcaaccatccctaaaacccacctatgacttgtaagcccccatttcaagatgctcaccttttggggctgaaccaatggatacctttcatgtactgatttatgtctttgcctgtaactcatctccataaaatgtataaaaccaaactgtaacctgactgtctcgggactacttactgaagggttcttgggtttgtgttttttttttttttttttccccaggctgtggtcactcacattggctcagaataaacctctttaagatattttatggagtttggagggccaggcatggtggcttacacctgtaatcccagcactttgggaggccaagcctggtggatcacttgagcccagtagtttgaggccagcctgggcaacatggtgcaaccctatctctataaaaaataaaaaattagtggggtgtgacagcacattcctgtggtcccagctattcaataggctgaggtaggggggactgcttgagcctgggaggcagaggttgcagtgagcccagatcacaccactgcactatggcctgggtgagtgagcaaggacctgtctcaacaaaagaaaaaaagagaaaacattttgcagagtttgatatttccattaacattagtgataacatcttttgcatatacattcttatccccatgattaattcctttaggaaactagtacggtatttttaatttcaaattttcatcagattattaaagaatttgacacactgcattaaattaccacaacagggatggaagaattattttcttctttctcctaaatgttaattaaaccgaaatcataaacagaacgagtcagcagtgaaaatagaataacctctaaaaatcacatgcacagtgaaaactgaacattcctctttcagaaaaatacttcagagattctgaacacagattttttggtgctataagattggcagtttatattccattgttcctagtcaagagtattgcttccagccaggcacggtggctcacgcctgcaatcccagcacttcgggaggctgagaagggcagattacctgaggtcaggaatttgagaccagcctggccaacacagcaaaaccgcttctctactaaaaacacaaaaattagcccggcatggtggcacacacctgtagtccctgttactcaggaggccacagtaggagaattgcttgaaccagggagacagaggttgcagtgagctgacatcgtgccactgcactccagcctgggcaacagagtgagacaccgtctcagaaaaaagactattgctcctgatgagaatgatggcggaggacctctttcaaccgactttattgccagaaagcatggattttaaagacatgagccatcattacggaatgtaaaaacctagaacttaatcttttagtctaaattttgaattgtgaatggggtatttcctatctaaaacagccaatattccattaaaactagagagtcacgtgacaaggtgctcctgcgcgttcacatggctgccctcacagtgctgttgtttggccttgtattaacatcttaaactgctccgttacacaccctgctgccagagaacagccaagtgccaagggaagggaaaaccttagcctagttttaaaataattgcttggctttgcctgtacttaaagagtcttgctctaacaggaggacacaactgtcttttgggaaaaaaaattccacttttattatctcttaattatagtgtcgctgttcccaatgttacacgatagcaaagaattctgcctgcattaccattataaactattttcagtatggatgactcagaataaattctactttcttaaatttgacatgtgggactaaattttctaaacttttgatgacaggcaggtgtgtaaatccctctaaagtgagtgaacctctccaaccttgtcaaggtgctccacaccactccttgtatccacagtatttacaatgagattgaaaagctgaaccacacatagttctcacctccttaaaaagcgatgaatattttaatatttcaaattcagaactaatctcaggactgtacaatgactaaagaatctataaaagaatgtgattaaaatattttaaaattattaaagtgatatgtccacacaattagcctcctttgattcatttcttcccacctcctctgttcccattttacaaaaaaaccttttgaaacaaattacttctccgagtcgttaagtgacattatatccctaaacaatgtgcttctaccactgtgtcataataggctgtaaacacactctcagttttgtgctgtgctagatgagaatttaacaaacttaactatgccattccatcttcccaatatacttacatagcttttatttgtatctgtattgattacctctgtagttttatggagcataacattattattattttagtgaaaaattttttccccagctttagtaaggtgttattgaccaataaaaattgtacataagtgtacaatttgatgtttttacatatgaatggtgaaataattaccacaaggaagctaactgacatacttttcacctcacatagttgccactttcttatgtattaatttgacaaataatgactgacattatttcttctttctccagtacaggcagcatcttctgacttcctctctgtaagaggagcttaacggatctctctccctgctccctcttagttctatccagttttacctcccaccttctatcatctgtactcttacaggttcaagttgcacaatatttatattttaatgtgtaccacaattaaatctttcacatatctaaatgtgagtaaccaaaattctattactatggtaagattttaaattattaattatgctataatgatggcgatcacaaagtcattttttcttttcaattttcattcaaaaaatctttttgtagagacagctataaccatatggtccaggctggtcttgaactcctagattcaaacggtcctcctgccttggccttccaaaatgctgggattacaggcgtgagccactgtgtctggtcaccgttttctgtcgctacggatttttgtttactgagttttctaattgtaattttcctgtgcagattttaagaaaaacatccttatatgtttctaaattttccatgcaatcagatgttctattgagttttaaaaattttatttataggccaggagcagtggcttatgcctgtaatcccagcgctctgggaagccaaggcaggaggactgcttgaggccaagagttcaagaccagtctgggcaatatagtcagcccccgtctccccaaaaaaaaaaaaaaaaaaaaaagaaaaaggaaaaaaaaaaaattagctgggcatggtggtatatgcctgtagtcccagctatctgggtggctgaggtgggaagactacctgagcccagaagtctgaggctgcagtgagctacaattgcatgtaccactgtactccagcctgggttactgagcgagactccatctcagaaaaaaaaaaaaaaaattgtaaaacatataagacttcaaaaggttatcaagagtaataaagtaggtatacatgtactaccgccaaatgtaaaaaatatatattatcaatatagtgaaaccactgggtacttgtcagtgactgcctgttattctcctttccagaagtaacaaccattctatgtttaataatttcaatatatgaatgtattcttactaaaaatagtattgttttgcatgctttcaaatgttatcttacgtgcagattcttctgcaagccgctttttttcattcaacattaccactggtgagattcctccatgttgatacgtggaactctagctccttccttttcaattatatggatatacaaaatccattcaatctcttattaatggacatttaagtttttaaattttgagctattataatgttgctataaacatgacttctgtaacactaagagtttttataggtgtatacacccttatgactaattaactgagatataagaataaacatttccaactttattattgccaactgctttctgaagtacaaatgataccactaatacttttgcagggtagaagagggcccattgctccaaatccttaccaacacttggtattcttttaatttttgtcaaggtaacatgtgaaatgacatttcactatatgtttaatgaatatccttgaatatcaataaggttgaatatgtcttcatatatgtattgatcatctcagtttcattttctgagcatggcctcttcaagtttttgcccatttttctactgagttgtattttttataagtaatttaaaatttctcgggaattgaacaatgagaacacatggacacaggaaggggaacatcacactctggggactgttgtggggtggggggaggggggagggatagcattaggagatatacctaatgctaaatgacgagttaatgggtgcagcacaccagcatggcacatgtatacatatgtaactaacctgcacattgtgcacatgtaccctaaaacttaaagtattaaaaaaaaaagaataaaagaaaaaataatgaaaaaaaaaatttctttataaatattaccatggatcctaatcctttattggtaatatgctacaagtatcttaatctgtgaattatctttcatttttaagtacaattttaatataaagtctttacttttagtgtaattatacatatcaatttttttttactgtttttgtaaatatgtatgtatatacgtatgcctgtttatatgtagagatgatgtcttgctatgttgcccaggctggtcttgaattcctgggctcaagtgatcctcctgtcttggattcccaaagtattgggattacaggtgtgagccactgtacccagctgcttttataaatcttaagaattcactttctacccaaaagtcatgaagttactgtcccacatgttcttctaaaaatcttagaaccttgtttctcaaatttttatctttaatctacgtgaaactggtttttgtgttagaactgaggtggggaatacacacacacacacacacacacacacacacacttctcaacataaattacggaagaatttttgcttctaattatctgacttactttctatatcatccatcaaatttttataaacactggagactgctgcttctgggttctcttttccaacccatcatcctatctgtatgtcttattatcttggaaaatgtcaacatggccctactgtacttctcccccttaatgtatgaggaagtttggtataaggctacagggagctgtgaaaactatggtcaaccagaaaatgcctacatccaggcaattcagtgtttaaacagcactgtgttggccaagtaaaagaaatgttcaggcttcactgtccctagcttgagacctccagttatctaaatacatgctacacagtgacagactgtcccaactacacaaaaaatgcagaatttaaacatttcataagcatattttctcatcggaattgcttttaacaatatgctactattagtttggtataatcagatttttgttccaccagatacactgctattctatactacatccttggttaagatgcttaggatcagtgtcttcatgtataaaatgaggacaataataatatctgctttataggaccaagattaaatgtattaatgcatgaaatgcttaggataaagctctaatatttagcaatcatttaattatcactattgttattgtgtagatcatttatattttgggtatgttgtttccagtttctttcttgatttccacaagtatgttacatcatattgagaaaactaagagcttatactgaattttgttttttattgtatctgacaaaacccaggagatgcgttttgttttccaaatttgacttttcaaagctttcccttaatgtcagatttaataggtctttgtaaaaatacatacttctaagataggtacaacaatttgtctcctggaggcagaatttctgaactgagcataactttaaaaggcaaaaaatgaagaaaacctccaaggtttaaaaatatggatgcagtctgacaaactgaatgtttaaagttaattaaaaaaaaaagacaccaaatcttgagtgaaataaatggtccatttgagacaagtgtatcagcatttaaaacaaaataacctttccatgcagctttgattcaaattttcacttataaaacactttttgtaatatttgtcatcagagcacctggccaggtttaaatttacatacaaatgtaatataggtctacctatagtgaccatgcttaatcaaagtaagtatttagaaaataagtatctactttttgtgtccaaaaaacagcattcaggattctcagaattatttggagctcctattccaggaaagctccactgttgttttcatttttttctgtgtagtgtaaataaaaagtgatgtgttttatagcaggttgtgtaagtccttactataaaacatttctctaatttgtttatagtgaccatctctcaaaagaagaaggcaaaaacattcagaaacaattaaggcattctggtagatttccaagaaggagcagcagccaaatagttagataaacctgttcaaccagacatgattgaaaatccaacaaatgaggttggtgggggagacaggattagacgggaaggaaacgaaagcttttctacatctccaaatatataactaaactgtttgcttttacttgaatgcttagaattccttattaatttcatagttcagtaaatattaggtcttaaagcgggaagcaactggaaagacgtttcttaacaaaagggatcatgaatcagcttagttctgcttatgcccaagaaacagtaactgctatagaaactgccctactataataacttaaaaagtctatgtaagtatataaaacaaaactttttagacatttcaaaacagaaaacattggattataattctgaagagaaagaaacaaatgagttaagactggcttactgcttagagaaagagtctcggttccaacagtggaagagggtacctaaacagagcctgtgagtcatgctgagttgaggaggtaagaaaggagtttagtgatgcggagataagaaaggagtttagtgatgctgagagggctagaatttgtagagctgcgtaaaacagaggggagagttacaaaaacagatggttctgaagacctgcagaggatactctgctcttggctgtagcatcgatcttagcactagtgaaaggaaataattcaaggcatgggaaaaataaagtagtgggatggacaatttcaagggctcacacagggctaagaagaatttatgttttcatcagctagagtggatagactgtgtaatacatgccatattggaaagaggctgaagaagaacaagaatgccttattaatggaaatatttaaataagtcccagaataaagactgctctggatccaccagaacaaagggtaaaggcaagcgtctaaagaattcagttaatctgcaagttacttacccgcacaccaggagaaaatccagtgttttttttagatgaatacaactaaaagtagcacctgaaaaatggaaaattcacaatgtctggcactcaaaaattacaaggaatgcaaagaaaaaggaaaaaaaaaccaactatgactaaagccagcagaaaaaaaataatgcaacagttccagaaacgacagaaaggaaggttatcaaagagaagaaccttaaaaaagcaattataaacagaataaatatattcaaggacatgaagaaaaacatcaacctgataaggagagaaacggaagatataaaatagacccaagttgaacttcaaagataaacatgctgattatgaaatgaaaaatgaagtaaatgaagaataaaaactatcaaataaagtactgaaatgacaaagagttaaaaatattggaaagagcttcaggaaacccttgggatagcactgagtatcatatagcaaacaagtcccataacaggagtggaggctttaagaaataatggctgaaaaaaacatgaacctatgaatccaagaaccccaataaacaccaaataaggaaaacataaagaaaatcacactaaggcatcacataataaaattgatgaaaaccagagatagaaaaatcttgaaagcattcatagtagcagaaaaagccatcttgggtgcagaggaacaaagataagaatgataggagactttttttgtctgaaatcctgcagggcagggaaaaatgaaacatcatctttaagtattgaaaggaaaaacaacctgccaaaggattctatacccagtgaatatacattcctaaaattaaggtgaaaataaagatattttcacactgataaaacatgagaaaaattcctgacagcagttatgtgggggtaaaagtaaaaaaaaggtttctgcttaaagcaaaaatattaacaatgaactactttaagttttagaacatagaattaaaatataggacaacatcacaaaggctaggaagagataaggggaattaacttgctataagggtctcaaaccataaatgaagcagtacaatttgaaggtgaactgtgacaaattaaagatgtacactgtaaaccttgcagcaaacactaaaataattaaagaagtacagcaaacaggccaatagtgacaaaaaacagaaccacacacaaaaaataatcctacacaagaaaggaaaagaccagacggaataaataagaaaccaacagtaagacggcagatttaaagtcaactatactaataactactataaatgtaaatggtataggcactctaattaaaagacagatactgtgatttacaataaaaagcgagacccaccaatattccatataatagaaagcaattttaaagacacaaccataaattaacaataaaaagttagaaacaaaatttgtatagcatgcaaaaactatgaaggaaactaaagtggctgtattaatattagacaaagtagactccaaaataaggaatataaccaggggtgtcggacgtcatttcatgacaaaggggtcaaatcatcaggaagacataatatatataggtataagggatgcaaaatgatatagaaactttagaaatttcttaaaaagttaaagatatatttagcatatggtgaagcaatcttactcttttactcctaggtaacttctgaaaagaaatgaaaacatatgtacgtgcaaaaacttatatgtgaatgtccataggggctttatttataacagttcaaaactggaaacaaccagaatgctcagctggtgaatcaataaactgtgggatatccaaataatggaatacttattaagcaataagaagagagaaactattaattcacacaacacctaacaatatacatgaatctgcaaagaataacactaagtgaatgaagccaaacacaaagcagtcccatgattccatttattgcaattttagaaaaggcaaaagtatagggcccaaagacagataatcatctgtcataaccgtcataggatgggagtaatacgagaagcaattactgccaaaagtacagttaaacttttctgggtaatggaaatgttatttattttaattgtgttgatgattatataactatacatttttcaaaactcaaactatatactctaaattggtgaattttagtttttgtaaattattagaaaccatgcacattctggattgtaaggctgaattatctgctaacattaatgtgatttggaaaccttgggaaattgaaatggggatatccaggaagagcctgaggaattaaaggcagctgaaacttccacgctcctcctgatagccccatggaaaaacagaggttaaaagtcctccagtgataaagcaactgacaggaaagaagcctggagatgggcacgtcttaacccatccatatattttccctttggttctgaggcaggaacagagatagaaacaagcagaggcaggttcctttggaaagcaggacgaacttcctaacttgctacaaagacaaaagccccatgacacttaaaactgccttgaccaatcagaaattctcaagacagttaactaaggctttaaaggagatacaatggcagaaaaacttctagcctggtacaaggtgtctgtgatgtctcaactgctaagcaatcctcaggttctgtatctatattcatatgtattaggccgctgagggagaagagcttctacccggagaatcctccaatagaggaggtttcctgggccactgggtccaggaaaacagtggacaaggaaaattttatcagtagaatctgggactttggaataaactaaccaattaagtcaatccattgctaggaaatgaatcaatgaaaagatgctcacatgggttaactgtgctatatacctgtctagcaggaagtagtaaatactccgaataagtgatagctgttatacttcccctttttgacttttcttgaattgaaattattcttttttttttctctagtactttatgtgaggtatgtcagatacagtcaaccctccatatctgtgggttctgcaactgtgtattcaaccaacggtggatggaaaatattccctctaaaattctgtctgcattgaatatgtacagacttttttccttgtcattattccccaaagaatacaacataacaactatttacacagtattagatattataagtaatccagagacagtttaaagtatatgggaggatatgcatcagttatatgcagatactatgccattttatatcagggacttgagtgtccttggattttggtacctgtcagaggccctggaatcaatcccctacagatattaagggacaacggtattttcgtatttttcacttagcctatagatttcagtgccatccatacctgactgaggggaatgaacactatcaacaaatcttagccttggagacagaagctgcagttgggcaggcatgttacagagagatggtatatttgtggttgtaaaaggaaaactgcaatgtttggcaaaagtattattcaatgtatgaagaagggtgtgtctgcacactggaaagaaacaaatgggtatctattgctttgtgtgccaagaactcccattctctgagaccagtatctcattcttactgtcattgcaagcaagtgggggctgtcaatcacaatattccatcctctcagtgatacaagtcagaatcctgtcctagaacagactaaatgagaagttagggaagaagaacaatcctctttggtgtcaaaattaaacacgtgatctatagcactgctaataaccatgtataaaggacctcattccaaagaataatgctgacacaaaaaatcatgcagagatagaaatggagagtacgtcctggtgacaatccatcttcaggtgtgcccttttgctaagatggattcacttgctgtcacaactatatgagtgagttctgatacaatgttgtgggataaaattaagtagtctagtaatctagtatataaggtgcacagaagatatggtggatgcactcttaaagaacttgggaacattaagaaatttgttcagcattgctaagtccatgtcaaagccaccccactgcaatgtttctctccatgtaagctaatagaatatgctaacacattaagaaaaaggatccagctacagatagaaacagtggtactatccatctcttcaccccaaagataattctgagcaaacatgtcaccttatcttactctgttcaagtatatcaaattgctatttcactctgcaaagattattctaactatataagcatgctctattcttctcaaactccaaacaccatcattgatcaagataatcatgcctcacacttcacagaaaaatcagaagccatccaattaggctccttcaatttcccaaaactaattatactatgctctcctacatctcacctgtccaccttctcaaaggcgagtcattccacatatgtactggatatgaattccctccctccatcctttgtctctgggaccttacaccattaatttttctatgcgttgcaaattcaacctttccctcaaccaccagaaatgtaaacttcatgaagacagaaaccttgtccctcctgctcaaccctgtatttctggtggctggcacagcaggtagtcagtattatttgttgaagccatgactaaataaatgaatggatagagaatgaataaattgaaaggagttctccctttctaaagttctataattctgcttagagaagagcaggtgccacattggatttttaatttagggttagaggctttatccaatttcaagaatgtgtctatagataaacataattttttcatccttgactttcagataaattccctttaaattttgagcataaagataaaataaatgaaatagaaaatgacaacgcatgatacttactcttctttccatccatatctgcatgaattttccgagccaagaatccacttttgtacacagcagcatttggatcatgaggaatgtccaaaaatgggttagtagtacttccaatacgactgatggtctttggatgtgttccgttagctttctcctcagtactttctgagggagacttttttttctcttcatcatctctaaaagggagaaagcacaaagactgagtcaagcacctatcataatattcaaagaaaaaggtaagttattgtaaaaaactacattgtattccaatggtgtatcactttttataaccaccaccatgataatgacagacaccatttgttaaatgtattctgtgtgccaggtgttaatgatcatggcaatatcttataagactgatattaatatcctctattacagataaggaaatagactcagtgagtttaaatgtacaaggccacagatttagtgatgaacagataatgaagatatgatcataaaatccctaaagtcattggtcttttcaccgtttacaatgctttcatgtttgtcttctttcaaacaagtgggagtttattggcaggaattatgattttgacttacgtatttctacagggtctagcatagaactaggtgtacagaaaacagcaaaagtgttagagtcagtccaatggacaatagtaaacaatatcccccaaataaccaggctagtccctaatattaaaaccccaggcaaagctactatggattagaatggggatgccaggcacagtgctttggcatgtgacagctgctactttctcaaccgccataaaaatagtccccaacatctattgttcccatctttatgtccatgtgtacccaatgtttagcttccacttttaagtgaaaatgtgtagtatttggttttctgttcctgtattaattcgcttagaataatggccttcagctgcatccatgccgctgcaaaggacatgatttcaacctttttctatggttgcatagtattccacggtgtgtatgtaccatattttctctatccagttcaccattgaagggcatctaggttaattccatgattttgctactgtgaatagggctgcaataaacctatgagtgcatgtgtctttttggtggaatgatttgttttcctttaggtatataaccagtaacaggattgctgatttgaatggtagttcttttttatgtactctaacaaagtacttaaaaactgctttccacagtagctgaactaacttacattcccaccaatgatgtataagtgttcccttttctctgcagccccactggcatctgttaatttttttgcctttttaataacagccattctgactggtgtcagatggtatctcattgtggttttgatttgcatttctctgatgattagtgacgccgagtattttttcatgtttgttggccatttgtatatcttcttttgagaacagtctgctcatgtcctttgcccacttttttagtaaggttatttagttttttgcttgttgaattgtttaggttccttatagaagctggatattagccagattaacagtttgcaaataaccacaatatattttaaatatatcacaaaaccagaagtgtttgataatgacggtaatcagagaaaaacagccttttttttctcttttggtattttatcagtaattgtgagataagtgaaaacaaaactggactcttagaagaaatggatattttacttttattttgaaagaattttagatttgtgaaggacaggattcccctatgcccagcttctcctaatattaacatcttatatattaataactatcgtaaaaaatttcaaaactaaaaaattaacgtaagtttaatacaatgaattaaactcggcttcatttggatttcactagtttaccatttttttctattctaggatcctatccatgatcccacagtgcattctgttgtcatgtctctttagcgtcttccagtctgtaacagttcctcagtctctccctgtcctttatgaccttgacactttgaacagtattggtcagttatcttgtagaatatcctcagtttaggtttttctgatgttttctcatgactggatagacgttatgcattttttggggaaagattccatataggtgatgcatctttctcagtgctttaggtccaggggatacaagttttattacttgttagaattaaccatgatcacttggttaaggcagtgtcccacaggttcctctacagtaaagttactatttaactttgtaagtgtttttggggagatatcttgtaactatgcaaatattgtgattctcctttacccactaactttatcttgtaacaattattattacggtgttttaaaggttccctcatttattctacattcattaattgaaattcttctgtaagtatggacacatggatatttgttttattctttaggttataatcaaatactattgttatttaatttgttgcttaaatttttgcagctttggccattgggagttataataaggtgtgctcctatgtcctgtgaacatgcctcatcttctaaaggacttctttactttcaggtaccacagaacgccaagctcatcttaaattttccttgtcctggccctgaaatcaaccacttctccaaggagccttggttcttcttactggagaacagtatttagaaatcaaatctcggggctaggtgtgctcattgctttggggtcctcccaatagacaaagctagggagatacagttatgtatcatataacaatgtgtggtcaacgatggacagcatacaatatacaaccattgtcttgtaaaattataatgcagccaaaaaaaatcccattgtctaacacttaccatactatgcttttcagtgttagagtatcctacttctatttattaaaaaaaaagttaactgtaaaacagcctcaggcaggtctttcagtaggtgttccaaaagaaggctttgcactatttacaacaccaaagacttggaaccaacccaaatgcccaccaatgatagactggataaagaaaatgtggcacatatacactatggaatactatggagtcataaaaaagaatgaattcatgtcctttgcagggacatggatgaagctggaaaccatcattctcagcaaactaacacacgaatagaaaaccaaacaccacatgttctcactcataagtgaaagttgaacaatgagaacatttggacacaaggaggggaacatcatacactggggcctgttgggggtggggtggagggcaaggggagggaggagagcattaggaaaaacacctaatgcacgtggggcttaaaacctagataatggtttgataggtgcagcaaaccactgtggcacatgtatacctatgtaacaaacctgcaggttctgcacatgtatcccagaacttaaagtaaaataaaataaaaaaggctttgttatcataggagatgacagcttcatgcacgcccctgaagaccttccagtgggacaatacatgaggcgaaagacagtgatattgatgatcctgacccttgtgtggccctaagccagcgtgtgtatttgtgttctaattatttttattatttaaactcttaggctataaagtcccatgtgttctaatttttaacaatttttttaacaaaaaagtttttaaaagtaaaaaaggcaaaatttcaaaaataggaaaacacttataaaataaggatataatgtttttgtacagctgtataatgtgttttaagctgttattaccaaaaagttaaaaagctaaaataacgagtttatgaagtaaaaaagttacagtatgctgatgttaatttataattgaagaaaaggtttttaaaaagaaatttcctgtagcctaagtgtacagtgtttagaaagtctacagtactgtgtagtaatgtcgtaggctttcaaatccattcaacactcactcagtcactgacccacccagagcaacttccagttctgcaaactccattcatggtaaagtgccctaaacaggaataccatttacaaaaaatctttaatgccatatttgttgctgttcattttttgattactgtttgttttctgtttagatatacaaataccattgtgttactactgcctatagtatttggcacagtaacgagctatacaggattatagcctaggagcaataggctataccatatagtacacatgatgttcacacagtgatgaattcgcctgatgacacagttctcagaacatattacagttatgaagtgatgtatgactgtatatataagtacactcacgtgtatacacacatctatatttgtgtatccatccaaccatcccaattaatttatattaacaccaccaaacctaagccagcacattccagccttctcccacttgcttatctgtacatcttcaatagtgagaaaactggctttcacgatctgcaatatattgatttgttcaatctcagtaaacatataaaagagttccaaaattgctagcctacacccatgtgaggaacaaatttatgtactagagtacagtgtttgtgtacatttcttttgtcttacactgttttccaaagttatgggtgagctctttttttctcactctcatcacaatggttaggtgaaaaacacattccttcgttatagtctgaattctactttgtgtttatcatatcctgactgattttcttaaaaaataagcatttttgaaaatgcatttcttgtgatgttcagatttaaggatttagataatgtatagagtcatgtacccactacaatgccaaatggaacagtcttatcaccccccaaattccctcacactgttatttggccaactcctctctcccatcgattcctggcaactgacttccatccctatagttctgccttttccagaatggcatataaaatggtttcttgcatttggcaaaatgcatttaagattcatccatattgtaatgtgaatcgatagtttgttccctaccattgtaaagtaccatttcattttatggtcgtgccagtttgtttatctattcatctaccgaaagatactgagttgtttctagtttctatattttatttttacaatgaaaaactatttgtatctacaaccaataccataataaaaatataaaaatacagtactgccagtctctcatagatcagaatcaatctggaagaaagatttctgtccttcaaattgattattctattatcatcattaagattcagtactgggcccagcatggtggctcatgcctgtaatcccagcacattgggaggccgaggcaggtagatcacaaggtcaggagttcaagaccagtctggccaaaatggtaaaaccccatctctactaaaaatacaaatattagcccactgcagtggcaggtgcctgtaatcccagctacttgggaggctgaagcagagaactgcttgaacctggcaagtggaggttgcagtgagctaagatcacgccactgcactccagcctgggcgacagagcgagattccatctcaaaaaaaaaaaaaaaaaaaagattcagtactgttacagcccacagctaacatcatactcaacagtcaaaggtggaatgtttttcctctaagaccatgaacaagacaagaatgcccactctcaccacttttgttcaacacagttttgggagttttaggctgagcaattaggcaagaaaaaaaaaaaaggaagtgactgtctctgatgctgacataatcttatatatagaaaaaccgtaaaaactacccctccctgacaactgttagaactgctaaagtcagtaaagttttagattaaaaaaccaacacacaaaaaatgagtagcatttttgtacactaactactcaaagaattaagaaaacaatcccacttccaaaagcattaaaaacaaacaaacaaaaaaaaacaagtaggaataaatttaagcaaggaggtgaagatctgtgtactgaaaaccgtaaaacattgaaaaattcacaaatcaatggagaaaaaaatcccatgttaatgaactggaagaattaatattgttaaaatatacctagtaaccaaattccaatgtcattttttatagggatagaaaaaatactaaaatttgtaggaaactagaaactactccaaacagccaaagcaatcttcagcaaaaaatcaaagctggaggcatagttttttgactgtaaaatataaagttactgtaatcaaaacagcatgatactggtataaaaacagaaagcccagaaaaaaatcccaagtagctaaggtcaactggatttctggaaaaggtttcaagaatatataatgggggaaactacagaatcaggtgccatggcattgaccactgcccttccgtggcttgtgccagtctgaaatccaaactatgacaccatcccctcttcgatccctactttaggcaaaatagaaaccagtcacatgggcagcctacagacaggccagaatattgttatcaagtcccactctcttccttgcatcccaagagagggagtaagtaattgggctgcttcctaaggactatgctataccatgctgtggagggagtcgggtaagggcaaataacattgctttgaagttttctactgttttaaatgtggcttttttttttaattgagagtttgcctggttgctgtacatctttggttttcagagcacatgtgaagttctttcagatggtcttacttgcttatggaatgtttccctaagaaaacaagggcctggagcttcctagtccaccattgtgccccatttcccttttattgctctagtcttagtgttatgggtttaattcagtccccacaagagaaattaaagtactaacttccagcatttaggaatatgaccttgtttggaaataagatgattaaagagtgggccctaatctaacaatattgatgtccttattaaagaaagaaatctggacacagacacacacatacagaaggaagaccctgaagctaccacaggctaggagagaggcatggaggagactcccggtcatggccttcaggaggaaacaaccctattttcaccttgatctcagtgatcaagaaccatgagacaataaatctgggtttttaaagcccatttgtggcattttgttatggcagccaaaggaaatggatatacttagatgctacctcaccacagcttcagattaattttatcacttttgcagatgggagtgtgccctagagaagaaaaactgggacaactgtgtctcagtacttgctcttccataaacttcactgtgatcctgaataagctgcagcatctctctagatctcagcctcctcatatgtaaaatttgaagcttgctctaagtcagtaaatacaagccatgcaaagcctgtccagggagtgggagcccaggatgagtagaaaggtctctggaatccccattcactttcaaaaaacagctcttggaagcagactgtggtcgtgaatccattctagttctagtatttcatgattgtagaactccgttgatatagaccaatacaaaaccacaacaaaagatcaggatattccatgtgtctccacagcattgaccctaaatggaaacctatgctgctaagtgtaggctaaatactgcaaaaagcctctcccctaagatatggagcaggtaccccaagttttaccatgcaaaccctccacaacaacaaaactgcatacattgttaagtgatacggtttggctgtgtccccacccaaatttcatcttgaattgtagttcctgtaatccccatgtgtcatgggagggaccagtgggaggtaactgaatcatgggagcagtttcccccaggctactcgtgtgatattaagttctcgtgagatctgatggttttataaggcccttcaccttcacttggctctcattcttctccttcctgccaccatgtgaagaaggacgtgtttccttccccttctgccataactgtaagtttcctgaggccttcccacctctgcggaactgtgagtcaattaaacctctttcctttataaattacccagtcttgggcagttctttatagcagcatgagaatggactaatacatcagtaagactggagggaagatggcagaagaaagccctgttctttcctctctatttaggaagcagaactaattagccccactgacctacctttgagtgtctcaaaagagaaactcgacacttgcccccactacttctttggcatcaggtaaaccgctctatcccttttgccttactatgtggcaaacccagtggggcagagctcacctctgctcctttagttctgatttcacagcctgtaatatggttaggctggggagctcagcaggcttggtggccactcaggtcccagtcacattctccagtataactttctgcaggtgccttgcactctgcattacacagcagaggcttgacttcatttcactcagctctctgctctgtgtatacactcctctagccagaacattacagaagggtaggggttataaatcaggtcccaaagtccaccttgtactggcaatcattaccatgatccctgtaatttaatttcctcaccttacaaccagcctagaagctagatgttaccaagtccctgctctcctccaggaagcaatgcttgggaactggtatccctgggcatcagggccagctgagtagtgatgggaaggagctctaagttgccaggcagtgtgtgctaggcagtcctgatatcatgatgattaagacccctcgaggggttcatcatccagtaggggaaacagatacacaaaatattggctaaaacattttttataaaatactatatgtctccacagagctgtgtacaaagcagtacaggatcagagaggagggaagagtctgtatcaaacatgctaaattataatgcaagaaatccttgttgggtgatggaaatggggtgataaactacggtggttgttacacaagtgtgcaaagttacaaacattggtgtagcataaaattggtacacttaagtgggtgaattttatggcataaaaattacacctcaataaagcagtttaaaaaataaaggtggtggttgaatgcaggggcagaacactaaggtggctcacatctcaatactgtgatcagatgattgcaggaaaataaagcgaagaatgaacttataaaaaatgtgctgagttatcatggggtttctattataccacatcacattataccacgaggcaggatgagtctaaaatggatctttgtcacttaccaaaaataaaaaagaaagcatgtagttaaattttaaaattctgctgaaaatatgaattgcattctattctctaaaaataccttattttgacacaggaatcctaaaagtaaaaaagagactatgctttattaaaaatgttaggcttcatcactagccttttaataccaagaaaaatgctgccagatatgagaaagatgtaggctagtaacttggctttctaaataaaggatctgaccatatgtacaatgactgtagtatgctttccaaaccaagacaaacttaaccaatggttaaaaaagtttctgaaaatacactggggtcaagccacatgttaggtattcccaaaagatctattggaaaatttttaaggggcaactaaaaataacttccttgagtattcttgatctggctaaattttctcacctttaaaaaatatacatatatgtataaattataatgtacgagtacataaatgctcaatgaaacaactactgtctaaaatgctcctcatatacacattaaaaatcattcagaaactatatttattatatatcatcttgtatcattcctcatcaaacatcaagcacttagcaattgatatagaggatataagattctctatccttagcatactaagaaaaatgctttctttacatcccagcctccataattctttgctcctcagtgattctaaaaatgctttaggacaagtaggctactaacataatcacattccatctgctcaccaacctgtctgctctgaatattctgaagataatgtgaaatgaagataacaatatttgtaaagtacataactttcatcatatttagaaatatttaagcttttcacaataaaacccttaaaatttctaagtatccatctcaatctcattatcaagagaaatgccacttagacatgaagcaaacaatgtattgtcattttttaaaaaaatttggccttttaaagctaagaactgggtggcaaatctttccagtttcctatacacctgagttcagctgagaaaacaagtacttaaatcttaagtgtgagctcagattaagtatgagatatgctttaggttcttgataaaattacatttcacagagccatatgagagagctgtcctagtccattttgtgttgctaaaacagaattccactggctgaggagtttatcacgaatggtgacttatttcttacagttctggagactgggaagtccaaagtcaagggtcctgaatctgatgagggactcccttgctacatcatcccattgtggaaggtgcaagggcaagaaagtgtgagagaggaagagggctgtgaacttggttttataagaaacccactcctgcagtaacaaccttaatccactcatagccctcatgacctaagcacctcttatgaagccttgcctaatggttgggggacatattcaaaccatagtattctgtctgtggcctctgaaatacattcatttcatcacagtgaccccagttttaactctttctagcaccaactcagaagtccgaagtccaaactctgacctaaatcagatacaggtcaatttgaggcatgattcatccttaggcaaatttcccaccagctgtgggcctgtgaaatcaaacaagttatctacttcaaatactatggtgagacagacatagatgctcccattccaaaagggagaaataggcaagaaaaaagaatgaacaaaacccaactccaaaaccaaatagggaaaacaacattaagacttaaagctggagaatagtttcctttgatgtcccaaatcctgaaaacactggaattggggttgggcccccaaggcctcaggcagccccaatcctatgacttcactgggcttagacgacccagcagctgtcatggaatatcccacatcttttgaaatctaggtaaagaaagccatgcctctacagctcttacattctgtgtgcctgcagaattagcaccacatggatgctgctaaggtttatggcttgtatttcctagaacagtgggctaagctgtagctaggccggcttacaccacggctggggtagccaaggaatgctgtgccagaatgtggggagcagagaactgagggggctctggtggagagcaccctgggcccatcccttgaaaccattctgccctcctacacctctgggactgtgatggaatgggcagcctcaaagatctctgaaatgttttcaggggtcattctcccattgtcttgatctcttgtatccataacaatatctttgcaaatggttgcttggccacaactgtggtttgctttcccaagcatgctttatcattctttgtaaggccaggctgaacattttcaaaatctttcttctgcttctcctttaattatcgttctatctttaagtcattcctctcatatcttactgtatgtggttaaaagtagctacttagctccatcaacattttgctttgaaatttattgcaccagatatcttagctccttgctcataaattctgccttccctaaagcccttggacaagaatacaattcagccaagttctctgtgactttattacaaggacagtctttactccagtttcaaataccttgttcttcatttctacctgagacctcatcaaaatggactttactatgcatgtttctactaacattctaattatgatcacttaagtaatgtctaagaagtcccagatggtccttaaatttcttgtcttctcctgagccctcacccaactgcccacaatgctccgtttgcagcagtctaggctttttctagcattcacttcataactgtcccagcttctgtggattacccaattccaaggccccttccacattttcagcttattgttatagcaacagccctaattctcggtaccaatcttctgtcgtagtctgttttgggttgctgtgaaagaattccacaaactgcataatttaaaatgaacagagatttatttcttacagtattggaggctggaagttcaaagtcaagtaaggggcctgcatctgatgagggcctccttgctggggtcttctctaacccccacctgctctcttgtgctttgctgcccttctcctagtaaggcagaaggtcaagaaagcgcaagagagcgagttggggatcacagttgcttttaaaacaaaactactctcacgataactaacccactcccttgataacattaatccattaattagggcagagcccttttcccttatgacctaacagtctctaattaggtgttacctcctaacactgcattggggattaagtttctagcacatgaactctggggacatgctgacaccatagcaagagtcttccttaattctaaccactgaaaatctttttcctttaaataccaaaatccagaagattaattcatgttcaatatcatttttagctaacaattttttaatttaaaaatactttactgtagaaaactctaataatcaatagctaacaaaattaagtggtctcaactctttagttcaatatttccttcaagttaatggtcaatttttcataactatggcatttctgtttcttttcttacagtcagggtgtctttgctgaatataaatagaacaatcaaaccaataatatcctttacataaccactatacatatatagatttaaccttagttattcttcgtatagattgtcttgtaagtttgttatgctagtactaacattagcattattattttaccaagagtccagcgtgacacagtatctgccatgttaggaatttgagtacagtgaaacagagagcaatgacaatgagaacactaaatctcattctagaatttcaatgaggtgtaatgagtatctagaaaagtcatttaattgtatgagcacctcaagtggagaactgagttttattccttctgtttctcccaacaataaatgaatgcattattccttctttgtagtcaaatatctcgtgcaaataattttatcagtttttccatggtgagttgtctctacctatgaccctaaatgccaagctccctacctctctctgcacacactcaaattaaatttttggttatatatttaaaatatatgttttatctataccattgtccagcttaatattttaccaagagtccagtatgatgtagtttctgctggttaggaatgtgagtatagtcccatagacagcaatgacactgagaatgttattctagtatttcaagaggcacaatagcaacttcttcttgccttagttttcttgttagtaatgattgccaacctacagatggctacattgaagtttaaaatgaaaattactttcattttaaagttccctcataaatgtcttcatcccaaataactttttcgagcaagaaagttttccttcattaatctacatctactattaagaaacactactctgattaacaattttatatatctatattcactagggattaaggatatacagttatttaatgtagtaagtcattgcaaaaaaaggaaattaccatgagttgcctttttgaaagaaaaccaaataattttatgtcaaggtaaaaaatattttaactaaaattaggaagaactcttttcattaggatgtaagttcaattctaaaaagtacacacaagggattccaacttttcttcatggctgattctaatgttggcaaataaacaaaatgaagcactacaacaaaaaaaatgaaaaacttaaatgaaaggcgacaaattatattaaaaagtgtaaggtggtacaactaaatcagtctaaactaatagaaaaactcttgggtgaaaagaaaactattcgtccttatgagattaccaactctcacagagaaacaactgagattacattttaattaatatgtattaatacctaaaatgaaatgagaatcaatgctgagttaagtaaaatatgataagggaaccaaataatgaaagtaaaagagccctagaaggcttctttactcggaaaaagagttttcttaagagttcacaaaacaaagagactttggaactagttaccaatttcatatttaggccattgggttgaatgaacaatcaaggtacccacataaaaaacaggtaatagtaatcccattgcctctatcatcccccaagaatacacacagagatgtacatgcacacactcacaccttcatgggcagtgttaaacataatggcaaagaagtgggaggaaatctttgcaaaattttctctacttcctaatttcagcaaatcagccaacaaagaggcagcactgatttcctgaaaagaccagtcatgacttaaatttgcaacaaggaaatgaaaagccaaactacaaactgttggtatttaaaaccacactttctaaagctcagggctatcataacacatgactggaaggacagaaagatatcaatgtgctaccacctcacctaattagccagaacaatttaatatgtgagggcagatgggaaatagtttaacttattagcaaatacagcaaatgttttaaactgttattgttataaaatgagttgtagggcaatatgaaattgcaggaaagattattccacgatgcaaagttgtaaaatgcttatccagagttaaaaagaacaaatgtgctaaatgacaaagcaaggccaatgctgctgtaactaaaacatggagggtgcacaagtgcagagggaatccagaagttcattatttaaaactgttttttttttttttttggctgactttattaaaatgagccaatacatgatttttttttttttttaaactaggataagggagtgatttggtttggatctgtgtccccgctcaaatttcatgctggattgtaatcccaaatgttgaatgtggggcctggtgagaggtgactcgatcataatggcattaccccctttagtactgttctcatgatagtgagtgagtgagttaagtcatcatgagatctggttgtttaaaggtgtggggcacctgccccctctctctcttcctcttgctccggccatgtgaagtgccagctcccccttcactttctgctgtgatttaaagtttcccgaggcctccccagaagctgagcagatgccagcaccacgcttcctgtgtagcctgcagaaccatcagccaattaaacttctttttatataaattacccagtctcaggtatcctttatggcagtgccagaataaacgaattcagaaaaatgggtcccaagaagtggggaattgctataaaaaatacctgaaaatgtagcagcaactttgggaactgggtaatgggcagaggttggaagagtgtggatggctcagaagatgacaggaagatgagggaaagtttgagacttcctagaggcttcttaaattgttgtgaccaaaatgctgatagtgatacggacaataaagtccaggctgtggaggtatcagatggcaatgaggaacttattgggaactaaagcaaaggttatgtttgttatgcggaagcaaagaacttggaggcactgtgcccctgccctagggatctgtggaattttgaacttgagagtgatgatttagggtatctggcagaagaaatttctaagcagcaaagcattaaagaagtaacctggctgcttctaacaacctatgcttatatgtgcgagcaaataaatgacataaaactggaacttatatctaaaagtttggaaaatttgcagcctggccatgtgaaaatttgcagcaggctgaagaaatttgctttactaaaaggcaggcaagtgctgatagcaagaaaatggggaaaatgcctcaaaggcatttcagagacctttgcagcagcccctcctatcacaggcctggaggcttaggagagaagaatggtttcataggccagtccccgggaagtttcactgccctatactgctccctgcatcccagccactctagctacagctgtggctaaaagggccaaggtacagctcaagctgtcactccagagagtgtaagccataagccttggtggcttccacatggcgttaagcctatgggtatgcagaatgcaagagttaaggcttcggagcctttgcctagatgtcagagaatgtatggaaaagcctggatatccaggcagacatctgcggcaggggtggaaccctcttggagaacctttactaggggagtgcagaagagaaatgtggggttggtgccccaacaaagagtccccaatgggtcactgcttagtggagctgtgagaagagggctaccatcctccaaaccccagaatggtagagcccccagcagtttgcaccctgcacctggaaaagccataggcactcaacgccagcccatgagagcaaccgcagggactgaactctggaaaagccacaggggcagagctgcccaaggccttgggagcccactcctcacaccagtgtgccctgaatataagaaatggagtcaaagcaggttattattggagctttaagatttaatgactgtcctgccggggtttcggacttgcacagtgcctgtagcccctttcttttggctgctttcttccttttggaataggagtatttagccaatgcctgtacccccattgtatcttgggagcaactaatttgtttttaattttacaggctcataggcacaagggactaggcttgtctcagataagagtgagttaaggctgaaatgagttaagactttgagggactgttgggaaggcatgactgtattttgcaatgtgagaaggacatgagattttagaggcgccagggatggaatgatatggtttggatctgtgctcccacacaaatctaatgttgaattgtaatccccactgttggaggtgggatctggcggtaagtgattggatcatgggggaagatttccccctttggtgctgttctcatggtagtgagtaagttattgtgagatctggttgtttaaaagtgtggcacttccaccccaccctgctctggccatgtgaagtgctgactccctctttgcctcctgtcatgactgaaagtttcctgaggcttccccagaagctgagcagatgctagcatcatacttcctgtacggcctgaagactgtgagccaattaaacctcttttgtttacaaattacccagtcttaagtattgctttgtagcagtgcaagaacagactaaaacagggagatttcttacaatttgtaaacactgttgtagaaagcagcaataaacatgaaagtcaaaggatgaaagagaggaacattaattttcctaatagacaatactgaacttattttattttcctatttgtgttaatcgttgtattttctgaagatcctcatgcagatacattttaaacaattccaacataagatataaactcccatatccacctcaactcacctcatcctacgccatcccaatcacaaagagtaattactcactttgtttatcacttagactggaaattttttaaagccaagaaaaatgcctcaatgccttatatagttttgttctccccaaattatcagcaggctgcatgatgcaagtaggtcaacaaatagatgcttcactaataatgaacaattgagcaaaggaacttggaaaggcaaatggtcatggtcctatatgacgtagcagagaccttccacaagtcaatttgactcactgcactcttcattacagtttttgtatttttatctttgtacagtcctccctctcccctaaatctcatgttgtgttctcattaggcaaggatctgtgtcttattcatatttgtatctagggcacagcactgggccaggcacaggagaagctggatagagattgcagaatagatgaataaataaatgatccttgctactaacttaaggaaaaactctagtaattctatgagcatttaatgagactagcaaattaatacaacattctcttaatgtgcactgtatcaaaggctagcacagaaacattcagactcactctctgctcttcaaagactttataagacggggtggctacagagatgccaggcagcatggtggtgccataggaggccataacagctggggaaaatcctggccttcccaccatactggacttggacctattgatgaacacttcttgacttaattttcctcatatataaagtaacaacaatggactacgtaagtacctttcaaaaaatttttcaagaacatataccttaaaaatatgaaatagaaccctatacatatattcaaaagagataaaagtggagctgttttgatcagctgaactaggcataatacttaaggaagcagaactgggtccccaacaattttcagtcacactcccaggtaaggccccaaggcatctccctgtaacccaaggttacactgaacccagtcagaaaaccaatgatataaaaacctataaggtttataacagttataacattctccggttctaacactcaataattctatcgtgatttcctctaaggttctaacatccacatcaagatgcctcctgcgcaagtcttccatgcattatcctacaaactttgtagcatcaccacctttcctgtaactattttctaaactacacattgtaggcttatcttttaagaaatgtggttccttcattaccattaacatcctttctatagccttttatggagccttcattacatataaacactatgatcagcaacagaggagataaagggacaaatccagacatgtatcatttccttaaagagcttacaatctaatggcacattactacaaataaccataatggggtgtagaaactgctggtgtcatcagataaagtaaaatggaagcttaaggctgagatcatacttctggttagcaagatcagaaaaaacttcaagaaaacagatggaataggagctggactgtgaaggatgataggctttgaacataaaatgattatgggatacaggttcctagcagaggtgacttcacgaacactgaatggagaacaaaatcaattattggcagaacgtgaagggcctaattaaagttttacagcacataggaacttcacagaggttaaagtacagggaagattggagacagaaggccttgttgaggaggcaaacactataaatgcctgaaaaacaaaagaatggcaggagtgaagaggaaagatgctgtttggagccatttctgcaggggttcgaagtggtggtgtgggagggtgtcaaagatgatgtaaaggctaaaatccaggtaagccggaaacgctggtgtcattaatagaaatggagcacacacgacaagtttggagacagacgatgagcgctaagtgccagcagaaacatcctgcaggaaaatgcaaacactgaattgaaacttgggaaagaggtcagagctgtatatatatataggaagaatttttacagaaatggcagaagaagttttaagagtgaattgcaattgctgaggaggagactacattggaagaagacaattcaaagtgtccatctaacgctaagggataatatgaggaaaatgggtcagagaaagtctagttagagaggtatgggagaaacgggagagcacagtgttataaataattatatccatgtacatacacttttatcaaggaaaaagcttagttttttttttttttttttttttgagaccaagtctcactctgtcacccaggctggggtatagtggcacaatctcagctcactgcaacctctgtttcttgggttcaagcaattctcccgcctcagcctcctgagtagctgggattacaagtgcacgccaccacgcccagctaatttttgtatttttagtagagatgaggtttcaccatgttggccaggctggtctcgaactcctgacctcaagtgatccaggctcctcagcctcccaaagtgttgggattacaggtgtcagcgaccgtgcccagctgcttagctcctttgctaaaggatcacatacactgatagatgtcagtgttctcagaagtgtgttctaaataaaaagcaccagttttagtagatgttaaaaggtgctttaagacaaaaataagattcagtgatttaataaattggggtattggccatttatttcctacagaaattcaagatgtacatcaggtttttaaattcaaatttctcctgcagaaattcaagatgtacgttgattgaacaggatgataacagagagatctgtttaattttgtttgagctagcattcattccaagacttagttgacccataatccctttgttttatatctgcttgatagagcagtacttcttccacaggaggaaacactgaaatatggcaaaactcagaaatttacagaatattagaactagaaaaaatacttgtgatcatttcatccaattccttcattttataggtgaagatagaaattatacgataaccactatagtgtcttcttctaattcttgacaatgtataaaaatgtagtctatgtatatgcatatgaacaagagagaaaaagaaaaaaagacaaaaaaaaaaagaaattggagctttgaaagctacagcatcaggcatcaattgaagagcaacttgctttatgttcagtgttttcaaacatttcagtgtcatcctgaaggttacatgagactcaatatttgctcagtcttgcaaaagaggaaactgaggactacaggttaacttggtcagtgaaccagctactacatgaaaaagctgtaattcacaccaaaatttatctgactctgaaatccaggcttctgaacaagatgctctgctaacttcacaagaagaaaccagttactgggtaaactcccgcccctccacccttgggtaacacgcaagatatagctttcttgcatcaaactccgactacctataaatgaataaataaaatctgctgtaacaaattaaaaaaaaaaacctagatttacaaaacaggtcctcaagagtatatgtatttgttttttaaaataacttcataaaagaatcttcaatgtattctcttgcccagagtgaatatgatgatgccatttttatttattttctctagactacatattctgcatatgtcaggatgtcctttttgcatttcagcaagattctgactatatccttcacaaaattttcctatgaaacccacttttgttcatgagaaataagcctaaagaagaatgatcacctttgatagcagaccatgaattcttaatgatcagttttccttgaaatggcacgctgcctttaaatgagtctcatcatgaatatacatacagacacataagccatatatatatatatgcaaatattaaagtcttaacttttgactccctaacttgcaataggaccatgactctacagtgagtagacgcaattcaagtggtgctgatacttcaaaaataaattcctgcacattatatgtaatacacagtcaactattaacccatgttcctccaacgtgcagataacataacaagttttatctcccaagttatgattctgtaaacccgagttcattgtagaatgctctgttaggtcacgtggtaaaacaatacttatgaatacttagtaaaaataaaaaataaaatccacgaagttctaattacaaagaacacattttgacctaatttcctggtaatgtgattaaaaatttcatattcttccataataattttataaaaattaaaattttgaactgctatattgattagggaaattttaacaacagtggtattgttctacgtagacctaggtgtagctcatctttaatagtatttctcaaagtatgtaccctgaaacactatatgtcactgtcaaagagagtcaggaaacattacacattctattcctctcttggggactgataacacacattggcattggataagctcctagaagttctgaagtttaaataaaatagctttattcaatccatcatctcccaagcttattccattcagagaacctttttttggttgctgttgttgttttgtgcttagtatctatcagtgtcctagtatgattagtatcataggaaataaacctggaaagccatgatctatgatgataggaaggagataattaaaataagtggatgataccaaaaccatttgtattacattttgcaatacacactattcatcagcagatttttcttttagaatgttactttttaaaagataaatttaaggccgggcgtggtcgctcactcctgtaatcccagaactttgggaggccgaggcaggtggatcacgaggtcaggagatcgagaccatcctggctaacactgtgaaaccccgtctctactaaaaatgcaaaaaaaaaaaattagctgggagtggtggtgggcgcctgtagtcccagctactcgggaggctgaggcaggagaatggcgtgaacccgggaggcggagcttgcagtgagccgagattgcgccactgcactccagcctgggcgacaaagccagactccacctcaaaaaaaaaaaaaaaaaaattaaaagacaattaattacctacaggtacagcaaccattttaaaagcagaataggaacacactgagtaccaaaaaaccacaggatactctgggtttacttgtataaaaccgaaataggttttacttgtatctgggtttacttgtataaagccacaaagtaggtaagacacttggtgtaaaatgagaattggcaatgcatatttaatccttctctaagatcacttccaaggcataaagacagtaggaaaaaagtgagtagttcattattaaaaggctgacgtccagcacacttacactgcccattcaagcttctcattcttgattgagttgtacagagcctgtaaagagagaaaatgagatcacattattctttccattctgttccacattttgaattcagcaaatgaccaagtaattccttcataaaaggataggcacgaagccccccttgtcagtcaccttgcttttagaaaggtgaagaatacatggggaggcaaatgagcattgggtgaacaacgaacgtttcatgaaacaaagaaactttcacaaagttataactgtcttttatcaataaggcacagtactgtactacatttcattatagtaaaatattaggatgtgattaaaattacactgtgcatgctatttctcatattgaaaatatggtcttgtagtttcactcagttggacagtggagtactcatacttttttcttttcttctttttttcagacggagtctcactccattgcccaggctggagtgcaacggcacaatcttggctcactgcaacctctgcctcctgggttcaagtgattctcttgcttcagcctcccgagtagctgggattacaggcgtgtgccaccacacctggctaatttttgtatttttagtagagacggggtttcaccatgttggccagactggtcttgaactcctgatctcaggtgatccacctgcctcagcctcccaaagtgctgggattagaggcatgagccactgtgtctggctgctttttttttttcgttaatgaaagaaatagaattgttttcatggcaaattaaagagtaagatacttggtagggggactgaagccagacatggaaaagcatcttaggatagttttagagtttcgataccactgacttaatccagtttttattataaatgtaacatcccaattctgccttacagttaagtattacattttgggtgtgtgtggttgtggcagattggataaaaaacttctttagacccttggtaacaataatggtaaagtcagcacaagactgctaccctgattctcccagctctagcattacaaaggtccttgtagtcagcttgttccactataccaactaccgagaaacatttttttaagacacagggtcttgctgtgtttcccaggctgcagtgcagcgactattcatgaccatgataatagtgcacaacagcctcaaactccagggctcaagtgattctcctgcctcagcttcctgaacagctgggactacaggcatatgccacagtgtctggctttacctttgaattttaagtaagatgttataaggaacacacaaatgcatttctaaggtacaaaaccacaagagcaaattatatttaacaaaagaacggtatgcataacaatattatgatgatgttggaacatttttcctcaaagaatgacttggatcaattagaacttgaaggcttagccaagacttcatttactctgagatagaaaaaagggggatcacatgtcatctaacctcttgtctttcaaacaagaaaaggcaggttcagaaagttgtccaagcagcacagcagagcagaactgccttgtatttctatcctttcgcccttaacattgtctcattcaagtgtttacatgtgtgtaagcaaacaatgcacaccaatagtaaattcacttttcagcaaaatacttccaaattcagtacaaatttatttaagttgtagaatttatattatttacgactcaatacgtgtattcttagccagtatcttgacaaacttcatgaaagttctcaattgtggcttcatagtcaattcaactattgaaatattacagtagctaataaaaaccaggtcacattttatatttttcaggacatgataggtattctcaaacacaaaagggatagaacgtacaattaaaatacggagtatactgaggcacaaagactatgctataaattgcatatttgttttgaagaactcaggattactgaagagatccaatctatgatatagttaatgtatcaggaggctgaacacctatggaagtgcagagagagttgaaaactggctcaagtctcaggagggctttcgttggataaacgccttttaaatgaattatattacttgcatgagccattttgaacccacaagtaacagtgggctgagaaactacaaatgaaaagagacagatcattaaaggttctttagatgctactatcatactcaatattacccagagtaattcaaaatgtggcaaagatttttaaaaaatctgttcataaaggtagaaagtttaaatgaccgctaaacagctaaaatttttctaatacattcatttctgttctagcacaaattttttcaaatactttttccctcaagaatattttgttcaaagagaagtagaattgtaaatttaaaaattcttgctattcaatcagccagatatctcatgaagataatctattataaatcatcttgccgaattccacagacttgcagtattgcaggtcaagtcctctcactgtgtaaacaacatagaatagaattttttttgtagcatgccgaatccagacagtgggtgtcatccctattcttttcaattgcaaaattgcaaagaattttccttgttctttgtagtgctttatcacaattattatttttcttaataaaaggaagacgctttacaaatgcatccaaaacttaaatacactctcaacacaacttcccatctttttatctactcagcctagttaagaaatgaattcccttgattcttctttatctctaacctggcagtcattacttcctttcccgtgtagcctagacgtcatagtctctcacctccaccagtctagttagtatcttcgatttctttgttctgctgttgtacatgaaaatattaatagatactatataattcttttttttttttttttgagacagggtcttgcttggtcacccgggctggagtacagtggtgcagtcatagctcactgcagcctcaaaatcctgggctcaagggatcctcttgccttagccttctaagtagctgtggttacacctatataactcttgatcaatcctactctgatttctccgtatgaaaatcctacagattagttaagatttcttttactttcaaatgtcaaatacctaaacactaccttaagggtaaggaggcctaataattaatgtagtcagatcataaaaagtatgctctagtagcctcagggatccaggaatttctctctcatctcaattcgcctctttctaccccaaccatctgcagtccttgtttctccactacacaagaaacacatccaaaacaagcaacaccttttcacagcttgtctctctcaatagtaacaacaacaaactagttatttctcccagctccagtatgaaagttcccagtagaggttcagttcacctatccttcccatggacagatctgcgtggctaggagaaagttctatgactcggcccatctctgaagccaaggggactagggggttgtggggaggtgggtattaatgaagggcagcactgacctagccactaataatcctcctgaacttcgcagcctcccctatttgtatgtgactaattcagcactactagagaaaattaaacaatagaacaaattaatgccattgaatattcatcaactcaaacttcagcagggtcttcattcatgagcctctcgccatctcctctaaaatgcatctgcactagcacctatttctcctttctgatggtaagggaagaaccaacaaaatgggatttcagaactgaactcagagatcatgaaacaaaggtttccttatacggatgaggaaatgaaatcccatgttaattaacttctctccacattccataacttgtttttcacaaacactgactcaagtaaataacacttcatgtttacatcaactaagtacattgtctcctcctaagaccaaaccttatagcatcgtatatgcctggccaaagtcagagcccatttgaaaagataataagacttgtgcctctcttagaatatattcaaataatctggtaatgttctattcttaaaagatgagctttaaagagccaccgttgctaggacacatgcttgaagcgcctttgttggtgaggatgatgggctggctgcactgatcctatactcttagtccatttaggaccaaaggcatttgtcatgagaatggctaaaactggaggcatagtctatggctcagaaaaacaacttatctccagctatgtgaggggttatctggcctagctgcaagagggcagggtttggggagaaacattgctatggactggtagttagagctaagtggagaaagttaccacatggaccttaatgggacagggcagcccatatgaatacatacagtgaagcgataactcactgtggaaggctgaagaatggcacccctaatgtccaggtcccaatctctagaacttgtgaatgttaccttatatggcaaaaactttaaagatgtgattaagttaaagaacttgagatggggaacgtacgtgggtgggctctaaatgcaatcacaagtgtctttatagaaggcagacggagatttaagaaagaaaagaaggcaacatgaagaggaatatggaaattagagtaatacacacgtaagtcaaagaatgctggcgaccaccagaggttagaagaggcgaggaagagacttttcccctgaaccctccagagggtaaaaagccctgttgacctcttgatttcagacctctggcctctgcaattgtgagaatgcatttctgtttttaagacaccaagtttgtggtaatttgtttcagcagcccgaggaaactaatactctagcgtactagagaatagcagatacctagcaaagaatgatgatatacccacaggtggatttcaggaaatagttccagggtcagtccctaggacaaacagtctttccccacagtggtcttatctaaagatgtgacagtgcacaagaaaatcaaccgaggaatttttaaaaacactgattattgtgccctgtcctagatctaccacatcagctccttggacgaggaaactgcatgaatatttctaaatgctccacatgtaactctgattggaagccttggttaaaaaatcactgctttgcaagcttaccaatcttttatctaactgtaatttctgtaacttaaccccagagccagatcacaatcacatacctctctcgacactagccaggacagaatgactctttgaatttgaagatcatcatttttaagaataacaaagcaaagaaaattgcttaaattacagaggtaaacatattctggtctaaatttaattttaagtcgttgttcctcacttttggttgcttctcagagacgataaaatgcaattttattcaaggctttagtgctgtcattgccagcccacacagggctctctgaagcttttctacattaccatgcattgtgtaaccgtgagtctctctttctctctccaacatattttgcacagttgatggaattcgtgtattttagttcaatcatctctaaactccaatgaatttttttctctgtggttcctgaatcattatgaaaagtatggaggatatcacagcttccactttcagtgaaactgacagtgaccgcagtggaatttgtactcagaaagaattatgacaccatccgtaccacaattctctctttcaaatgctatgctggctctcatgcagatacttagatcaagcagactgttaagtatagaattaaatatgcaccactctggcagtgttatcagagaaagagcatgtttgaaaaagacactggttaaaaattaatgataaaaccagttattagataaatatcaaaatggttagaaaaactcaaaatactttgcaatggtcttcaacttctactatcgtctctatgccttaaaataatattgaaaaactgcactatctctcactataggaagcttctccaaaactaggatttggaattgactctttttttgccccctccgcaccagtggaggtccttacaccttgcgatgtaccaaataaggttataggtgagggttatgacttttttttcttaagtggcaaagggcaattgttaagcagagatgcaaaaggagaaatagcctgaaggcttgaccacaagagaattcacaggtagatccattttagggagaagtacatacagaagatgagtttctggaaatggattccctttaagctatttgtgttctcccgtacccactggacagttttcacatgcccaagtttaaagagcgccacattagagaatgtatattcataagcaacctggtcaacattcatcttttcagctcttatttagggtaatagaacatgcttgaattttttttttttcacttctatggtaagatgtagttttgaaatcgagtcaacatgtaaacagagctgaaatctgtatctcgggcaattagtcttatgttgtgatgtacttccaaacccagtcacagtcccaaaaccacctaaccatgaatagatgtcccagcacaaattcgtattaatgaacactagaaaattactcttcaagcccttatcttattgaaagagaatctgaagtataattaatatgtataattcatcatgtaatcatttttaagcacattccagaggctagggaggcattatgctaggtacagatgaatctgttctgtcttcagaggcctcttatataaggaatacaaaatgtgctgctaaccctgactgaactttacctagtgaagaattagtcagctaatggagtcaactaatttttttcctacttacaatgtgtgagacactttcacacacagtatctaatatgtgacattatgttatacatattttcttgagagaaagatttgataaaacagagaacagatccaatcttatgagcaaagaatttgaaacgggtgggtggggcacctatcactgacttgtacatttaagacaaatcaatttacctggccctcattttctttacatgcaataggagagggctgcataaagttagtgttctttgcccccttccagatctactattttacaattcagcttgagaaagaccttagctatcacccagccaaactcccaaactagtcctttctttagtctctgctcccttttcctgtgttcctcactaaatattttttgccatggtttttgatcaatagcatgactacctgctctcaaatcctaggcacagcttttacagattaataaatgcacattttaaaattgcaaatgaacgaacaagaataggagagggagtgggagctacagcaagaaagccagagaaatattatgaggtgggggaaggggagcaatgggactctgactgcttcttgtcaaatgcacctttctgagctacaacagtttgaaccaccatttcttcattattactgaagaaaaataaggtagccaaagacaatactaactaaacacacctgccaaagaatatggccagcatctctggggatgcacaaaatcaaacctgaaagtgaaggccgggcgcagtggctcacaaatgtaatcccagcactttgggagccgcagagggaggatcacttgagcccaggagttcgaaaccagcctagccaacgtggcgaaacccagcctttactaaaaacacaaaaattagccaggtgtggtgacacgtgcctgtagtcccagctacttagaggctgatgcaggaggattgcttcaaccagggaggtggaggtttcagtgagccaagatcatgccactgcactccagcctgggcgacagaatgagactttgtctcaaaaaaccaaaaagcaaaaaaaaaaaaaccgaataaaaatgtaattgctaattatcttttgtactaacataatacttcaaagttttactaatgtgtgtatgcattcatttatttattttgggggtggacttgatcaataagatgtattcaaacacagcacatttctcctaaactacttttgcttcaccttgagattaccttctattgaactggctgttgtgtctcagagaaagtgtcttaactatgctagtatgaataacactattctaaatgtaaacaaaacattaagattgctgctaagttctttgtagagtaaaggttttaagtatagggatacctcactgtattgtgctttgcctcactgagcttcacgtatacgataatgctttacaacttgaaggtttgtggctaccctgttttgagcaaatctgtcagtgacatttttttccagcagcacagtttcactttgtatctctctgtcacattttgacaattctcacaattcaaacatttgattattatatttgctatggtaatcagtgatctttgatgttactactgtaattgttttggggagccattaaccatctccacataagatggtaaacttaataaatgttatgtgttctgagcactgcactgaccagctgttccctaagatacaacaatactgaaattagaccaattagtaatcctgcaatggtctctaactgttcaagtaaaaggaagagttgcatgtctctcactttaaatcaaaagctagaaatgattaagcttagtgaggctaaggctacgctgaaggtgaggtttcttgcaccagttaaccaagttgtaaatgaaaagaaaaagttcttgaagaaaattaaaagtgttactccagggaacacacaaaatataagagagtgaaacagctttattgctgatatggagaaagtttaaatggtctggatagaagatcaaactagccacaacattcccttaaggccaaagcctaattcagagcaaggacctaactgtcttccaccctgcaaaagctgagacaagtgagaaagctgcagaagaaaagtttgaaggtaacagatgtcggttcgtgaggtttaaggaaagaagcagaccctgtaatataaaagtccaaggtaaagctgcaaccggtgatggagaagctgcagcaagttatccagaagatccagctaagatcactgatgaaggtggctatactaaacaacagattttcagtatatacaaaacagccttttattggaagataatgccatctaggactttgatagctagggagaagtcaatgcctggcttcaaagcttcaaaagtcaggctgactctcttcttaggggcaatggggcaatgaagctggtgaccttaagctgaagccaatgctcaagtatcattctgaaaatcctgaggcccttactctgcctttgctctttaagtgtaacaacaaagccaggatggcagcatatctgttgacaggatggtttgctaaatatttttagtccattgtcgagacctattgctcagaaaaaaggattcctttcaaaatgttactggtcattaacagagcacctcgtcacccaagaactctgatggagatgtacaaggagatgactgttgttttcatgcctgctaacacaacatccattccgtagaccatggatcaagaagtgatttctactgccaagtcttattatttaaatacatttcacaaggctgtaactgccatagatagcgattcctctgatggatatgggcaaagtaaactgaaaaccttctagaaaggattcaccattttggatgtcttcaagaacatctgtgattcatgggaggtcaaaatatcaacatcaacaggagtttggaagaagttgattccaaccctcatggaatgactttggggggtttgagacttcagcagaggaagtcactgcagatgtggtggaaacagtaacacagctagaattagacgtggagcctaaagatatgactgcattgctgcaatctcatggtaaaacatgaacagatgaggatttgtatggatgagcaaagaaagtagtttcctgagatggaaactacccccggtgaagatgctatgaacactgttaaaatgacaaaaaaggatttagaatatgaaataaacatagttcataaagcagtagcagggtttgaggggaatgactgcatttctgaatgaagttctactgtgggtaaaatgctaacaaacagcatcaaatgctacacagaaatctttcatgaaagagtctacagctgggtgtgggtggcgtgcatgccaatggtctcagctatttgagaggctgaggtgagaagactgtttgagcctgggagatcaaggctgcagtgagctgtgatcgtgccactgcacttcagcctgggtgagacagcgagacccagtcttaaaaaacaaacaaacaaaactaatgatgcagcaagcttaattactgccttttcagaaattgccacagtcatatcaaccttcagcagccaccaccctgattagtcagcagccatcaacatcaaggtgagaccctccataagcaaaacgatgacaacttgctgaaggctccaatgacacacataataaactacagtatagtgtaaacatacctttttttttgagacagtcttgtgtgtcacccaggctggactgcagtgtggcacgatctccacttactgcaacttctgcctcctgggttcaagtggttctcttgccttagcctcctgagtagctggaattataggggcacgccactgtgtcctgtttatttttgtatttttagtagagacagggtttcgccatgttggccaggctggtcttgaactcctgacctcaggtgatccgcccgctttggcatcccaaagttctgtgattaaaggcgtgagccacctcacccagctgtgtaaacataacttctaaatgcatacggacaccaaaaaattcctgtggcttgctttatcgcggtatttgttttattgctgtggtctagaactgaacctgtagtatctccaaggtctgcctgtttaaagaatttttcccctagttacaactgtaaacatctaatgaactgattagaacattaagtccaaatgctggttcatcatcaaaaaacaaactaagagttacaactcaaatatctcgtaacagataagtcaggaaggccagggagagactccgggggtttggagaaagctccatgtacaaggtaagctagcactcagctgtagcctgatttcaaccaagtgggaatgtagcttcactattgcttttttttggggggtggggggaagtagctggaagcacacattattcaaggctggcaaatgttcaagtatgtcaacagagagagcaatgtaaactactgtgggtgagacaagcacatccactatcaaagaggacaccaattttgaaacagattggaatgctattgtgtccagaattggtgggttcttggtctcactgacttccctcgcggtcagtgttacagttcttaaaggagacgtgtccgcagtttgttcattcctcccggtgggttcatggtcttgctggatgtgttgggagttttttccttcttgtgggttcgtggtctcgctggcttcaggagtgaagctgcagacctttgtgttgagtgttacagctcataaaggcagtgtggaaggggaccccagcgagttgccactggtggctcaggcagcctgcttttattctcttatctggccccacccacatcctgctgattggtccattttacagagagccgattactctgttttacagagaactgattggtccattttgacaaggtgctgactggtgcatttacaatccctgagctagacacaaaacttctccacctacccactagattagctagatacagagtgctgattggtgtatttacaaaccctgagctagacacaaagtgctgattggtgcatttacaaaccttgagctagatacagagtgccgattggtgtattcccaagcccttagctagacatgaagattctccaagtccccaccagattagctagatacagagtgcccactggtgcctccacaaaccctgaggtagacacagggtgctgattggcgtgtttacaatcccttacctagacataaagattcttcaagtccccaaatagatttaggagcccagctggcttcacccagtggatcctgaaccaggcggcaggcagagctgcccgccagtcccgccgtgtgcctgcactcctcagcccttaggcagctgatgggaccaggcgctgcggagcagggggcggtactcgtcagggaggctcaggcggggcaaggagcccatggcggggtgggggaggctcaggcatggcgggctgcagagcctccgagccctgccccgcagggaggcagctgaggcctggggagaatctgagtgtagcgccggcaggccggcactgctgggggacccggtgcaccctccacagctgctggcccagttactaagcccctcactgcccgaggccagcggcaccggccggccgctccaagtgtggggcccgcggaagccacacccaccaagaaatcgcgctggcccgcaagctccgcgcgcaacccgggttcccgcccaggcctctccctgcacacctcccagcaagctgagggagccggctccggcctcggtcagcccagaaacgggctcccacagtgcagcggcaggctgaagggttcctcaagcgcggccagagtgggcagagaggccgaggggttgcggagagtgagcaagggctgccaggactgccagcacgctgtcacctctcactgtgattagaaattgtaaggaggaaacagtaagaatcactgaacaaacacggcaaaatttccaatttttgatttatagacaaacttctgaatatttcatgtttcgcctggtatttctgacgctgcgatgatgttctagccatttcaaataactgatcttcctctgataataactatcaatgaggccccactatgtgatactgctaagagcctgactttcacttgatctcactgaactctcacagcagccatatatgagagaggtagtattattcccactctagaaatgccacagctgatgcctatgaaggttaagtaggctgccaaggtcatacagcagagctgggtatctcagacaggtctttcctaagccatagtctctgcttttaactgccctaatcacaacacaatattgtcaccatgtaagtatattattatgtgtactgttcacatacacacctgtgtacatatatacatactttaaagtcagtattatgtgtattgttcacatacacacctgtgtacatattattttaaatatagataatcagtaataaattttgcaactctgataaatgtcttgcctagaaatcagagttaataaagttaaaagtaaacaatgctatccacagtattacatttcttagcttttccttttgttatatcagcttaggccttcttattagtttatttaaaaaataatgttttcacagggaaagatatccatcatcctaagttcacggctaagaaaacttatgatcacagtgcacatgaattgatggtttatagttcaaattctcctttaacacatcactgactatttataacttgtctactccatctccctacatagcgtaccttgcttaatgcatcctcattgtattagtctattgtacaatgaccacaacaaatatttgattataacacatgctgatatatgaagggaaattgttttttgtaactactagacactaattagaatgtactttttctgatacagtagtctcccgatccttgggggaatatgttccaaggctcccagtggaacatgaaaccacgaatgggaccaaaccctatatattgtatgtttttttcctagacttacatgcttataaggttgaatttgtaaattagggacagaaagaaattaacaataactaataataaaatagaacaatgataacatatgccagcttcactactcttgcactttgcagctattattaagtaaaataagggtgacttgaaggcaagaactgtgatgctgtgacagccaatttgataaccaacttagctagtaagtgactgagggcagggagcatccacagtggggaggcactggacaaaggaaggattcgcgtccacatgggatggcacacgacagtgagattgcatcgcactacgccggatggcatgagatttaaaacttatgaaatgtttgtctctaaaattttccttttaatgtttttggacgatgtttgatggcagttaagtgaaaccatgagtaactacctgaaactgcagataaggggcgaatcccgtaatggtatagcatatggtataagtattaatacagtaaagtattttataacaactagaagactaattcatgtttgtaacacttataatagtaaaaataaatcccttaaaaccattcatttattcattcatatattcagttgaacagttatttatttaggcatcgtgaatccagtggtgaacaacagacacagaacttagatttgagtggggtggaagcaggtaataaataagaaaaataacagatgacgataattctgtcactttctggtaggctaccagataattattataaggtgattcaaataaggtcactggaaagagtagccgtagcctggatggtcagagaaggcctctgggcaaggaaacgtaagacgtgagtgaccgggagcagccacgcacaggtgtggggagcgaggtaagcagctcctgggcaccactgaaccgggtgggtctgagaaacccagcggggctggtgcggctggagcaaatgggcccagctgtggtgtgagcaggtcccgaagggcttttaaaccagaaaagttagaggtttattctgtgctggccgggtgaccactagaggattttaagcgggagggtgacctgctgtaattcatgtttttaaagggtggctccgcttctgtgtggagaaaggattataagagaaaaagggaaacagcagcgaggcaggtggaatctgggtgagaggtgaggtaagttgactgggatgaaggcaggcagtggcggattagggacggatcaggctgtttttctaaattatatgagaaaggtggaccattttcacatacctcaagcacaaataaaaaactgggtacaacgaacagtttcaacagtagcaccagaaatgtatcattatgatatttaaagtcatttaagctaagaaggaggtaaatacattaagagataaaggaaagaagtaaggtgcaaaacattgttacggtatgtttccattttgtgggggaaaaatgtgtgcgagtatctgggcacgaatagaacatttctgaggggatacacacaaccccaccgacaatgactgactccggacacagcaactcggggagcagggtggggggattttcaatgtataatcttctggacaatttgaatgttgaccacacagtgtacactttgcttcttcgatgaaaaatagagatgacattagattttatgctccttgcagatgagatcaagtcttccatctccctttagtctctataatgcttcgtaagttgtcttaaccacagcgagggtttcatttgctgagaaggcaagggcttcagtgaggacgatgctgtataacacaattatgatgggaggcagcaaaggcaggaaaaaagaacaataaactagaaagctgcagacctagattcacacctgcttctacgtcctaggaagtaagtaggatgactccacttcgccgatctaggagctggaggttaggcagattgttgcttggtgtaggttgaaagttaccagatcaaatgcaagatgctcacttaaatttgaacttcagataaataataacatttctagcataagcatgccctccaattttacatgagacacactaaaaattgtctaaaattaaaatttacctgggtgttctgtatttttatttgtgaaatctggcaaccctatgccagccacaactctctttccaagaggtaatgtagttatgatctgagtgaatcactttctttcttatacaatgaattaaaggttaacttccaaggtattccacagcagatttaactattcttctttggaagcaccatgattccagaagccattgtgttcacagtcatctcctgattttgtttttttgttttttgtttttttttttgagatggagtctcgctttgtcgcccaggctggagggcagtgcgcgatctccgctcactgcaagctccgcctcctgggttcacgccattctcctgcctcagcctcccgaatagctgggactataggtgcccgccatgacgtccggctaattttttgtatttttagtagagatggggtttcaccgtgttagccagaatggtctcgatctcctgaccttgttatccgcccgccttggcctcccaaagtgctggaattacaggcgtgagccactgcgccgggcctgattttgtttttaacttttataccctgatcctctgaaactgtaatttatcaatttatcaaaaacttgtctagtttagacagctaaaccatatcagtgaaaaacataaccataaccagtattttcaataaagattctggaatgtacttgatgaaatttgttaatgtccatcttgttggtaagccttaagtgttggaaagtagcaagcatgtaccataataaaaaatgcaatttgagaacataggaaaacataaatttaaagtgaccttgtaaatatatgcaatattttttaagtacccaagaaaaacggtcaattatatttaataactatggacatgatgaagttaacgtgcacagtttattaaaaaaaaaaacttgctgggtaacaagcacaatccttttaaataaatggcctgtaaaaaaaacaatccctgggggactttgacatttagagagaatgccaggcctggcatttgttccctgtcatttccatgcattagacaaagcaatgaagacaaaccaaatggaaataggttttattcaaaacgatcaatacaaacaaattaaataatctcacccagtggatagcaggcttcaaatttcataaacaggaaaatttgcaaaagaaattttagggagctaaatagaattgccagtttttcgtttagctaaatgagaaaataaattttttaaagaaacaaagcaccaactattatcggtattgttgcataaaaataagttgcatggacaatctcagaagagacaactgtttctcaagaaaggaccagcctttcactgatattttgctatagactaaaactgtgacagcaactagcagcagaacatggtctagtctgataactgctagagtataaagtcttggaagagatgaaaccttttgcttttcttaaaaagtagtctccattacctggcatttgttaaacccaaagttaattaagataaacaaaagccattctagtccctggaaattattccagtctcgtatgtacctatatatgctgtctacattccttctgattcattaaaaaaaatttctcaaggcaatatatgtatatcatttatataatcaaaaattactaaaaggtatgtaatacaaataatcttttaacttcacctctgattcttgctgctcaaaagtcacctctttcaatctctttttggtttttctattttcaatatgatctattgactttcaactgcagaactctggaaagtgaacatttatttggttctcttaacacacacacccatccacacacacacacacacccacacacaccctgcccgtctctttctttccactcccatattaaaatcataccacagtcacaatttgcagtttcatgaattttcagtcctcatattattgtgactatatagacattattcatggggcagaacactaggctacgtttccattttttgtaagatttttgatttccctggagttaatcatcatcttattttgttgttgtttactcagttttctacgaatctatctctatgtcaacttcacaccctccagcaggcattccttcggtgccatggttggaagcatgtctcttggcatcgtctctgcccccactcctctaatctggctggtttctatctccggcacagctgttgtcccagggtttccctttgccattgtcctggggattccctctccccctctgctctactggacaccatgtcttctctttcacttcttcaagcaactgagaaaaagtacatgagaaagtagagagggaagagacgccctgctgtgaaacgtttatacctttcactgaatcctgctattttcaacgtggggatctccccgtgggcctcgactgagcctaatttcctaagtccaaaacctctggattaaacttatcagagagaaagaacagaaaattgtagggcgggcaggggggcatgctggctcatacctgtaatcccaacgatttgggaggccaaggcaggaggattgcttgagcccagcagttaaagaccaacctgggaaacaaaacaagaccctatctctacaaaaaaattaaaaaatgagctgcgcatggtggtgtgtgcctgtggctcctgctactctggaagctgaggacttgggaggattccttgagcccaggaagtggagggtgcagtgagcagtgatcgtgccactgcagtccagactggatgaaagagtgaaacttgtcttaaaaaaaaaaagaaaatggtgggaggaagggtatgcggctatcaaagcaggggagggcattcagaaggtcgacttactaattttagaggctttaaagggctgtcctcgttcgactcactgccctcagaggtagccagtggcccccagttcctgggccttccctgcgttctgtggggacagattgatctatttctttctttagtatttggcatccagtttttttctgtggaacttaaatagtgaacacgtctatctggtttccatgtttcaaagtttgctgatgttttgaaaaatcctctctcattctttgggtccttgaaggtctacgaatcctactgtcattttagtggagtttaggtgggtgtaaagataaaagcacactgttaccttaaattctaatttaagagttaagtttttttgctatatgtaaataccacttaatcacagtctaagagatcacagcagggggtggatggggcacagaaaatctcctcaaaacactgtccaaccatagtaagagtattccaaatggcctttttattttacctgtttttaagaagatgtattaagaaagaagtgtggccagatgtggtgtctcatgtctgtgatcccagcactttgggaggctgaggtgggagaagcatctgaggtggggtgttcaagaccagactgggcaacattgtaagtcctctgtctctacaaaaaagttaaaatattagcctggagtggtgacatgtgcctagttactcaggaagtggaggcatgaggattatatgaggccaggatttcagggctacagtgaggtatgttcttactactgcactccagcttgggtgacaaagtgagaccctgtctccaatttaaaaaaaaaagcaacaataaagaaaagtgtcatcaatctatataaatctgctggacctttatctgtccctcggagtgacagtcaagagctgcttctctcaaagtactttcttgtatctgtacgtctagttaggtaggacctcaaccctttagatttacttatgctgggagaccttagaagaaaactgtaatgaaaaagctcaataaggattcgttcccttgtcatgagccactggggcaccaggatctagagaaggtcttactgcttcctgtaaacaccttggcctgccccagtggatttctgagtagtagagctgacgctgacaccactaaactgcagctgagtgcaagaaggagattagactgtttgagatagcttcgtaatcttatttatttactggaatcaaacacacacttggctcaccagatttgaatgtggcagtaacgagtacactagtgtttccagtgccttggggggcatttcatgttgtaaaacttaactgcaggctacaaacaatggcatgtcataaggggagtcaggctaggactagagcctcagccagcccgttcagaaaaattttgatattaagcatttcaaagaatctacctagaaaaacaaattccaccgatatcaggtgatctacgtgtccaaacaggtacactaaatgtaccatcggaacatggtacagtggattttaaaaaaagaaataaaatctgcttgaatgatagttaaggcaaagcttaaaaatcttaattaaaattaatgttagaagagcaacttccatcataaattaatatcataaattaacaagcaggaagccatcttgcacagctactcttggtctctgcttcactatggatgagtaaataaaaaatattttccaaaaatctcctattagactctaagctggacgcaatccctaagctctaagccaggcatgatctaacaacaggttgcagaatagcttgtcaccatacatattcccacacagaagctccttatggtcaacttcaggttatcatgatgctacgaaactccctgatcttcggcagtgactatctttaaaatgcaaatatatatatatttttttctctttcgactcctatcattattgcatagagttttctttttcctttccctggattctgaaaaggatattacactaagcttgccaggaatgacagcatggaccagcattttctctacaatgttcaaatactgcatggaagttctcaaacacctgcttcagtacaccttccccaaaagaatgtgttcaaatacagtctactcataaatggaggggagcaagaatgcagtacgaccttgggagttagagatgacacaacaggagtgggacgcggcttctccttcatgtatttctttcttcttctcttcacaaaacccacacctctaccacctcactgatgccatacccgctaaccctgaggacttagtcacacaaagaaaagagccattctctctgctctcataatgtttaaatatgtttcacttagtccagaaactggccttaggagatttaacaggaaaccaagattgtggagtgtcctatcctgagtaggaaatgccgaacaattgatttacagccttgttgctgctggccagaccagcgaggagcccatcactcgagataactattacaaccagatatgctgacccgcataccctacccctcttttgtgctttgcccagccaagcctgtatactttagccttgataacaatatctgtgctttgcctaataaaaaaacacctaccagcttccccctgctgcttcctgcagagccagtcagaggaccctgtgcctcacctccactgtctcccttgtgcttgagcacaagccctgatttgaaagcctcatctgggaaatctgctcggctccatgttaatttccattacatgggaagccaaagagcctgcggtctgtaacagagacatccaaaccaaacacatcacctacactttactcaagtgaaaatgggtaaacagtgatcgtaaagatctgctattaattaaattcaagggtcaagaaatatcactctatcaggagcatagtgtgctcaacatttactcctaagtaatcatttgagcaatcttaaaaaagacatttatttatatgaaagtaccagcaggatttgagaaattcacagatacagaggaactagaggaaggagggaaattaagaggtgggcagcagggggtagctctaacaaaccaacccagtaacaaaaaccattgtcactttgctaggtttcctaacaaaaataaaaccaggtcagcgcagtggctcatgccttgaatgccagcacttttggaggccaaggagttcagatcacacgaggccaggaattaaagaccagcctggccaacatggcaaaaacccatctctattaaaaataaaaaaaaaatagctgggtgtggtggtgcatgagaattgcctgaacccaggaggcagaggttacagtgagcccaggtcaggccattgcactctggcctagaagacagagcaatattgtgtaaggagtgaaagtttttattttggggcaagtctgactcaagtcatcaacttaaggggaataaacagttatcgataatatgaaaatgatacagataatgataatctgtagaactacgtccctgaagaagtcaggtctctttttaagatctcctttggctaaggatcacagtaaaacattagaacatgttgactgggcacggtggcttacgcctgtaatctcagcactgtgggaggcgaggcggccagatcacgaggtcaggagatcaaaaccatcctggctaacacggtgaaaccccatctctactaaaaatacaaaaaattagccaggcgtggtggcgggtgcctgtagtcccagctactcgggaggctgaagcaggagagtggtgtgaacctgggaggcagagcttgcagtgagccgagatcaggccactgcactccagcctgggcagcagagcgagactctgtctcaaaaaaaaaaaaacaaagtaaacaaaaaaacccacaaaacattagaacatgttaatctggcagaataattaatacctggtgaaaaagtataacttaacataggagagccaagaaaagaaaaataggcttctgaagataaaattgtttttatctttgcactaccagatttactttgttcaacacaccacctccctaattccttcaaatgccaggattagaactagtgcaggaggatgttgatattttgacctaatagtttaagttgtttaaaaaaaattctccttgggagctcattagactgaggtacctctggcattttaaatttttacatgaacaaaccaaaggccaatgtaaacagtaaatggaaactagaaaatataccaatcagaaaccatcaacttcttttaaaaaatttatttttctttctctctgcctatcattctttccaccaactaacttccagccaatcaaaactgttctcttcgccttgcttctgcaaatactacataagagttttcccagctgggcgtggtggctcacgcctataatcccaacgctttgggaggcctaagtgggcggatcgcctgaggttgggagttcaagaccagcccgacaaacatggagaaactccgtcactattaaaaatacaaaattagccggacgtggtggcgcatgcctgtaatcccagctaacttgggaggccgaggcaggggaatcgctcgaatctgggaggcagaggttgcggtgagccgagattgtgccattgcactccagcctgggcaacaaaagcaaaactccgtctcaaaaaaaaaaaaaagttttccttcttgcacctctcatcagagtgccagccccttgtggtttggtacaaccctaatttatgcatccctgaatgttcaaactcttgaaaatgtatatatgcttaagtttttcttttaataaagtctattcagctaaaggatgaatttatgaggttaaaaatgtactccttcaacttaggaataacaaaaatatgtaaagacatttgcaagaaaattttcatattatgactaagaattttctccattttaaaataggcagatatcaatgtcctgtttgaccagaatctccttcccaggctctagccttagtctaaagagcaaaagtggtctaggaagaaatgacaacaatctgcaagcctgccaccaaaacttcaggtcgcaaagggccattgtaatgatttcttcaggtttctttgtgtatagctttaactcacagaggaagcaatgattagcagttatctaacaatgcaaaggaaacagcaagtgaagcctaagcagaatggggagaatagaggtgatggtgcctttcaacattattgcaacacgtttttaaaaagcaatggattaggcacttagcagagcagaggtttggagcaaaggacttccattttcctttaacacgtttatggttaacatctcctagtacaggaagaggtttattcagaatacatataaaactacctttgttaaatctagctcagtctttaaggttccttccacagaggaaataaccccaccaacctcggcaagatttctaaaattaacagtgttcagaacaaagatatcattttgtcaaaaccctgcattttagggatgagtcttggggaggtgaagtaacttgtctaggtgaacattgctacttagaaagcaaaaccagggtagcccgccaggatgcggcatcctgactgagaaaccaacaggccaatgtttcactatgcaccaaccaaagtaccagtactttactggaagttcttgaaatttcggtgtcacagaaattgatttctttgctatatcactgaataaaagctttaaacggttcacttgaatcaacattattaactagagaattcttgatctaatctctagcatcatgcttattcctcaaaaaaggcctcaaggattcagccacgcatgttatattaatccactcatgtgacattcacctacaacaacataaagaaacaacagtttgagattccgcctcatttaaacggtatcacgtagtttggcaagagatggggaagaaaagagtgtttatcaacatgaacttttacagatttatgttttaaaccataagttaaaaattagtactagaataatttatatttgacaaatatttagactcagaggaggactgtggaaatgtctgggagaactgaggcttaaatcaacattttctaatactgcacattccaaattctggagtacagttggccctccatatccatgggttttgaaaccccaagggtacccgaatacccggggctgattgtattctacttttaggaaattgtttctaaattagaaatcaattagaatctaattgattctaaaatgttacttctgtcaaaggcagagcaaccagctggatctgacagcaggaaggtctgcactgccccctcatggccagaagccttgctagtaactcttccaataacagacacccaatgaagagctgagctcagtcagacttcattaattttaataatgaatgccggtctccacgaaacacatgttcttccaaaacatattcagatttgcatcctgcccatattatgtgcttcagaggttgatacaaacattattatcgagaaaaagacaaagccacactctctctagaggaaatggtaagatttaaacacagaataaagaaaaaaagtcaacacggagaagggggttttaaagaaaataacatctataagctgaattttagtaggttaaataatattcttcagacgaggtcaatatgaaccataaagtactggaaaattcaattttcttaatttaaaatatttagaccaagaaaagcatttaagatatctcactaaaattaaaagcaaaacttctaatcctttccacagtcctttaacactttttttcaaatgaatatgaataaatcagagaacaagtgaggactacagataattaatatttgaataaaccattatgttttaatggccaagaaaacaagctggaaacatcaaagatgaaagtttcaaagaatacaaaacatgtaattccaactctgacaaggagaagcaattattacacctattctagaaagagccagagttctagaaagataacattaaatcccaggagcgaaccacgagttaatggtatcttattttttacaggttgggaagatgacatgagagggtggagagaggtggcaatggggatcttctaatcatcaaattagacatcctgcattttggatgaaagagtcagataatcaaaaatgctgtttacatgattagcaagaagaaataccagctgggtgcagtagctcgtgcctatcatcccaatactttgggaggcagaggtggaaggactgcttgagcccaggagttggagaccaacctgggcaacatactgagacattgtttctgtttcaaaaaaaaaaaaaaaaaaaaaagaagaggaggaagaagaaacactgatttaagggctaaaaaatactactagatacaagtaagatcaatgaaaattctgattaaaattggaggaaaacgtgtaactgtggataaaaatgggagaagtgatgcttaaatcaacattttacacatgtctattatagtataattaagttcagtaatttagggtacaagcctgtcatattattcagtttatttcatttagggaatataaatggctagtcaatgattagggtcactctgatagaatattctattctactgattttctcttagctctggtgttcaattttaagccactagataatcctaaaaatatctcttgtgagatattgggagcttggctatatccttgaacacatattctgtaacttagggaccacatatgcctcaaaaaaatactaatcatctcttaaaaaccgactataatctttaaggtatcatgtgatggcctactgactacagttctaccagtggccttttatactgttaactcctgcggcgtttgcaatattcaaaaaaaaaaaaaaaaagtgcttggccttctcttccacagatacatatcaagtaaaagtacctgtactgtgtgacaaacacagaggacagtagagaatcttttcatgtggtatctatgctggattccaacattacactacacaaccataattctgggtgaacccactaatattacaatgcctaaattatcatgaggataggtagtaggactacaacagagttaaggatgatgagctcttaatttcccatagcctctgactgcataccatgggtatactccacattaaaacatccaaaacaaaatccagagacgtctcttagtgctcttatagaagccaattttatagccatgttgagaattacatacatgctcacatacatttatttaagaatatgataaaccattctggtctatttcagcaggagaccgcagtcctgacaccacaggtggtctcataacactttcagtagaagccaacacatccctatacaggtcacattaaaggactttgaagacacgtttctctctaaagataaagctttttaaaaaaacagtgaggagtaaaaagccagatttgaagacttactggagccaggcaatttgctaatgacggagggggtcagactccactatgtcataatgtaagggggtgaataggaagccaacatatttcttaaagtcacactaaggtattttgccacctgtcccctgccatattttgaggggaacctgttaatgccaaagtctttcaataatgttatgtcacacagggatggggaggtagcagaggaggagggcagtggggagtggtgggagggtgaagaaagcctgatgtcactctcagtgggtctggatataaccccgagaaggctgaaatgacactgagatccacctcctgacgctctctctgcacattatcaagcccatgaatctccgttataatcatctccatctccagacctggagttctgtgatcctatgattctattattccatttttaaacctgtggagtgggagtgtttctgagtaccctgctcacacagatggtggtgggaagaatctcaagaatatgttgcatgtagtaaatgcccacttcactacgtaatcactcccttcacatttcacacgaacaaagattatattatcttcaagacagctgcaaaaacacgagtggtttcatggcagcatagcatcagcacatatatgtgtaaggaacatgaaagaagaaatttctcttcattacatatgcctggggctaaccactctaaacctgacatgaatgtagtataataggaccaggtcatacttgtacatcagctccacagactgggggctgggggaagaccaggggaggaaaggaaaaaggaactaactgaaagataaaatcatacacaatatctctgtattcctgatgttctaaaaatactccgcactgaaaaatcatttgtcaaggcaacctttctgagaccaaaaacaagatcgatgtgccaaacaacagtttcccacagtcatctcattttgagcacggctttcgcccatctcttccacaaactggctctttacaaaactgacccatgccacagcatctttgtatctggagttcaggtcccatccgtttcacctgatcgcacctgattctcttagaaccattttatactcctcgttactttctcagtctatcactgcacattagacactgccaaagactatccaattctgttgccctgccacacagctgtcaataaggttcaatgtggtatttctttaccttgttctccttagcagaaaactctgaggagttggaaattttcatggactttgacctgtgagactgccgccggatagaatcctcccgggagtatttcacggaacctgaggtcctcacccgtaccttgctggcactctggacactattcacgccaatcattttcgaaggtcaactaaggaaggggtttagagaaataaaaaggcactttccaaccgttccaaggctctcacgctggaggaactctgcggggttgtgcctgagcagctcctgagcgccgtgatccgcgttagcttaagaagcaccaggctgcctcccccagcatcttcaactaccctgtttgcagcgagtctgattgttccaggcacagctcacgtcactggctgcaaagaggaaaaaaatgcaatccacccctgctactcgtctctcttttccacacacacacacacacacacacacacacacacacacacacacacaccccatcatattcacacactggaacgaatggcaattggccaggcaagcaattcattaacattccaaaaagcaacactatttctcttgtgatatttgtgaagtaagctcattaatgtcaacaaccaaatagagataccacaaataaaagtctcaagtaatctccaaggcaccatgtggggtgggaacgtagctgaatttccacaaggaagaaaaaaaatatggatggacgtcaaaaggctcaattaattacaggctagtgaaacgatgcgagacacaaaggcatctcaatgatcaataattttcctttctttcccgtttcaggccacacactgtttgacagcaattcaaattatgttgccattctgaagaattaaatgtttcttatgaccttagactacgacagccagatatttcaagaggaattatgtcagtgtgtacggcaaatccagaataaagatgttctgttacctctctaggagactgagaaaatgactggggggttagcacaggttaactttcaatatggcacagagtgagagcaataaagctaactccgggcaacaagcagcaagcagcttttccaaaagccatcaatgttctgtcagtgtacacagcaatgtgcaagcctctgagtacgaatcacaaactggagattactagaaaacaagaccattttagctcctaacatatgaagtgagttttgagcatactactcaggattgcgatgtctcactatctggcatcccagggacagaggctcagccacataagcgtgttctccagataaaggaggctttcgtgttaatataaataacaaaacttaaacattgtttacaaagaccactctgggaaaaacgtcagcctcaatccatcccacccctcagatttaaacttttcctttacaactcaagaatgtatacacttttttttacaatgtaccaatgttcaaattttgcaacgcactggtgttcttgagcattatttgagataattaattttttaaaaaatggtttaaagtaattcttaaactttaattactaaagttatgttttaatgtcaggtaactgtttccctctactgtcaacaggcccagcagagggtgatgtttgacccttgggttttgttgcatcctcatgacaggggctttcttcctatatcctttacattttttttttttaacttttcatctcctatttttaaagcacttagtgcttctattgtgctataaagaagacgaagacattaatattggtaaaatgttaccatctaaaataataatagattatttttggaataggttttggaagatcttggggactctcctgtcctttgaggtacattttcctctcttcttaggaaactgaagctaccaaataactgtttctcagaattaagaaaaattctgtaaagttactattttacaaagcatattccaaagacataaaaagtggtgtactatagcagtaaaataaaatcgatcatttggaatagacttagttctaacttaagcagacgacgagtctacaggtaaagatctccagttaacaaaagtaagcttgaggtggaacccagtaagaaactaataccataataaagataaaaattcaaaatgtcccgtgtaaaagacatgagcgcctgcctctgtgtggggataaagacagtgcacgggcttaaaagaaacatgccctttggatatttgtcagtcatcataatgaggagttataaactatctcctgatgaactttcttttctccaccaaaatggttagattaaaaaacaaacaaacaaacaacaacaacaacaacaaaaactaaaaccatatggtaggatgtacagaaatggaatctgatacatgtcatttctgggaggtttagcagaaggacgccatctttacccaaagactgcccaattgacgttactcctgtactgtctccactaataaccactttcatcgatctgtttaacacctaataccttacagaagccacttgttctcttgttttcactctcaacatgacaattctgcgaagtgggttgaggtaatattgcaatccccactttcctgatgaggacgctatcacagagccagcatgcagattctcgcatgaagtataccaggaaccacgctgtgtccctcacactatagctgtctgcattgccctgtcctttttaaacctgccatgagcttttctgcaagtcagggagagaaagttttcttctgctcctgccttttactctctgttgcagaacacgtatttctacgtggacagagtgaagagaactcctacaatgctgctagcagtctcacagcagatgatccctgcgacatatctgagtatgtctcaagaggtacctgaaaaagctgtacagacctcagcatccaggggcccttgatgctcaggcctcatcctactgacctaaacttaatcccaaccgcttctcactcttcttatctttgtcagtcaggcctgactcttcattccaggtgagtgcgtggcactttagcttccactcagcccatgcatggaaggcaagcttgcctcctttctgaagctttcccgaatgaccctccatctgctgtcatcctgtctggaactctgttgccccatcctgattcactactaagctggcttctcctcattcagcagtcagctcagtatctttttccaaaaggaccttctgtgaccatccttccttaaacagcagcccagctccaccctagtcattcatttgccaccaaaacccctacttctgtgacttcagggcactcatagctgtttgaaattacctgcatctcagaggccaaaacagaacctggtgaagagccggagctcaatgaccagctgtcaaataaaggaactactttaaatatacaagtttcccttctctatcggctctcacgtcattcaactttcttttaaagaaaattcaggatgggtgcagtggctcactcctgtaatcccagcactttgggaggccaaggcgggcggatcacatgagtccaagagttcaagaccaacctgggcaaaacagtgaaaaacccatctctacaaataatacaaaaaattagccgggcatgatgatgagcacctgtggtcctgactacttgagaggctggggtgggaggatcacctgagcccaggaggttgaggttgcagtgagctgtgatcatacaactgcactccagcttgggagacacagtgagatcctgtctcaaaaaaagaaaatttagcagttttttttttttctgaaaaaatgaatacaataaatacgaaatgatttcccccctaactatacaaaaaagtatgaagtgaaatttgtttccttcccgtaccattttcctgttcagtccctctgcccgaaacaagaactgttcccagtttcctatgcatccttccagagataataagccatccacgtgtgtgtgtccacgtgcgtgtgtgtgtttgggtttgtgtgtgtgcgcttgcccatcccttttcttctcatggactataaatggaagcatgatatatatttttgctatttttttttaagatggagtcttgctccatcgcccaggctggagtacagtggcatgatcttggctgactgtaacctccgcctcccgggttcaagtaattctccctgcgtcagcctctggagtagctgggattacaggcacctgccaccatgcctgggtaatttttgtattttttagtaaagatggggtttcgccatgttggccaggctggtcttgaactcctaacctcaggtaatccaccctcctctgcctcccaaagtgctgggattacagatgtgagccactacgcttggtctatttttgctatttttatttatattttagagatagggtcctgttctgtcgctcaggctggagtgcagtgatgccataatagctcactgcagctatgagcaaagatcctggactcaagtgatcctcatgcctgagcctcctgagtagctaggactacaggcatgcacctggcacgatcacgtcaggctgtttgtttgtttgtttgttttggtagaaatagggtcttgctatgctgtccaggctagtctcaaactcctggtctcaagcgatactcctgcctcggcctctcaaagtgctgggattatgggcgtgagccactgtgcctggccttcttaatatttcttgctcttttaacccttatcaaaatcctgttacattatcacatacaaagccgccttactcttgttaatagcagcatagtattcgagcatgtgaatgtatcatattgtaacagggtcttattattgaacatttagtctgcaatcttttgctacaataatgatgcagtgaataatacccctgcaatgtatcacatcctaacattgaaacaacatagttttccaattgttttctgaacaagtcttattttcttcatcctacattatttcttatcacccacaatcatggtgttaggtacatatggggttcacaactagattcaatatgaaataatcacttcaaagacgtgttggatgaccctgtcctgccccatctggctctgaggccttgaccatttatagacatgagccagcctgtacagagacagccgagccggcttgctataaaataaaagcaggcttcctggagagaagcagctgtttaaaggtacaaaataactttccacaaaagctttagcagaaagtgaaggtgacttccataacaaatcaaaatagcaggagacatttaatgaagcaaactaattaagcggaaggctggaaactggtgcttcaccttctgatgctttctctaaggacaccgtttggtagataaaccctaaaaggcttctaacaagggacctagttaatggtcatcagaaaaactcaacctctcaaaagagtaccagagaaatgaactcaatacacttctttgctgtgtctactaggtaccagatgctggggacacacaacgctgataccatcaggcccctaactttgagcagctcacattcagtcgggggtaggaggtagagagaacaagaaattctgttgccataattataatgatgaatatcttcagagtatcaatgaactgaaaggctttcagatcccaagtgaaatcaacaggagagtatcaaacggcacccaggcagacacttccctctttgctaagaaaatctcacagaaccattagtagaaggaggtgaagactgaggtatgaactctggagaaaagctaaagtggaaatgaattataaataccaattgtctagaggtacaattagcaggataccaagaaggactggggagggaagagaggcatgaggtgtcaagaggaactcagcctcagcctattttcagaacagaatggcggttgtaacactcagttaattcaaaaggctctcatgactttccctaggttcctcacattacatttgcttgtactgaaacagagtaaagtgacagaggctgatttgggagtgacagggcaggggcttgccaagattttctgtccatgtttgtcacgtagcccaacatattcaagaggctagtgctgctgttataaagatgctaatgattaattgtttcctagactattcatttggacttattattagagctgggagaggcctcagcaagaatcatcttcaatctcttcattctatagatgactcctgagacacagaaacaaagtgacttgtccaggagctcataactatgaagtgaccaaactgagacttgggcccaggtttcttaattaccaatattgaggtttctttttttcctcctatgctatttgtttcttgaaagctaaatattccacgaacacatatctcttcagactacattaaggcctgaaaggttatcttgaaatggaaagttcaaggctgggagactgactctagaagtgaaatagaggccagctactcataagaactacgaaaaggagacatgaaaggacaaaatcaactgtaccaatagcgtaggaactggtcttggagtcctgaaacgtatgtgacagctccctgtccttgacctggcaggagtgaggtacgcaacctttcgttctctgagtgctattcctttccatgcggtaacatgactacaaagcaagttaattttgcagagaacgatagctactactgttaaggatacataaacacacaaggtatcatgaggaaaacagatacattggatcaaaacgtactgctttatttttcctgtcttcttccaggcctttccagctaatacttttctagtctagggatctattttgaaccccagcagatggtggcagcctagcttcttctaacactctacaccccaggacaggattcttatcccctagatggtccagccacatgaggcctgatacaggctccactgcctgacatctgagcctgcaccagaaccctgctgccatgtgtcactaacctaccaccttgatggacacaccaccgctttcctaaacgggactcagaccctttctcccagaataaacacttggcccacagtgccgggctacctcttcctcgctgtctggtccgtcacccttcgaccccagcctgctgaaccagcttcagagccccttcccttgatttcccctgccccttctcagaaaggtccaataaggcttgccttcacccatctcaattggacataaaactgcaaagttttttctagcagtggggctacggatttccttagtccataagacatcactagaatctaagctaaatcaaccttaatgaacaatcactataagaattggcggttaggagtaaaaaaaaaaaaatcctatgatttgtacaacctatgaggacgcatcacctcactccagcagccttcaatcttcctggagcatcacacgcttttgattccatctgttcctcaaacatacaaagcaacaggatggggggaaaaatctttaaatagaacgttcttacattgcaaatgaaataacattcttaaggcagggggaacacccgtataagttaaacagttttgaacctggaaaaaaacctcattttttccccctcatgaacaagaccagtcatgtaagatgttttagaccagagtgatgcattagatttgctgtttagaagtacggacaatgcagaacaaagacggcctctgtgtgttcacacacttaactctgtatagctgacaatgccacagtcagctcagacctttccaaccatcatatggaaaacaaacacaaaactgtgaagctacagggccttccggagatcagaaaaacttaccctatatacctgaggcattataaactcttctttctgtgctacaagaaggtattcttaattctagcccaaagtaaacacaaaatgcaaatacagaaatgctatttcacagcctccaaagctgttcatccagatgagtaaaccaataattgtatataaaagggtgagtgctgagaaaatactgtttcaaaagctaatccaataagcccgtccataattatctctaacatctagtgtcaactcaacaaatattccccaagtgcctaatacatgccaatcattgaatctaggaggcaataaaatgatcagagatccctgcccttgtgcttcacatcaaagacaaattattctctaagtaaaaaacaatgccagtcgaagtacatgaccctaggtgcattttttctaaaaaaagattatttgaacagagacagagagggagccactttttgctgtctcattttcatttatcaaaagtcctctaaaattaccaacatttcatttttcatttctttgattagtttgcttggtagtctgggtcacttatgaatttctatcagtccttaataatgtcaagccatatttagtttcatcaaaaaagggtgaccatttggtacaatgtaagagtaactgtaagctctatagtgcaaaagacaaaacatctgtttaaattctgttcaacattttaacttccctcattcactgtgccaggcatgaggaataaaatattatgcaaatccagagagattcctcttcccactgagctgacactgagatagacattaatcaatcaataagtaataatcaaataatacccaaaataaatgtaaaacagtaactgtgccaatacaatggaagagaatcacaaggtactgcagctctggaagtctctgacagcaattggaatgggcctggccttaaggaagtctgggaatgcttccctgaggactttagaaaatgaggcaggatctgaagaatgaacaggagaaaagagggaacagcagtctgtgccaaggccctctgacggaggggtaaaaggtaaaagcaggagcaaccagaagaaaatcaggccataatggagcgggagctgagaaatatatttaagaaggatgatgagaggcttttttaaagatgatgaaaagctatcaaagggactttaaaaagtagtaacagaacctgattggaattttgaggggattattcatttttttcttcccagtaactgatgtttggctagctgcaagaattgtcactttgggcacattttctgtaaccaaatgtatcttcggcctttatattcaaaagggcagtaaaccaaactgcctatattatatagatgttattttaactcctcactggataaggtctctctgaaattaaaggatggagtacagatagttggggaacaattaaaattcaaactttaataccaaagctaagctctggggctgcagaaattcactaccgggggtagaatgtccaggtgggagtttggactggtactagctcaacctcaagtaaattcctgaagggtttagaaaaatctgaaacagacgctgacatatgtgaaggccgggctacataaaacatggagatgatgaacttctcaaatggagcagaacaccacaaaatttggagaagacagggctatttcaaacacatttcccccaactgctggttgtactgctgctacccctcaatgagtagggattctatgaatcagaccagcttgacacatacgaccttaaatacaacaaacaaacccaacagatttgctatttcatactctgcctcatccaaatttcaatgtggccaagccccaaatcatggtttctaccaggtcaacagcacataaggcggcagcaaagcgcaatggctatgagccaaacggacctgtgttcatatcttggctttgtcattgactggtcagtgacattgaataagttcctgaaattctctatatttcacttaaaaacagggggaaacatgctgtattaaaatttgttgattttaggctactcaccaaaacaacatcctgctttagcggaaatcttcaggtattccctgtccctgtaagctggaaacaaaggtataagccatgtgacctaagcccggccatatgatgctctcaaaaaagtggcgtaaagactcagagtcggtgacagagcccccctgttgcagttgtggtggcaactgcaggctactagccccacacttttcctacggaagcaacgtggcactttcctctgcactcagcctccttggttcaagtctatttttctaatatgatcctcaaaatagcctcctcctccattctgtgaactacctgatgacctttcaatagattcctttttactcttaagttattaaaggtcagtttccatgtttttggagccaggaatcctggctattacaactgacttatattagatggtgcagggcaaacagagatgaagcattagcatggcatctgataggtaagtagtgatgatgggtagtaacactggaccctgaatgctaggaaagatctgaaaaaagaatttgggatctgaaaatagtcctgtccaagtgtcatgaaacagtaaggtaactagagcacctcaagccagtgttttgtttcagtgacaaagattaagaagacactggtacctactcaagcctgaggcaccacacagtaaatcatcatcaataaaatgttcctggtcccttcaacacctgcccaccacacccacctgagccctaacctgccagccaactctcctcatctgctaccaccacactgttccctaagcctgtggagaaaacattctacaaaactcaaattaactaaattaaaaatgaagttccagccaggcgcggtggcgcacgtctgtaatcccagcactttagaaggctgaggcaggtggatcacaaggtcagcagatcgagaccatcctggctaagatggtgaaaccctgtctctattaaaaatacaaaaaattagccgggcgtggtgctgggcacctgtagtcccagctacttgggaggctgaggcaggagaatggcgtgaacccgggaggcagagcttgcagtgagccgagatcgtgccactgcactccagcctgggcaacagagtgagactgcatctccgaaaaaaaaaaaaaaagtgaagttccttctctagatggaagcttctttcacttcttaaataataaattaaaattattctgataggctgggtgcagtggttcacatgtgtaatcctagcactttgggaggccaagacaggcggatcacttgagcacttgagctcaggagctcaagaccagcctgggcaacatagtgaaaccctatctccactgaaaaaaaaaattattctgataaatgaaactgttttcatgtggtagtactgattcaagggatccttggagctggccaaaggtatggaggaaaattatagcataaaaatactaactcttagatatttaaaaaaatctaatacatttttatataagaaggaaacaataaatggataggaaaaaagaccctctaagacaggaagggaccagagttaggctgtgcaattcccaaattctctaggggtaaaactactccttccccttctactagggatccttagccttctagacttttagactaaagatccctagcagagggagaaagcttccttgcaaagaacagcaacgacaaaggcctgatgagagctaatgttacagtaatattgagatcacaacttgggctggctatgtgaaggctgacaatctaaatgaaatcttaatctctctcagaggaaactgcagacacaacagtcattgatacctgtcagccccaaatcagccttgcagacataaaagtgcatgcatgaagtaaaaagataacagcatctttgatgcctcctgtcatgtcataaaccaaactaggtagtatatcaaatactgtagaaacaaactattagacttcttccatgtatgccagaagacccctgaaggattccatagaactgtggataactttgatctattcccccttaaggggcatttttattatgtaataactgacacatacgaaacaatacatataatatttacacaagatattagaaataataaaaaacacccttaaacattcctccaagtacatgaaacagaacataaccatcaccattaaacttcttgaggacaccaatctcaacggttttgctcttcctgggtatatacacataccagaaaataattttgcattatcttgtaaagttgaatttatctaccttgtaacctcacagttcttttccaaggactacactctagaaagaccattacagaaacttggaacagatgagttaaaaaatgttgtctgtaacaagaaggagtatgaaacaagtcaaatggataaattaacaatgataacttcatgtgaccagaacagtaccctctctcatgtgtaatgcaagctggtaacaggaacggggggaatgcacattcctgggtagactctgtgctgagctgcccagacaccccttcaggaatcaagggcacatccagcgtcacctggcagctgtcgctgagaattgccctgagatgaaaaaaggtgcctggcccagggtcatgggagacaggacctgcatctgaggatgtgtcaatgcctctctagctttctccaccgacctccggtcccagagctctgcaaggattcacagaggcctttgttgagatggcattgccgtccgttcctctctgcccaatcctgcttcctttccacctcctcctcacctccatacgactcagtctgttccccagggaatttcatacaggccggaaacttcacattatctcatttaatacgtatgacaaacactattagatagatattatcagtcccattttatacatggttttagaggaagtagttaacttgtctaaagcttttcagctaagacaggagcttggattcaatgttgaatctacttggatcctcaagactatgctctttcaattactctgtgtggcctgttttactaagcagcacgttgctcagcttgtgttaagatacattccgaggagcaaataaaagtgcatttcttttaaattattctttaattcagatattactaattgcattttccccagaattacaaaggtcttagtacattataataagtatcacagtcactcatcaagatatgatgagcttcctagcttgtgaatacaaataagaaatactccatttttactgcactagttctaagatatctgattctcataggataagggagcagtagtgtgcctcaaatcggaacatcattagagctggggaaaagtatagaatggtactgtccaatagaagtctataaaagccacataataacttaaaatttctagtaacctcattaaaatgtgtaaaaagaaaacaagtaaaattaactttaacgatgcatcttgtttgccccatatatccaaaatgttaccatttcaggccaggcacgttggctcatgtctataatcccagcactttgccactttgcggggacaacgtgggaggatcacttgagcccaggggtttgagaccagcctgggcaacatagtaagactctctttctattttatcaaatttaaaagaagttatttcaacatgtaatcaataaaaacaatgagatattttacattattttttctgcacgagtctttgaaatctggtgtgtattttacactcccagaatatctcaatttggactagccaggtattaactgctcgacagcgacatggggtgagtggcgacaatactgggtatcacaggcaagggggagagggtaggaaacaacgggctaagaatgagataagagaattgtcagtacttttaccatccactcctgactggccaacaaaagtacctgacaagtgataagactcaaaacattttctcttaaatatggagcccatctccttgacagtctatgtaaacaagagtgctctgcagaacattatagaaaagtgtttcttttatatacagtattaaggtctgaggtccatgattcactaaaacatttcgttgctatcagaagtcaacttgggaacattttatattctagaacattattgttacttaaagaaacaaaatgctttaaatggagttctaagaaaagaacatggcaccttctctcctcctttatcttaaaatccccagaaggtcccaaagctctgcctgtgattgcgtgaattacctctgggcaagtatctatcaatttttaggggtcctagattcctcatccaggaaatgtgagtgttggatgaaataacctctccagttccttctggcatcaacatttcgtcactacacagcacagtctgatcagcaaattgttttctgaaaagcaaacaaaaatccatttcatcgttgcatcacttttctctgagaaaaagtctgtacataatttatctattgtggaaagatgaataatggtccccccaaagatgtccatgtcctaactctcagatcacaagatttttatgatactctgtgaatattatatgtcaaaagagaatttgcagatgtgaataagttaacgaacttaaggagaagagattaccctgggttgtctcagtgggcacacaggatgtatttttgttttgttttttcagagacagggtctcactctgtagcccaggctcaagtgcagtggtgcgatcatagctcattgtaacctcgaactcctaggctcaactgagcctcctgcttcaatctttcaagtagctaggtctacaggcacatgccactatgcccacctagttttaacattttttaattttttaaaaaaatttttgtagagatgaggtctcattacgttgcccaggttggtctctaactcctgggctcaagtgatcctcctgccttggcctcccgaagtgctaagattataggtgcaagccatgatgctcagcctcacagcgttcttacaaaagaggttggaggttcagagtcagagaagacgggatgacagaagcagaagggaagaagaggtttgaaggtggagaaagggggtcatgaatcaaggaatagacagctcttagaagctggaaaagacaagcaaaaagattctcccctcgagcctccagaaggaatacagccctgccaacccattttggacttctgaccttcagacctatgagctaatatattgtgttaagacaacaagtttatggtaatttgatacagtagcaatagcaaacagatatacctataatcatacaagtaacatccaagatggtatatctatgtggcttctttgtcagaagtaggtgtattgatttccaactaatctatttaattaggattaaggagttctgtgttagcttttatatgcaggaacaataatatgtgagataagtttcaataaaaaagtactagctttttctagaaaatatgtagaaacactatcatttaaaattaacattaatgagagatagtaaatctgtattaatattaatcatctgaagacccaaagatgaaaccccactcaaccaggctcataaggaaatgaatgaaaaggttacctggtgtggcagagatgcctgtttgtccacctaaatcccttcttcctcccatggtacagggttgtttctgggaacatccagagactgcttctcagcatcccttgcaactagattcctgctaaggaatgtgagtgaaagctatgtgtgccacttccaggccaagctttttaagagccactactcattttacttttacaggccaaatacagaaaaattcataagtccccgaagatgatgatgccacaaaatggaaagaggctgctgtatttttgcaaaaagaagcaatctgttcaccaggaatatctagctttgacaaccatgtaaacaagaaacaaacttatactgtgttggagccagtcaacaatttgagatcatttactacagtaatgtagcctactcagatgaagacacctagtcacagtcaggcaagacgacccaacatttctttcttgagcttattttcaggttgataacaattcatagagtgtagtgaaaactggggacttatattgaatgagtttgactaaccttctactcacttgaccgaatactctatatgaaggatagtgcccttagaaaatatgtgctggaatgtctgtcatttctggtaaaaatttcaggtagcgtaaagactgctgggcaatacaggaaaaagaattcaaatgatataaaaataaattaattataaacttttggataggcatggtaggctatagaatggtgggtggtcacactgggagaatgagcagttttagttattaccagtatttaagccaaagttcattagggtttttcgcagtaacacacattgtacaaacaataatgagatccccacccaaaaaaaaaaaccacaaaaatcaagctgcagattccgctcctatattttcctttctttactaagcccattggcaactgattaactttttgaaattattctcaactataaattctaccccatcagcagttaatcaacaataaaattcctgggaaaaaattggtaatgtgaggcttcctcatttgcaaggacatttgaacagaatcttatttcagtcaaaccttattttcattttcctaggccaagaattagagaaacagaacctgaaattagcaaccatcttttgggactgttgtattaacattaaagataatatacaatataaaaaccaaacccagacaataatgcagcaactttccctgtttccctttaaaaacagacctcctaatcacttaattagatgtactttaaaaggtacataaagtccaagaatttatcatatcggtggccaaaaataagaatattttacagattcctattaatgagttatctatacattattagtaataggaaaaatgatgtactttctagagtacggttgtttcttaaggatcaagctcttaaagatataacatactgctgaaatagtgtgaacactcgtgagaggctatctcccatgcttaaacctttctgctccacttctaataacctgaaaacaatatttgagaaaatcaacaatgtgcttccggagctaagaataagcataagcacaacatggtctcttagcagacatactgggggaaaaccaggaacagaagccaagcctcgagacctctcaactcaaacaccaatgggtttcacaccatcacactgaagaccaatacgtagaatactgcaacttccttttttttcagtctttttctttcctttggttttttctttctttccttccgtctaggggtaagcaaacagtagagtagaaaggatgcaggactaagattcacaacatttgagtgaacctgacgcaatgccaccatcctgtgatacagccttggaagagtcactttacatctccagacctcagtttatatatctgtactgatgttataatctccaaggtctttggaaatttaaaactctataatttcataaaacaatattttgtgtatttatttattttgagacagggtgttactctgtcacccaggctggagtgcagtgttgtgatcatggctcactgtagcctcaacctcctggcttaagcaatcctctcaccccagcctcccaagtagctgagaccacaggtgtgtgccaagaagcctggctgattttttttttttttttctgtagagacaggatcactctatgttgtccaggttggtctcgaactcctgggcccaagtgatcttcctgccttaacttccccaaattctgagattacaggtgcaagtcactgtgactggccacatgaaacatttttatcttgtatactgtaagtaaaatagttttttttggtcacaagaaatgctgtgtctcttgagttggtataaataatttcaaacacaatacaagtctcattcagcttgctataaattttaaactcatatacagtaacctatttcaacaagcccctttatgaagcttacacaattgaaaacatactatgtatcaagaaaccttttatacagaatggaacaatcacatcgtttatcaatagggtaagctgaacatttatattgcagtccagttaaaccaaatgtgtatgtactagtctcatcatttaagtgaagtcttccattgttgaaggaaacaaaaaagtggcttcctagtagtgcagagtaagttccaagatgtttaaaggatatatacacgtgcctgtcaatgtgaactttctttaaatgcactgatttatgcagtaatatttggagtatgactttaagtgaatatttgctttaatatttaccaaatataagagctttacaactgcatagccatgagctttcctgagggagtaaaaatctacgtacaaagtagagatttatgaacactatttcatctcaggttttttcaaccgacaaaaaaacatgaaaatatcactggtgtgaaatactatgttcacaggaccatttacggctcttgggatttttgcctacaaattatgtgaaattacatgaaagagctgaaaacaaaaaagaagcaaaaacaaaacccctttaagagtgcattcgtttcagcattttacttcccaaggcagaatgttttcccaggaatcctgggagtgacttcagatactccgactgatatttacagctgccatgtatttacaccaataacttgtccatctgtagaggaaggctgaaataatcaatttgtaaccgacaggtctttctacatgtttaagatcatcttgaaatatattggaaatgtatctctcagatccacattctcccggatgacttcaaaacatcacctgattttggtgatggaggaaattttttggtgtgtgtttatgtacataggtaacctactttatgggttgttctaagagttatgagatggaaatcatgtaaaatgttagcacatctttggtagcacatctttaccttaattggtactgttttcccctttttgtattgtgaatcatagttgtacgtactttaggggtatgtgtgttcttttgacacatatacacaacaatgtgcaatgatcaagtcagggtaactgggatattcatcgccttaaacatttatctttggtttgtggtgggagcattacaatttttctcttctagctataggtactctttctttctttctttctttttttgagatggaatctcgctctgttgcccaggctggagtgcagtggtgtgatctcggttccctgcaagctccggctcccgggttcacaccattttcctgcctcagcctcccgagtagctgggactaccggtgcccgccatcacgcctggctaaatttttgcatttttagtagagacagggtttcaccatgttagccgggatggtctcgatctcctgacctcatgatccgcccgcctcagcctcccaaagtgctgggattacaggtgtgagccaccgcgcttggacagctataggtactctttataagaggcattttactgctttgtgtagtgcctgctatagccattttcatgttctcctaaaatgtctttctccatgtcttttctggtattatcttgatttttgtgtttttctgaggcaagaactgtgaaaaatcctaatgggaggaactctccttatttgagagtgtcgagagctgaaggaaatgtcttaactttttggttaaaaaaggaatacaagaaaaagaaggcaacaccaccagcagatgccactgcctcgtcacgagggcttttctccccaatgaattaatagtctacaaaggggcagaagtttccagtgcattctgcagctgtaaaacacactgaagccgctcagggaccaagatgcaaatgagcctgccactgatgaaccaatgtctcagcaagggccttcagagacttacacagagaggtccccttaaaggtatgaaaaggtgctcattaagcacttttaagacgtcgaaattgaaataactatccttcagttcttcattatcactaggtggttggactctgaggggatcaagcatttacttttcaaggaaaagtttaaaccaaactcataagcacacaaacctctagaaacgtaccattttgccagtgaaaataaatcacccagagaaaagagatcccatatagagaattcccttggacatgaaattctttgttaaagtaaataacatgcaactgacttccacagaagactggatgactgcagtacaatggatgctgttaatatttccgagaagatggtggctaacctttagttgtttattttttaaaataagtaaaataacatgaatatgttgctaatgagaatatataacactaagcctgaaaatattcattaagccatgaatagaaatggatacagctgaatctcaatgctatcattttcataatttgtcctgaagtatatttgacaatgaatttcacattaaccaaagtgcttttaaccctgaaactactgcagcatcactgatttggtcctaaaattgtggcattgattccaaaaagcagctgatccacgaaaaagggaaaaaaaagaaaaaaggaacttcctggcagataagatctttaaaaaagatgccaaaaagatgaaaaagcaagaaacaaagcaaagcatgatgtaccaaaatgctactttccaactgaaaacagatacatttctttcctctctttaaaacgctagtagttctttagaccatttggcaactaaagggtaagaaaaatgccatagcttcacacaaccctttactgaaataagaatgtgctttactctggacatttatttttcttactagactctaaatgaagaatctccctttactagaggaccagttctagcaagatgaacttacacaatggggaccttaaactccgtgtataaaggaaaataagagaacctttttttgtgagacagagtctctgtcgcacaggctggagtgcagttgtgtggtctcggctcactgaaacttctgtctcctgggttcaagtgattctcctgtctcaccctccccagtagctaggattacagggacgtgccaccacactcggctaatttttgtatttttagtagagacagggtttccccacgctggccaggctggctggtcttgaactcctgacctcgtgatctgcctgcctcagcctcacaaagtgttgggattacaggcgtgagccaccatgtctggccccaataagagaaccttattgtgagtttccatctcagttctgctaagttgctgagacacttcctatctagttctattgctttgttcttttcattctgccttcctacaacattcatgtctttgtccagcttatgattaaaaactgaaagtagaaaaataatatgttaaaagacaaaccagcaaaaatataagcagcatatacgacaaaggtaataataatgtttaaaaaaaataaaaaggttttggagatcaactaagaaaaagatgaatatctcaatttaaaaattggaaaaaataaatgggcaaccccaaaatgaagaaagcaagttttccataaacataagaaaaataaaaattaactagtaccaaaaatgcaaatcgagacaatgagtactaatttcatcagtcaaactggcccagaaatagtatggaacacccttcctagatgacaatttattgtattaataatacaaataaaaagcacaaaaacatctgcattcattctttgactcagtaattcttaaggaaatgaaaaaatgtttagttgaagcagttgttgaaaataacaaaaaatgaaaacaataacaatgtctaaaaatgagggactaggccaggcgtgatggctcatgcctgtaatcccagccctttgggaggccaagccgggtggactgctcaagctcagtagttcgagatcagccagggcaacatggcttaagacggtgcctatacaaaaaaatagaaaaattagctgggtgtggtgtcgtgtgcctgtagtcttagctacttgggaggctgaggtgggaggatgacttgagcttgggaggcagaggttacagtgagctgagaccgtgccactatacttcagcctaggtgacagagccagaccctgtctcaagcaaaaaaaaaaaaaaaaaaaaaaaaattcgttaaataacataaggcatataaaatgaaatctagtgtaaatattaaaattctgttgaaatacatattgatatgtaaagatctttttagtatattaataggtaaaaaagaagaccacacttaaatatgtgttcatctatatctatattaaaaaagtcttaaagaaagtgacataggctatgtctgggtaactattctttggggaggagttgagtatattctgcctttggaggggaatgagtattcgtgatcaagaaagtggaatgtggttgttgtattgctatatacaaacgtattttgtatgtggaaaaagaatatttgtgatcaagagtatcaaaaatactacttttcacaaatatctactgcatatcctactcccaaggtttcccaaggaaagcttcctactccattgatgttgaccacacccatgtaacttgctttggccagtggactatgaacaaatagggcccatgtcccattccagcagctttaaatgcactgtataggttggctcagcgtccagttcttcccttccaccacaggaagggcttgtcactgagcaactgttatttcaaaatggatctcccaacgagaagacgcttagagcagagctctgccacagccgttctgtagccaccaaaaagtaattgaaaagggaaatgaatacctgtttcaacccattaagattttagggttctttgttactcagaaaagctgtttagtaaatacacaatgcaatattgtgctgtaaattgtcattatggaagaattttttctcgttttgcttatttatatttcctaattgttctattataactatgtattacacaaacacacattggttaaaaaaaagaaaaccttaaaacaacaggataggtcaacaaactaaaaggaattgattctaacttgactgagtcatttcaatatccaaagaaataatcattgttcactatttgtcagccaaagaagattagcaaaaaagccatatagaagagcactggtggtgcccatccatgcacaatccaggggagaaaaagccttagctaatgggcttggatatatttttcatccagctggcaatcacctagcaaggagatggatatagaagctgcatctaatgaactgtgaggtttgtggacctttggcaaacacatcctcactggaaatggctacatcaagctgcctaagcttcatgacattaaacagtcaccacctctagcttcctttgtcctgatgccacaccagctaagcaaccttctgagtataccatattatatggtttcttagttacctattaggaaagaatgtcctggttaaaccagcttagacagcatttatttaaattaataaactggcatttaaatttaatttttataagggaatgagggaagaaataggcaaagattcttgactactaagtcaaattctcatttaggaaatcaggattttccatactgcattctatccaatgcaatcttgactacttctcatttgcaattccatgttcctattacgcttattcccattcagctgccactccacacatgtatacacatcatatactcactctctcgttgtgctgattttgcatattcttctctgcctgtccaaatcctacccatccttcaaaaacgcctcaaagctcaccctcttcccctttccagaaaacctacccgacaattcacaacagcagcactacccctttatactgctctgctcctgtgtcaagtctatgagacttttctagatgaatatcagctccttgaagttttctatacacagcccacagcaacaggtaagtagcagattctcaagaagtgttcatgaaattgatttctgactaaattaatccaacagcttcagggcagggcttatcctacttatcttggcagattggaggattgggatttacagttgacagccccacaacacacacacttgctactactgccaggcagttctgaatactttttaatcaatgatcttataaaaacaaaaagtgcaagactatgagatagatattatcatcactcccatgttccagatgagacagcaaagctcatatgactgataacactcttgaggtcagaagtggtacggctgggattcagggcccatgtttgttacctcctgccaattttagctcattataataaaataaggctcattagaaacatagtaagctaggaagaaattcttatacttcttccccgaagagtacagtctgagatggaaaagtttgggatgggaagtaagagacgcaaaaaggaaagcctgaatcaaacagacagatactgatgtcttccacagaagacaggtcacaatgactgcagtatgtggccaagtaggacatcaaagtttggggctagagctgaattgctcagggcaacagaggaaagattaggcaatgccacctacatttccttctctgctcttgtaccaggtaataaaccaccttgcttttaaagaaatgttggccaattatgtaaagaatatttattcacaatctcggcagaggtacccagtctgatcctggagacaggggagaaagggaaaacagacagaggaatcctgactaatttacagttttaatggggctcactttaaacctcagacttactctttcttccttctttacacatatggcaaagaggatataaggataaagacaacagaaaaaccttccttttctttcttaggatttagggatgagagtaacagtaattcctctacattgtatggaagggccaaataagagactgtggtaaagcacctagctcaatacaagggtgattaactgctctctctccactttccacctatgtgaatactgaatatagcacctcatggcagctctaggcctgggattgaaaaaaaaattagaaaattttttttttccacagaaaaatttctaactttcagtcttagcagtacctctgagtagagccatcacttataagttacagaccacacagctgtctctccgtgtttttccaaaagtttttactctaaccttctgtaacagacaacattttcgtcatgacccagtacataaaagatgcaaatatgcataataccctctattttctactgcattttaataaaagaaatgctagtcaagaaagaggtcaagatggcctactagaagcagctctcctctgtggctcccacccagaggaacaaaaacagtgagtgaatcctgcaccttcagctgagggatccggattatctcactgggactaatgaggtggttggcgtgacccatggagagcaagaaaaagcagggtagaacaatggccaacctgagagccacacggggtaagaggaactcccacctccagtcaagggaggtggagagtgatcatactaccccaccagggaaaccacgctttttccaagtatctatgcaacctgcggatcaggagatccccttgtgaacccacgctaccagggccttgggtcccatgcacagagctgtgcagactctcagcagctgctcgggttgtggacagcggtagcaggctggagactaagatgaccaagttcttggggaaaggggtggctgccatcactgtggctccaattggccgttttctcctgctgatgccagggagactgggcagtttagaccaggaggaattccccacagtgaagcacagcgactgtggcagatcatgggctgacttctttaggtgggacctgatccatccctcctcactgggcagggtctccccacatgaattccagcaactccagccagggatttaggataaaactcttgatccctgggatggagcccctgacgggaggggcggccactgtctctggttcagcagatttaatctctcccgcctgctggctctgaggagtctggtcagctcagaaaagtgggaatcccctcagcccactgcacctgttctgccaaggggcagccaggctgcttcttcaagagggtccctgatcctgtgccccctgactaggtgaaacctcccaacagaagtcatcagacacctcatacagcagagttctggctagcatcaggtcagtgtccctctaggacagagttcccagagaaacaaacaggcaaccatctttgctgttctgcagactcccctggtgatacctccaggtatgggaggtacccaggtgaatagggtgtggagtggaaccccagaaaccacagcagccctatggaagagggacctaactattaaaagaaaaacagaaagcaacaacaacaataacaaaaaagacaccacaaaaaccccagccaaaggccagcagcctcaaagatccaaggtaaataagctcacaaagattagaaagaatcaaagaaaaaacactgaaaattaaaaagaaatagggtgcctcttctcctccaaatgattgcaccacctctccagcaagggcacagaactggactgagcctgagacagatgaagtgatagaagtaagcttcacaaggtggtaataacaagctttgctgagctaaaggagtgggttctaacccaattcaaagcggctaaaaaccatgatgaaacactacaggacctgttaaccagaataacccgtttagagaggaacataaatgacctcatggagctgaaacacacaacacgagaacttcacaacgcaaccatgagtatcaatagccaaacagaccatgtggaggagagaatctcagaggtgaagactatgttgctgaagtaagacaggcagaaaagattagagggaaaaaaaatgagaaggaatgaacaaaaccttcgaaaactatgagattatgtaaaaagacaaaacctacgactgattggggtacctgaaagagacagggggaacagaaccaggttggaaaacatactccaagatgtcatccaggagaacttccccaacctagcaagacaggcaaatattcacattgaggaaacccagagaaccacagtaagatactccatgagaagaacaactctaagatacctaatcttcagcaaaggttgaaataaaagaaaaaatcttaaagggagccagggaaaaaggccaggtcacttacaaagggaagcccatgagactaacagtggacctctcagcagaaaccttacgagccagaagagattgggggccaatattcaatttttttttttgagatggagtctctctctgtcgccaaggctggagtgcagtggcgtgatttaggctcactgcaacgtccaactcccaggttcaagtgattcttctgcctcagcttcctgagtagctgggattacaggtgcctgccaccacacctagctaatttttgtatttttagtagagattgggtttcaccatattggaccaggctggtcttgaactcctggcctcaggtgatctgcccaactcggcctcccaaagttctgggattacaggcatgagccactgcgcctggtctcaacattcttaaaaaaaagaatttccgacctagaatttaatatctggccaaactaagctttgtgagtgaaggggaaataaaatctttttcagacaagcaaatgatgacagaattcatcaccaccagacctgccttgcaagaactcctgtaagaagcactgaatatggaaagggaaaatggttaccagccactacaaaaacatactgaagtacacagaccaataacactatgaagcaactacattaacaagtctgtaaaataaccagccagcatcatgatgacaggatcaaattcacacataacaatatgaaccttaaatgtaaatgggctaaatgcctcaattaaaagacacagaatggaaagctggagaaagagtcaaaacccattgctgtgctgtcttcaagagacccatctcacacgcaaagacacaataggctcaaaataaatggagggaggaaaagcacatggaaaacagaaaacagcaggggtcacaatcatagttttgacaaaacagactttaaatgaacaaagataaaaaaatacaaagaagtgcctcacataacggtaaaggatgcaattcaacacgaagagctaactatcccaaatacatatgcacctaatacaggagcatccagattcataaagcaagttcttaacagacctacaaagagacttagactcccacacaatgataatgggagatgttaacaccccattgacaatatcagacagatcgtcaagagagaaaattaacaaagatactcagaacctgaaatcagctctggatcaagcagacctgacaggtatctacagaaccttccaccccgaaacaacagaatacacattctttttatcaccacatggtacttactctaaaattgatcacataattggaagtaaaacactcctcagcaaatgcaaaataactgaaatcataatagtctctcggaccacagagtgatccaatcagaaatcaagattaagaaacccatataaaaccacacaactacatggaaattgaacaacctgcttctgaatgactcctgagtaaataatgaaattaaggcagaaattacgaagttctctgaaactaatgagaacaaagacaatgtaccagaatctctgggacacagctaaagcaatgttaagagggacatttacagtactaaatgcccacagcaaaaagctacaaagacctcacatcaacaacctaacatcacaactaaaagaactagagaaccaagagcaaacaaacctcaaagcccgcagaagacaagatatgactaaaatcagcgcagaactgaaggagatagggacatgaaaaatccttccaaaaaaaaaaaatcaatgaatcccagagctggttttttgaaaaaattaatagatgaaccactagctagaacaataaagaagaaaaaataattgaatacacacaataaaaatgataaaggggtatcatccctgaccccacagaaatataaacaaccatcagagaataccataaacacctgtatgcaaataaactagaaaatctagaagaaatggatatattcctagacacatacacacatacaccttcccaagactgaatcaggaagtggttgaatccctgaacagaccaatattgagttctgatattgaggcagtaataaatagcctcccaaccaaacaaacaaaaaagcccaggaccagatgcattacagctgaattctaccacaggtacaaacaggagctagtaccatttcatgcgaaactattccaaaaaattgaaaaggaagaactcctcccttactcgcgttatgaggccagcatcatcctgatatcaaaacctggcagagatataacaaaaaaaagaaaacttcaaaccaacatacgtggtgaacaccagtgcaaaaatcctcaataaatgctggcaaactgcatcccgaagcacattgaaaaacttatccaccatgatgaagttggcttcatccctggaatgcaaggcgggttcaacatatgcaaatcagttaatgtaattcatcacatacacagaactccagacaaaaaccacgggattatctcgatagataccaaaaagacctttgataaaattcaatatcccttcatgttaaaaattctgaataaactaggtattgaaggaacgtacctcaaaacaataaaagccattcatgacaaacccacagccagtatcatactgaatgggcaaaagcaggaagcacaccccttgaaaaccggcacaagacaaggatgccctctttcaccactcgtattcaacacagtattagacattctggccaaggaaatcaggcaagagaaagaaataaagggtattcaaataggaagagaagtcaaattgtctttgtttgcagatgatataaacctatatctagaaaacaccattatctcagctgaaaagcttctttacctgataagtcacttcagcaatgtctcaggatacaaaatcaatgtgcaaaaatgataagcattcctatacaccaacaacagacaagcagagagccaaatcatgaatgaactcccattcacaattgctacaaagagaataaaatacctaggaatatggcaaacaagggaagtgaacgacctcttcaaggagaacgacaaacctctgcccaaggaaatcagatgatgcaaacaaatgaaaaaacgttctatgctcatggatagtaaggatcagtatcatgaaaacggccatactgcccaaaataatttatacattcaatgttattccaatcaaactaccattggcattcttcacagaattagaaaacatcattttaaaattcatatggaaccgaaaaagagtctgtacagccaagacaatcctaagcaaaaagaacaaacctggagaaatcccactacctgaattcaaactatactacaagtctacagtaaccaaaacagtatggtactggtacaaaaaacagacacatagaccaatggaacagaaagagaactcagaaataagactacacatttacaaccatctgatcgtcaacaaacctgacaaaagcaggcaatggggaaatgattccctatttaataaatagtgttgtgaaaactggctagccatatgcataaaattgaaactgtaccccttccttataccttatacaaaaattaactcaagatggattaaagacttaaatgtaaaacccaaaactggaaaaactagaagaaaatctaggcaataccattcaggacatacgcatgggcaaagattttatgatgaaaatgtcaaaagcaactgcaacaaaagtaaaaattgacaaatgaaatctaattaaactaaagagcttcttcacagcaaaagaaactatcatcacagcaaacattcaacccacagaatgggaaaaaatgtttgaaacatccgtttgacaaaggtctgatatccagagactacaaggaacttaaatttacaagaaaaaaaaaaaaaaccaaacaaccccatcaaaaagcaggcaaaggacatgaacagatacttctcaaaagtcatacgtgcagccaagaaacttatgaaaaaaaccctcaatatcgctagtcattagagaaatgcaaatcaaaaccacaatgagataccatttcacaccagtcagaatggtgattattgcaaagtcaagaaacaacagatgctggtgaggctttggaaaaacagcaacgcttttacgctgctggtaggaatgtaagttggttcaaccattgtagaagacagtgtggcaattcctcaaagacctagaaccagaaatacaatttaatctagcaatcccattactgggtatatacccaaaggaatataaattattctgttataaagacacatgcacgtgtatgttcactggagtgctattcacaatatcaaagacatggaatcaacccaaatgtccatcagtgatagactgcatacagaaaacgtggcacatatacaccatagaatactatgcagccataaaaaggaatgagatcatttcttttgcagggacatggatagatctggaagccatcatcctcagcaaactaatgcaggaaaagaaaaccaaacactgcatgttctcactcataagtgggagatgaacaaggagaacccgtggacacagggagggaaacaacacacactgggccttgtagggggtgggaagacggagaacatcaggaaaaatagctaatgcaggctgggcttaatacttaggtgatgggttgataggtgcagctaaccaccatggcacacgtttacccatgtaacaaacctgcacatcctgcacatgtaaaattaaaagaaaaaaacatgctagtcacaaaccactaaattaacataatgacccattaataggttacaatctacactttgaaaagcattgacctagattaagcagatctaagaaacatattattaatgtatccatgtatgtaattcaacactttcaggaaagccaatattttgctattccttgaattatcctcattcaaattattaaagagtaagtgctctacaaactctaacttaatgacttataaactgacagaaattttaaaatggaatgtttttcctacagactagaaggctttagattttgtctctggagctaaataaaacataatttttaaaaaagcaaaatcgcttggaagtgtttcccaaacacaggcatcaatgctctacctcagttgttataatctatggcaggcatagcaacagggctctgctgctctagaacccatggcaaacaccacttactaataatactgctcatttcttgaaccccattgcaatctgcaatttcttcttactccaaccctccaggcagctaccaaaaaactgtagcaaataagtacatccaacgcatatttactgagtccctactatgtgacaggcattgttctaggtagagacagacacagcagtaaaaatgcaaagcatctaacttcatagaacatagatttgagtgagggagctggctaacaaaggaataagcaaatacattggttgcttcaggttgctctgggtgctttaacgaacaaaagtagggtaagaggacagagcataacggcaggagtgggtgagtgctatttcaaagaggatggccatggcccaattgttggtcaggccatgagtgcagagaacaaaatctagttagctagcttaaaacatgatttatcaggtattaaacagttgattgctggaaaggtcaaagaaaaacttcaaggctgaatgtctacgaaacacgcccacatccatacttaccactcatggtccacactcaccttacacacctcatatggtgtgtctgacggtggcatcaaaccacaaccagaacctgagcagcaagaggagagggaaatatagtttttacctttccgggctctgcagtggaataaatggaaaaatgcctctatgaaaacacaacattcttgcaggcccctgattaatgaggagccaatgaaaggaagtgttccaggtgggtgaaacaaaaggctgagagtgggaatgagcttggtgtattcacacagcagcaagatggccagggtggctgaagcttgggcagtgggagaggaaataatgagagatgaggcagggagggtattcaagacccagttcaagtaagtcttgcaagctttgataaggagtctaaatgtattttcctaagtgtagaaggatgttataggatgaggattttaagcagaggaataacatgttctgaataacctttcttaatagaccattgtagttctataaactgttctccatgcttgatttacatcaatagcttaaaaatgtacaattttaaagtgacttcatttgatcttctatggagtaactttttcaattaaaaaaggcctaaaaggtaatatttctcaatctataactccctcacggatacagcacatgtgtgagcatgatcatctctaccttctctaagaccaagaggagtagccaaaggtagcaggcccaagcctggacacccacctcttgccaggctccaggaagatgtggttaatcaagggtaagtttttttctaaaaaacaaaactcagacctctggacttaaaatcctgagattcttcctagttagaaacaaaaacgaaattagcttccagcactaaaatcaacctattttaaacagtcttaaaggtttttttgttcccgtctccaatatgcaacctaaagccaaaacatttcaaactcaaacaagagaatgaaataaaaataaaattaaccaaattacgtttattttaatttttttttcaaaaagtaaccattttatactaacatccatttgcaacgggccactttcttaaggagcagaaccacttaaaagaaaaggtcaatttaaaaattgttccagaatgggagtgaggagttcttgctataagtacatgcctagtttagcaactattatgcttctgccaggagcatttattactgttatgaggtcacccattataaatgtggtctgaatgttctaatttgcttttctttatacaatgttaatgttgcaagcttttgagccaaaacatattttgctccagttaaaaaaaaaccaaccatgaagcaaaattgcagaaagggaatcaattttaaacaaatttgttatattatatattttatatgtttgtatgttaaatttaatttcttttactttctccaaagcagccacaatactggctttgatgaagggtcacactataaccacttgagtcaactcctgactttttgactcagttagaaagataaaaaagcaaaacaaaatattccctttgccttctctccatacagcctgccttgtaattcttttcacacataaatctgaactattcattttctttgtatttcataaacttttgcctgctctagctcccttacgaacattaaattctctgcggtgagacttggtaaatagaacacaaaaaatgctccataggattagactaaatgctgaagctggctcagtgggactggtgatggccagcttccaagacggcacccagcggcctgcctctgggactcatgtgcttgtgtattgcctcccacttctgtccaagggtttaacagtctttcttcaagcacattcggcagaaatggaattagtttcaccctgccctagtgagcccttgaagctctgactgtatcttacctcctggagcagctgccacacccctaccctgtcgccatttcctaaaacaacaccctcaacaaggttaccttgtatgtaatagtcttctaccctcacaatcttttattttattaattcctctattcatctacattcatctagaatcacagcaatatttacctattttcccatgttatccattacatgctcaaattaactttacttttccccatagggaattataaaagaagatttgtagctttagcatattattatgtgtgtgctttggtttgtttgttcttgcagtgaagtaggcagagacagggattacaaagaggttagatcatttagcttcatagacagatatacaggactagaagggaatattcaaacacagttatctcagctttgggaatactgatgcatttttaaaactttacagatttgctaaaacaaatgtttaatacattttataatcagaagaatattaacaaaaagtatcacatgtattcatgtattagctgtgcttttgaacatagcactctcctaagacccgaaatgtcatataatctgaagaaaaccgctaaaaacctttaggagatgacatatggtacaagaaaaacaggaaatgatgacagaagagagtaggaggtcaaggaaattttataatttagagacattaataatgagtttgaaagtcgtttggtgcaaaaaaaccccacctaaactaaaatgggaaaatcaggttttacaaaaaggaggcaatggggagagcagagttcagcacaaaagccaagacaacattcaaaaaaagacatcacagaccttcagtctccacttgactgctacaattatctgtggagctgtcaaccagctgatgtagagatcttgtgggaataaagcattaaagaatgtaagtgataacagagttatcctagatcaggagaatgaggctaaaaggaaaaagctaagacagagatcgaaaattaggtggctgtgacttcggatagtcccgcagcctgcttcagaagcgctctgctctgtttggccaataaacgagtgtctagaaggcaccctggaagatgggtatgagtggacgccactgagattgtcaaagtgaaaagtttcctgggtacaatacacagagttcctctaaacaagactgcattctgaccttgactttttaactgaaattttaaaaatctgaaactgagtttatggcttgtacaaactactaaatccagacttttgctttattccatgttttagagaactccagagaaaaagaattttctcaagccacatacacaaccctggcagaagcaaaagacaggtcaaggacattatctttattatgtgctactagtcatactgctttaaaacaatattcatatttgtataaaactgtatcaaaacagatactatagaatctcacttgaacaagactttaaaaatcatttactccaaatactcatttactcgtttagctgagccccttgttcaacatcctaattgcacaactattcttgaacatttgcaggtcaaggaacccactatttcccgagatagtatgatctattcatggacacctccaactttgagaaagcctgacttgtttattctagtttattttatttttaatcttcaagttacctaaatctattctttagagctggtttcattttaaccagaaagctctgtaggaatatagcatatatctagatagcaaaactctgtatattttgctttgtcaaagattttttagacaatagttcttttgtatatcaggctctataaacacgaaggattaaagaataccaaccaggcctcttctgttcatagcgatatatgcatcatatttctcatatcgaaacccaaaaaggtaaagatacgtaagttttcttgcccttaatgccctaaaatgtaaaatagaattccatgggcagttatgactgccccattctgacccaactcattagggactactgccatttccaatgtatgggaaactcatatatgtagagaaaatctgcagatattcccttgcaagcagagaagttggaaaacaaaaacaaaaaaacaaaaaaccctcaaagctcctgctttgaatccaaaaacataaccatattttattaaaatggtcattaaagtaccaggcacattccaatcattcctggcaacatgaaccaccagatgtttactggattacacattttaccacaattggattctctgagcctcttaaggtgactctttggattgacaacacattttaataaaatatctaggaaaagggtataattttattaagtcaaggatgagcaatctaagaaaccagagttaaaaacaacaacaaaagcaaacctctatccatatcctcagactacctggaattatatgtgtttacagcaattaacaattggcaagaattagaagatcttgagtgggacataaatacaaaatacatgcaaaatgaccaaaaagtgaaatgaaaattgattcttacagaagtacatactgaatgtgccagtaaaattaaaagaaaaatccagtgtttagtacaaacccatcctccctgcctggccacccccacagtgctctgcagatggcatacaataccagtcacaggagcgccgatgcatttgctcagtgcgttttaaacacacacataattacaacaatccaagtcttcaggaaaataaaatgaggttaaagggtcacattccaaagcagtgatttattatttgtagtgatgccttaaaggttttattttttcctatttgatatcactctctcccaaaccccaggatctgagggcaaaaacaagcctctatttaaaaaagacaagatgaagaaaaaaattcatactgaggagaaaggttcatctgtcaatgtgaacaaggagtttacatcactagcattctactggttttcttggggaaagaagtctctgcagaaaagcccacaatccacatcccactcggagcaaaggcccttctcacccgaagagccctagtgattcatgtcatcgccatctgtcccaccggacacccctgaaaactcacttctggctagcaaaacaaggtgtgtgcaatttctgatactgttttatcaatcactgatttctctttaaggattatttcattaaaaaaaaaaaacctgccaatgttccaatacaggctccaaaggggtggggaaggcacccaggggtgctatgtaagactcattttgagacatgcctacaaatgtctatcagaatgaactaactgtatcccaagtaactaggaccaagtgcttgagccacccaagaccaggaactgctgtatttatccttttgtttttccttgaagttctatagcatagctgggaccattaaagccttagaagttaaaaagattgacgtttattgagacaataatgcaatgtctcattttatacatgaggaaggtgatattgtataaggttaggtgacatgctcaaggccatgaagctgtgtaacaacaagaccagagatgggcctgggtctttggactcctgttccaggaaccatactgcataaaccgatgatcattctggaatatgtgtcctattaacacagggcaagagggaggcatttgctagtgtaactgtttactaaatcgttccctaaagactgatcacacttctttacccaataaaatccagccagtaaagaatcatagtaagtatttatttaatgtgttgatgttcaaaatgtgttgcattaaaagtgagctttttaaaaggcctacgagacacccaatggctgcacacatattgttcccactgaagggacaaccatttttaagtaggtcacacatagtaatgccacgtaatttaaagtgtgatgactaacaacacatttgaaagcggaagccaatttattgttacaatttctaaactggtgcagacatacagactatgattgttgagccttgtttttaacagtaaaaattgaatttcaactcccctttctcccagctgcggtattgaacttaaaagtctactagatcggtgggtggacgatcaaagaacatttaaaacattttaactttactacccacaaggaggtgggagtaatatgtcagtgggactaaaatgtatgtgacagagtcttaagagattccctaactagacaagaagctggttgttcccttttttaaagcagcagcactcacccttacctttgctcagtctactttttagagctggcaaatagaataaaagagttaaatcagaatctaaaaatatccatgttcttatatgttctgtttccagtgcagttgaaaacactaatcacagttgataatctgagatttctcttatctagatggccttgtaaaaggtttcccttcaagtgagtaatacgtaatccacactaagaataaacttaatctttaaaaaatggaaaacattaattctttctctccatttcctcccccttcatttccacctgaaggaagtacagatgtgaataaatgtatctaaatataatcattagagaaagatgtcaatctcatttccaaaagactgaaaccaagtaggaggagaaagaagaagcaataatggatgagggagaaaagcatactgacctcttcggcctgggatgccctgaggctgcctctgaccagcgcccccttccatctgcctaaatctcatctatctatagagcccattcaaattctatcactcccaaggagcattactggagtacaatatgccctccaaactctaattttctgaactatttcagcacccgttatgcgaaccccacaatgagcaacaattatagaatgccgtatgtcccttgctagctgttttacatgttatcagttttgtttccctatttaaaccattaagatgaagaacatgcaacataactcatacttttaaaatgttttccataatactggcatgcaaatggacaaacaggtgcttgagaaaaacaaagaaacaaacgaacaaacaaaccatgctccgttgaattgacacagcaaaactcatgcctcttaagagtgacccacagtatttcctccgtgggcagtgcatgaacccaggagcacatgaaggacatgtggctgcagatgacacgtgtgttctagcttgtttgaaaagcccaggtgtaacgatcaatattactgttattgttactctctgcatagaaagctaagtgccataagtaatacttaggaatgagctgtcatgcaaactctgcaaatgcctttgtgcatatatggatttaatttttctttcatttttgcattcatcatccagtgcactttctcattttatagaaagtcattaaaaagatcttcagtagctattttaatataatctaagttagttccttaggcgtttctctactgaagatcaattaaatgcttagcacagagcgacatcctgaaagaaatacaaaaagacatatgacagagttccctttctattttgaggtgggggaaaaaaaccctgttccttctgtatctccagtaccatctctcccgaggccttccatacactaatggttcaaagaatatgtcagtggcactgcactgtttacagattaatgacactggtaagtataaacatagcaaagtacggtagcctttttaaaataaactatcatatgaaagccaagtacataaaaataaatacattttaagaacacatttttaattctgacttaaatttctagaagatttgattttccctgacagtgtcactgaaaaatcatttattgattttaaatctctcatgtttcctgaggcagaaattaatttaatgtgattggcaacttccgtttccatacacaatggaatacctaaggaagcttccagtagtcacagcagtgaaacactatcacagccatatgaactcaagtaaagatctgtaaacttacatgtctacagttatacagaaaattattcttttgagggttaatgataatagacataagaagaatgaaaatactaaaaagaagatgaaaatatgagcctagggtttggattctttataagcaggtaggggtggaagaatcatgtggattagagatctcagcatcaggacgagtagaggggtaatgcctgtcaccaaggctattacagcggtctataaatggaagaagaaaaatgaggcaaaatcatattgggcaaaacaaatagcagtaatattaaagccagaaatctccttagagttcttactgttgggccaggtgtggtggctcatgcttgtaatcccagcattttggtaggtcagggcaggagcatctcttgtggccaggagttcaaagccagcctgggcaacatagcgagacccccatctcaacagaaaataaaacatgagctgtgtggtggtgtgaacctgtaatcccagctacttgagaagaagctgaggcaggaggatcacttgagcccagagtctgaggctgcagtgagctatgatcactccattgtactccagcctgggtgacagagtgagaccctgtctctaaaaaaaataaataaaaataaaaataaaaataaaataattctttctgctggtggggacctggcgggggaagtgtagagagttaatgtgggcacgtaattcctcatttgagaaagatacatgggcttaacaaatgattcaagaacaaataagcttattaataaatggaaaaataaatgaaggcatgaataaaagcagcaaggaaataacatataactaactaacagtctgcgtccctggatataaggagaaatatgtggtcaaagaacaatcgtaacaactagatgggaacaatgggagatgtggaatgggcaggtgggcttaggcaaaattagtggctcagaaaagaaagaaaaagaaaagtcatgtaaaaggattttaaaagacaaagtgaacagaattctaccatgttgggaatcattgagcaaatctaatttccttgttcttttctaccaaataaacttccattaaagttttcagtgcagcaaacaggttctacgtattggctccccatcatatttcctatgtaacccatgcctggagtaagcctctactccaatccacccaaattctatccatcctttaggtctaacgcgacgcaagccccccaagaactcttttattttttaggaaacttagaaaatagtaatctttctcttttcctgcagtcagcttttggaagaggggctacaaacagacaagggacagaaatatcaaaaggagaaaatataagtaggatcagatcttcaaagaactgaatattatagatttccttggttggggtcagaagaaagatgaaaaacaaagtattccaatcccactttgtcctaaaggggagaaatccattatacttccttcaagcgggctagcttttgatttctggaaccactggggacaatgggcttggcattcttttctatcaccctcccacctcatgttccactttcccctcttttgagagacggggacatctaaaatggagtcagtacatgtcccaaagtaaaggacagccagggacaggaagaagaagacccactgaaaggaacttttatttttcctttttgttttattattatttttaatgaattcctccagcactaaacctgtaagatgaacagatatcatctcctaggttattggccaagaacacactgcctcaataccaaataagatataatgcagagactctaggcaactcccgaagaaacaagttataaaagagaggggaagcaaaattagtggcaccaatggcaatgacgcaaagaaaaagaaaaaggaaagaaatgccaagctgtagccaggcaatgcaatgtaaaaccattgcttcatgtcccgcccacttccacacccactgagagtgctgttcttggggactagaaaacagcttgaggtaacaacagaagaatcaatgccaagccatacttatctctcagccaagacactaacctcacagttcatggacgttattgaaagacagaagacaaacacaagaggagaagatgaatgtggttctctcctgccttgtccaccacttccctaaacccagaaaggcactcctgtgccaaatctgtttaaaaatcatatgaatcactggcctctgtttcttttatgcatttattgtagaccagcctacactgacatcgatgagctagtgagatattgccaagtaataagcagccagagacattaagttactgaactttaatgaaataacagcttagaatttaaagacaaagaaatgtcttttatcgtcttccacatacagaaaaggaacatagctgcttaaaagatccactgtaattccccaatattctcttgtatccttattttaatatcaactgctgtatagctgattataatcattacgttattatatcaaaccctaaatatagaggtttaaataaactacaggattatctgctacctagaactaggcccaaatctccatccattcccatgactttaattcatgctcatggcgaaagatttccaaacaattctatcttctcatctcagagtctattagaacatgaactcgatgtctgttctgttgcatctttataacccctagaacatgcttaataggtatcaactgaatgaacctaggtctaatgaaatctcagattcagcttatgcaaaataccttcattccaactaaaccaaaactactatcttaatgttccaaccacgcttcggggctctaactttagatagtcttaactcatccctgtcctttatttccactatccagacagtccaccatctaggaaattttctttagaaaataaattgctaggctgggtgcggtggctcatgcctgtaatcccagcacttgcactttgggaggcagaggcaggaggatcacctgaagtcaggagttctagaccagcctggtcaacatgacaaaaccccatctctactaaaaatataaaaatcgtccaggcaggccaggcgcagtggctcacgcctgtaatcccagaactttgggaggccgaagtgggtgaaccatgaggacaggtattcaagaccagcttggccaacatggtgaagccccatctctactaaaaatacaaaaaactacctgggcatggtggtgggcacctgtaatcccagctactctagaagctgaggcaggagaatcgattgaacctgggaggcggaggttgcagtgagccgagatcgcactactgcactccagcccaggaaaccgcaagactgtgtctcaaaaaaaaaaaaaaaaaaaaaaaaatgagccaggcatggtggtggacacctgtaatcgcagctacttgggaagctgaggcagggagaactccttgagcctgggaggtggaggctgcagtaagccacgattgtgccactgcactgcagcctgggtaacagagcaagattccatctcaatcgatcaatcaatcaatagctaaattaaaaaaaaatccaaacacacacacacacacacacacacacacacacgcacgcacacacacacccctcttattcatctttacctctctgccacaaccctcccctactacactattccaggctggctatcattacccatattttggcagtcctgtctaagctggactttttactttcagtgtctgcataccagttacagacgaaaagtctcttttgctcagaagttatttatacttccctattacccacctactctcccaagtaaaattatgctcttaaggaaaaccattcaaagtccaagtttgtaacatatcccacccatcgagttggcctcctcattgccctactagtctactaagctactttctagacttatatttaacccatttttatccatttagtctattagaacacatattccatgagggcagggatttttcactgttatatcttcaccacctagatcaatgcctgaagactggacccttaaatatttgctgaatgaatgaatgattttatgaaaaacagaaaaaaaaaagcggagaaagggaagtagaagagagagtgttaaacttcacaaaggagtttatcattataggttcaggtcaagtcccactttcactcatcacttcagccttcactgatttctctcttctctgattttccatggaatttctgcaccgtacaattgagcactgaaatactcattgcaagaattcaatgaaaagttgagaacctcctatccaccaaactctgcacagcacagacatggtttatgccttctccaaacttatagtctcatagaaacattcaacaaagtcaattaaaaaccagctaccacaggtgcacatagaaagaacacttagactttgatgacagggaaggcttctcagaggaagggacagctaacggaagacttgaagggtgagtatgagttacccagacaaaaaggagggaggagtgtttcaggcagaggaaacagcatggatggagacttagaggcaagacagagtgtttaggaaaagtgtttgggaattgaaggaagttcagtggttctggagtacatgggcagcaaagagccaaagctgctggggtgggcaaggaccagactttcaagggccaagcagtcaccttgagttacgctgcgtgagctaaaaatgtgagttatgtgaagtcatgcataagttaattagctcgatttagccattccaaaatgtatacagatttcaaaacatgttgtacatgacaaatataacctttatatgtcaattttgaaaaatataaaacttttgaaaaaaaagctatgaaaatgaatatgaaagggaagctgggaaggggaaggggacagagagggtggacgcctcacatgtcagttctgcttctcagttattctggaagatttcttttaagaaaagcagagatctggtttcaggctttctctgtatctcaaaatgtctgttcaaaaaatgtggaattcacaagaaaacctgttgatttgaaaactttgattcttcctgcacctttcccacccaaagaaaaagaacagctgtaaaatttaacaactaacagagactaataagcaatttttaacgctagagacttcatcaactataagaaccttatgtccctttcaattttcttcccctttgagactctgaactagtcagtagagatttctgaaccacacgtcccccacaatccacaaacctataaattttcataattatgcattctgtaaaagcttaagcaatgagctaaggaaacagctctaagtggttctgatttcaatttctctgttgcatcagattaactgactcctttaacccacagcagtgtctaacattagtccatactcaataccaagttcaagtcaaatgtgggaccttgtgtaaggttcttacccaaaattatttcaagatgaagagggctgtatctagacttatgcagttctcctaagaacatgccaccacattaaataaaagtagcatgcaacaaccataaaacgaataaacaaaagtcaaagctcctaagacaaaaaagggtacagtgcaggttcctatgtaaggtatagattttaactggataatttttagtaattgtatatcaagaaaagatacccaacatctgtctcatgtattaccttcaaaaactcttctttctctaaatagcttgcactctctctgggccatgaatgaaatgaggccactgtgagaaattacaaatgccattctggaggaaaatccttcacatccctatcttgagcctactacacaggagaaggaaataaatcctcatgctaaaccttccactgaggaaattactaattcaatttctcttaccaacgttgctacaatgcactaaacatttctacccagtaaaaactcttatttatcacattcatttatttccattttaattagaatagcaaagcctacattccataaagactggaaaaggaagaaagcatcataaagcaaaaaaagcttcctcatttttgaaacaggaatatcatacgggatactagctactgactttcaaaaataagaaatatgctcaagtattgcctctttctaatgacaagtaatatgctgtgtttttcccaaggcaccacttcttttgagatattttgactatgaaatgtttccgtgggacagctctaaaaaatctgcatttattccacaatcacacaacaataaaatgaggacctgaccttctaggtatgaaggtaccacagcacaatcatcaacactgctaccaaatctcatctgctaatatgtaaaatgtctccttctccagctgacaagcggtaagtattctccaatataaacaaacatatacaccccacgttataactaaaacattatctagctttgacttgtcattgtggaggaaatacaaaaaccctttatatataaatattaatgagatgaccatgccttatagttgaactagcaatctgatctttaacgaagttgacccttagtacctctgaggaaagataaagaaaagatacactatatccattgttacattcactggcctttcatccatccactcaaaaagtatttattgatcactttctatgtgccagatactgtacgctatacactgtttacacatatttttggcttctatcccttaaaataccagtagcagctaattgcctcagctgtaacaaccaaatagatctccaaacattgccagatgtcctttgggaagccttgtcttagagtttaagattctgtgggcactgtttttcagaaatttaagatataactgaaagacaagatgtgtgtacttaaaatatatgaaaacactgaacaaataaatagccgataataacattttagagttggcaagatggctaccaaaaaaaaaatcacatgtacctagctaaggtcgaaagtaatgtttatttttaaataaaactttaaaaagataatttctttctaaaagtcattccaatctgtcctctctagaaaattcacccctttacctcccccacaaaataaacactcttcaccagcctggccaacatggtaaaaccctgtctctaataaaaatacaaaaattagctggacgtgggggcgggcagctgaaatcccagctactcgggagcctgaggcaggagaatcgcttgaacccgggaagcggaggttgcagtgagcagagattgcaccactgcactcttgcctgggtgacaagagtgaaactctgtctcaaaaacaaaaaacaaaaaaccttcttcatcacatagcaaaacatttattctgactatggactaatgcactcatggagtcagtgttaaaaaataaagaccagaaggatggaaacagcaaacaaatcatgaaagtgacattggaagattctgccaattaagaaaggcaacttagattctctatacccttcctcttttatctatttgatacttaaaatttactgccctgtatcaaacatgatctcagtaattcttttttaatcaactgtttaggacagcttgaggaaaggaattgctaggcagaaagacaacaggagaaacaataaatcttttaagtacaaaaaactgacaacgaaatgagaaaaatactaccttgtgtgctcaaaggaaattgcttatagaaactgaaaccaggactcagaacagtcatgtgttctactcaggaaattaaaagttgtacttttaaaaagggtttcagatccttccagaaaatctaaaataaaactaggtaactaccttccaggttttcctgggaacacttgccatttgaacagaaaatacacattgcaaactctccttggagtgtctgggtctttgcttttaaataaaaatgtttaccctagatccttctgctttgttttctgcccatcagtgagtaggatgcacagctatttgaggagtctgagaggtcactatggtttaatgggtagcaggaaatattctttagggaaaataagtcatcttttttccactgtttttcttttgagagagacaagtaattttctgtctctcatatacaactagaagaaaatggtatcactgtgcccctcagagaaatgtccccctaggagcatttcaggagagtcacctgcttcaagtgaggacaaatataaagctggtaaaaaaacaaccctcctcccccccgaaaaaaaaacccactaactacaaagcaagaaatagcgactgaagaatgcctaacgaactcgtactaaaacaaaatactgattgtagatggacatacggagtcatagaactatctggacacaccgtaaacagatatgagaaaagaaggaagattaggaagctacaaatcctgtctcagtaatctattgctctgtaacaagctaccccaaaagcgaggggctttaaatcatcatcagttcatttgctagagattctgcacaagtgcagtctggggcagaactcagtgagaacaggatgtctcaaccccatgtgctaatggccgagctgacctggggctggaggatccaagatgccccagtccaatgtatgagcatggtgccagctgcaagctggagcaccttgatgctcctacacatggcttctccctccagcaggatatcttgagcttccttccttacatggtggctccgaaactgccaggcctcttaaggcctgccgttacaacagcaccacttctgccacattctgtcacacaaaccagcccaggcttcggcgggaggggaaatagactctacactcctgatgaatggaacaacatgttcgtgcagggatgggagaactccaagtgatcatttcttccttttttttttatttttttttcacagatattctaccacaagccccactattgtgaaccacgataatataaaatgaaattaggaaaaagataagatgaccgggacgaagtaccttgcctacacacgccccctccctatcaccaccatcttctgcccttgactcttcaaccaacgaaggagagaaaagaaagaagagaatgaaacgtgcaatgcagactatagcatcacggacagcagcgttggttacaacatcttattagggtcctttaaaaatacagaaagagaacaaatgaaggagaacctagaaccaccacttactgctttttcttatgacttttggctcaatgtatgttttacacaaaaagaaatgctacaaggatttggtaccaggtaaacaatatataaattgttagggaaaaaaggaaaatctctttttttaaaaaatgagaggttctactttttagggtcataattgtataagttcaatgtttctagcatatctttctagaagaaagactagaacagccacaggtgaaaaaggaaactgataaatggagggggtaatatagtagatcctgtgacgacatcctttatcctgcactaaaactgcaatgctgcagaatgccatccccctcttgaaatcctgactctttgagaatagcaaatggtggtattactcatgcatgacctttgccaaaaagtggctggcagatgggtttgcccagcaaagtggagatgtgatgagattattctgagtccctatgcaagtagcccagttgagcctggacaagaatttcactggatcagaggctttttactttcacagaacgtagacaaatgtgccatgtcacaatggcttccactcacgtcctggtttatcatcattcctccctccactcctcaacagaaaccaaaaaaaaggcaattatctttcttccagctacagatgttaatcctcaactaacatcccataccggcagtgtctgcaatgtagtagaaaggctttgaagcctgcaaatcatttaggaccaaaaggaggaaatccaagtccaattatgggaaaatgaaaaaaagaaaaagagcagaaaagcccttcaaatcagaccacacagaaggccaaaaccacagatgaaaggaactgagaagctatgggttttttttgctgccttttaaatacagacccctaggcaaaggcagcacttatttaacatatccacaggtattaaagtctataacatataaggtgctagaaaaataatttcagtgattgttacttatgggtctagataattcttaatattgacaaacattggtatccatgtaaaagacaaaagtagaaaatatcactaaacttggaggtagaaaccagacttgaattctgcctctatgtatagcctttggaaaattactttttgtttcaaagcccaagtttcttcatctataaaaatatggattaaaaataccttcattcaaagagttgtactataacttttcaatgaaattcatgtatatgtctgaaaaacagtatctaataaatataaactgtgtatgattctgatctttaatacagattaagactcccaagtaaaagtcctttttctttttttaaatcatggaaaagacacaaattttgttgtcacaagatgatggttcaatggttctaggtcagattttgttcctcctggcaagatgatcttgggtaagtcttttctctttccaagtcctaggttctccatttcatttatttgcttgtaaacctgaattcatttggaggcactaacagtaaacacggcaaataaagtccccgcccttatggaacttagcaagtcatgaggagacctaaaagcaatgaatgtacagtgttggctactgttttctaaacgatgaggtgactgggttagaatatcttcaagaccctctccagctttaagcctgtgaacccgtaactgtaaatataaaagtcaacaaaaagaaggaagaccacagtttctcattctgatgttttgtaaggtgttaaatcattttttctcaagccaaaatcaaaagcttccagagaacagcaataccattacaaaggctttctgaattaaaaacgaacagtcctcatctcagttgaaaacttaaaattctactgttaaagggaaaatcaagtcctcacatcaaagactgtgccctttatccccttgaaagcaataattcagagtaatattggcacatacgccgaggaccactcatgccttagcatacagaatcagaaactgtttactaaaactagggtctgttgattaatcctacattcagtaagagtttgagaagggaataatcaccaaaaatccctaagttctctcctctgatcatcagtggggctgtagttcaactccaggaaaacactttatagagataagaggagactacttaccgccagggcagaagagcatgttgagatacggaaataatggtgcccaaaaacaagagatgaaaaaaattgggaaagcttcacctaagaagagataactatgttgaatcatagaagtaatcttcaattatcagaatggtcattgagatactcacaatcagagtaatacactgaatggcgaatggacgataaacgtacccaagtggacacactactccctaggataagattcccaggggataggaatgctttctttgctgcctttacactttatattctttattcgccctacaaacatatttaaggctgtagtagttaaatggagggtaggttctacaagcacagtttttctctgacagatttctatctcctggtagcatggtttttactggcaacctcaagtgggtaagccttacataaaaagcttcagttttcagaatgaatcagacaaggactaagaaataatgatcataagcagttagaatcagtacaaatttatgaggctgatgaaactatgggaaaacaaaggattattggataccaacaacagttcttcaaataatttttcagtgacacagcaccagaaattttctgtttaagtcaactaagaaacacgcacctgaatagtaaaattaagttttaggaaacttatttggcaaattgaacaaagattgtcaagcagaattcattaaaaatacaaagaataaataaaaacaattgatttttatggatctaactataaatctaactagatatatctaactacaaaaaacaatctaactataaattgtttttatggaaagtagcttctgacaaatttcaactttcttaaaacaacgtagaattccaacaaacttgagcacatctcctatgctacagtttacctatttaagtataagcataaaccttatatatctcacgtaatttctataacctccaacttccatacttacaaactctggaataagatgccctatattatccaatcaacactctagctctgccacttactgtgaaattgaaggcaagacacttaactactctgctccttagtctgtttcttctttatatctaaaaagtaaaataatggtacctaccctcaagggttactgaaagaatcaaatgtgttaatatatttaaacactagaataatgcctggcacaccatgaaaatttttaaatgctgggaattttatcatcaactgtgtttattagtatacatatttatagacgagtatgtgttagtaaacaccatttactaaactgtttactaaaactagagtctatttattaatcctacattcagtaagagtttgagaagggaataatcacccaaaatccccaagttccctcctttgatcatcaatggggctgtagttcaactccagggaaatattttatagagataagggcagattaccccagagcagaatagcatgttgagatacggaaataatggtgcacaaaaacaagagatgaaaaaaattggaaaggtttcacctaagaagaggtaactttgctgaatcatagaagtaatcttcaaatatcagaatcgtcatcaattaaatcagtaattagacttattatttgtttttccaaaggtaaatttggctgatgatcagaaaaatcttttaaatcaaagctttctgatggcaatgagcattctttccaaatgaatgctaacattaaaaacaaaatgctgcttttcaaatatagagagatgattatgctgagtgtgagcctggactagatgacataaaaaaatctcagaattgtagaatattaaaatgtgaaaaggacttcaaagtcatctgcttttgtggtttagttgtccattggaatcacctggggagcatctgaaaaaatactgttctctttccagatcaattaaaatcagaactttctggggatagaggctgtgcactattttgctggtttgttttctttagtctttgtaattgtcccaggtagttctaacatatagccacagctgagaaacactgcattagttcacaaatgagaaaaatagggcccacagttagaaaataatggaactttaatttgaacccaggtactatgctgtgctatttgtttatttgtgtgtgtgtgtgcgtgtgacggggtcttactctgtagcccaggatggaatgcagtgcatgctcatggctcatgcagccttggcttcctgggctcaagcgatcctcccacctcagcctcccgagaggtgggacttacttttttaaatatatttttgtagagatggagtgttgccatgttgtccaggctggtttcaaactcttgacctcaagcaatctgctcgcttggcctcccagagtgctgggattacaggtgtgagtcactacgcttggcctctatgctattttcaataaattactcaaaaggtctatggctttataatatgcataaggctataaataagtcttgcaaatatcagtttcggaggggaaagtatataccttattttttttccccagggtacagactgttctctggtctattatcactttctaactttaaagacattatttcactgaacttcagtagaaaatatacacaaaactagtcttgcatcatggggtttacttctaactttgattttgacctacttgagcctgatttcctattgtttttgcaagtatgcccttgcacagatccttatcacacaggcaggaggcagaggctccctctactcaatttgtgatcaagagaaactgcttataaattattttctgcttgcagatgacaccaactagaagctatctttgctagattttaaaagtcttaatcagtgtgaaattgggagaagggcaaaggaatggaaatcaggaaatccgaatggctaacatggggtcacagggaaagaagagcaagcccagaactgaatgttaattccacagctcagcctctacatcacaaactgttaccaggactttctggtgaccaattttgcatatcatttcaaattagaggcctcctggcaggtgggaaaaccatggcagtgagaaggacaagtagctgtccttctctctgttctgtctttacccacactaattagggccttaaacaactcactatctctctgaaactccttttctcatttataaaatgggaaggttcatcaagatcatctcaagggtgacttcgaattacaatgttctatgatgagataacatctgcattgtcaaggaggacagggctggcctatgatgtttatactgtgaatagttgcttttcctgtggacagaatctaccacatgctaaatagaatccacacagcagccatattataaaagggatctaccatacacatcacatgttaaatttttaatacagtaatcattatcagaaatgtgaattccatcacaggttaaaccttaacacaagtaggctgaaaatcaaactggcatcttactctcagcaataaagactcgtactagccacctgataactccatgacagagatataaacagcatacacattcaagggcagactatagcttgaactgactgatcactttccagaaatgctattcttggattgctaagaagtaagctataccacacccgctccgaaaaaaaaaaacaaaaacaaaaaaaacaccaagaaatcccttcacctcaaagaatattctagaaaaaaattctagtcattttttttgttctgaaatgtaccttttaatatattttaaagacaaaaaaataccacaaggatttcttttccttttaagaagaaccttcggctcttaggtatcacagattgttcagaacaacttggactaaaggcggatttcgcctagtgatttaattaataaacatgtttgtggttcaaaaatcattttggaaggcacatatggaaaactaggaaaacttcagatggatgaatatttagtaataaatatatttaaggaagaatattaaccaaccaaaaattaatttaaattgaaaatgcttcccagttataatcagtaacaaggaagcagatgattcccccacaaaaatatagaactgtaggcaataaacagatctttgtggaagaaaaagagtaagctatttaagggaaaaaataggtgttcccatacttaattattagttataaactcgctgttgaaataccaagagtatttaaagaaacaagaggccgggcaaacctggaaaacaacacatgtaaatacagtgcctttgtctggactctatagagaaccagaaagtgttctaaaacatctgttttattatagggttgaaaataaagaagaaggtaatatgtactttgaaatctattttctaatttccatttttcatgtgtctaatagctaaagataacacattcattttataaatacagtaccactattagctagcatggtcacagggctctaatttatcctatttatagtagcaaaaaaataaaccacattttttaattataaatcaacaacttatcattgtatatatttgaggatacaaagtaatattatgatttgaaaattcagtgtgaaataatcaaatcaaacaaattaacatgcccattacctcaaatacttttttgcagtgagaacatttgaaattgacctggctttctggctaagatcaactatagtatctgtcttcatcagtctaattctaatatttgtaaagaatattagaaatcagatgaaagtaacattatcagctatctttagaacataagttatttctaaaagaaatgtcaagaactcacaaataatataatatcaaatctgggataacagactgcgtagtaactttcttgtgcatggacaagctcacagggacaaaactgcaagatgttcctatcaaccagagtggaggccagccagcctccacgagcaggagctgctgtccatggagctgctctggacccactccacattcccctagcacggcgttgctttcctgtcttctgttcccaggtctgatctccgactggcccgcaaaactggacgctgacacgggttccacagtgacagctcctgctgtgttaactcagcctggatcgcccccacactgctttatgagcactaaattttggcaacctactctctctctcctcggaatctgacctcaactgcaccctttctgttccacttcacttctcctcaattctgacagcttgcagtgaccttccctagctacaaagagaaaactgtgttgggtttcatttgcaaaattctcaagtagaatccatcacaccttcagtcctgttctctaagggcccttttagcagtcacattattgccctcttattattggcagagagagtctgagtgaccttggatgaatctcaactgctttttgagcttaaccttgacagcccctcggtttcattacctaatgatttaggaatatcagactatctagaaaatcttttaagattacttccatttctaataacctgctcatattccttatctcagtgaaatgaccctaccaggtacttaaatcccaaaagtcacatggaaatcctctctctcactcatcctcatattcaaatgaacaaatgattccctctgtcccacgactttgtctcctagtcctcctaatgtcccttaaacctcagctctgtgaggctgacttcacttcccctaccttccagctgcttccgggttcagcacttccactagactttcccagtgacttccggcttttctctgagtgtggattaacctgggtgcctccctgaggtcagagggcttatctgaccctcaagaaataagtcctggtgcaaagccaaaaatgaatgaaggaatgaaagggagaaaggaaatatctaaagattttcagatcctaacataaaaagggattaaaatattgttttctgttgtctgttttttaaatcttagaaaacacaacactgagtaagagggagatgagagtaagtggtggggagaaaggaaggaaggacacttacaggtacgagttacggtccagagaacgagcgaagcatgtgacacatgtaatctcatttcctcctgtaacaactgttcacaagatgcgatgtcatctccattttatggttagagaaagtggactctgaaagcctccttaatttgcccaatgtcacaatgccagtaagtgtcagggtcagaactttaaccaagatgatgtgactccaagagtccattgatctttccctagagtttgttaccatgatgatctcaactttacaacagtggtccatgggagtagcttatatcatattaaaatcttagaatttcagtgtgcaggaagaagagtttaaaaacaatcctagaatttaagaaaccaaagtatttgggaaataggagggaaaactccaccaacactgcagctgtgctattcatctatagactctactcttgtactggcactagctacatatgtcggcacctttgaaatgcagtattttaaaatccaatcctgtgctaagattatccgtcctatcagcggcatgctgcattttgggatgccctctcccacctactttaagctctccagagactgtgatacaacaatatgggcttcaacacactgcatctaattttattgtaaaaaaaaaaaaaaaaaaaaaaaaggctatgccatatggttaccaacaaatgaaatagtgactgttgcaaacagaataaaaaagcaggtggagccctgacaaaaaaaagtacaactgaaatgagatctaaaagatttaaaaatagctggtcaaccagtaatgtatacttaaacgaaagtgtttaagaaaccaggatgaaaaatgtataaaaacattaccaggagtaatatgaggaaaataatgctttcgacattttcattttatccttggaaagctttggtgattcaaatttaaaaggactataatagggaagatataaaaaggaatcacaagtccaagagaacagaagaaagtttcaccttttgttctaatttcttagaatcatcttcctatttccttgcaatatacctctttaagaaacctggtatactttgctttatatatgatttaccaaaaaagaaaaaagagaaagaaacaaaccaaccaaccaagcaaccaacctagtatcaccaaaaccacaaagacagacgggccttaaatttgctacgtaacctgtatacacttaaattagaatggtcaggctgagttctctagtaaacactataaagaacttcagaatgacacaggcatcaaaccaagcaaggaagaaaaaatctttataatcgtgaaacaaactgatgttatatccaaaatataaatataagcatattctttgaaaacatgtagttatttccatatatattttacctacagtgtatataatcatagatagcttttgtgaaggtattagtgaattccggatccccctgtaactcagttggcccatcaccacctaaagattaaaaagcaattgatatctatcctatttttaacttcagtcctggagattacatcaccattttggtgcccaactccaggttttaatcactctaataaaaatgtcaggaattatttattactggcaaaatgctacagtttagaagccatttggtttatttttcataaagacaaagagctagtcatacccatccttacctaggttatccataacctttcacaacctaggattatacactagagtaattagttaatcttccaagttaagacccacatttcagagaactgtagacatcaactagttttaagtggctgagagcacagtcaggtctcttacaatttccaatgtgagggacaagtcatatgaccttggacactatgcgatgcctttagctttagaaatagttttcatggctggttttacttaataaatattgatagcaggcttctcttaaaagttgctatgcatacttcttcaactgtattgcaggaacaaagggcaaacctcccctttgccctttgaaggttcactgaaaatcaactggccaaaggtagaataacagcgaaaaaagcatacaatttattaatatgtacaagggacaatcacagagtgattccccaaatattccaatggggccaacatactcctacagcttcttttcatagaggagcggggagatagcgaatgcagggaactctgtcaaagggcaataaatgattaccaaggagaatgaacggatgggaaaacagagatgaacttgtaaatggtcctctttagaaaatgttcgagcatgcttacattctttagtattctttgttacaatagataatgagataacaaggaggtgaaggacaaacagtcgttctccttggtgggtccagtctttacttggatgggggaaaagtctcttcccacatttactgatctctaagaacctttcattcaaaatacctattataccagggagccatattttggagtgaagttccctggataccttcagtatactttatgcaaaataaattttaaaatatttaacttagaaagtggaagttcctatttgggaggccgagggggaagattacttgaggccaggaatttgagaccaatctgggcaacacagaaagaccctgtctctattaaaaaaaaaaaaaaaagaaagaaaattagctaggcttggtggcacatgcctgcagtcccagctactttgaggggggaggttaaggtgggaggatcccttgagcccaggaatttgtggttgcagtgagatatggttgcatcgctatattgcactccagcctgggtgaaagtgcaaactctgtctctcaccaccaccaccaccaccaccaccaccaccaccaccacccagaagttccctaatatgctgctcccctgacatcaccactattaacacattcatcttctagattctcacatatgaattttaacataaatggtatcattccatacttaattttgtattgatgttccccaccatcaattccttgaaaataataattaggtaatcatattttatgaagtattttttatgtgccaagtatcatcctgtaggctttacatggattttcacatttaaacctcattcctggttcataagtaggtatatttacttttcccaagttccagatgaggaagctgatagaggaataatttccccaaggtcacagaattggtgctaagtatcagagaatccaggcagcatgaataaagaagctatactcttaaccccttctcttcactttgccatccataccactactcataactctacgtggtctttttaacaactgtattaattacatgaataaagtataactgatgtaatccttcactgatcgagatttgtattattctcaattttttgctattgtatacaatgctgcttttaatgtccttgtacacatacctttgtacgtttaactacccagcatctttcttttttcttctgaaataattttagacttacaaaaaggttgtacaaatggtacagagttcctgtaaatcctccacccagtcttcccttaatgttaacatcttacgtaaccatcagtgcaattatcaaaaccagaacgttaatgttggtatagtattaactgaactatacaccttattcaaatttcaccagtttccccattactgcccttgtcctattccatgatcctctctagaacccacaaggccttcagttactatggcttcttagtctcctccatttggtgacagttcttcagtattcccttgtcttttatgacctcgacacttcaaaagaagatgggccagttattatatagaatatcttgcaatttgggtttggctgctgttttctcatgtttacaatgaagttaggcattttgggaaagagaagtgatgttaagtgatgttatcttctcctttagagcatcagaggcttcatgatgttgagatgccttgccactggtgatgttaatcttgatcacttggttaaggtggtatctttcactgtctacattgtaaagttagtattttcccctcataatgaataaatatcctgggagagatactttgagactacacaaatatcctgtttcttccctaactttcatctactaaatttagtatccttcaatggctctatcaacaacaataattactgcgatatttgccatttcctcctttcctttcacaattgttaaaatttttctgtaataaaaacctgtcccttctccacaatttttaaaatgtattcaacggatattcattttcttctctgagtataatctaatactatcactttgttgctcaaattgttccagctttggccattaggagctcctccaggttggctaggttggccttctggcacaccaccctcttcttttgagcacttactttctggcaccacaagatgttctaggctcattttatattttccctgccccaggactacaaccaaccaattctccacagagcattaattcattttactggtgaacagtatttagaaaccaaggtctggaagctacgctgctcattgatattgagatatcagtgcttctagatccgctcggcaggcagagctaagaaatatatgcaggcgtatatttacatgcatatatacatacccatcatgcaaactcacctacgtttctgcatcaatccatacattaaaaattacaagttcatatgaataacgtcaactggaatccaataccacagggttccttattcataatttctttctcccatagagagaaaactgcctcttatcatctatagtatgtttgtttatttgcatatcctagtatacagataaagtaatgatagaggcagacaaatgcctagacagacagacagaggcaggtcccctgcaaaatcctaccttcaggccaaagatagtttaaagcctgaaagctgagctacaagttaaatctttggaccaaactgagagtgtcttcctgtctggcatactttcctctgatgggtccccacccttcacgtattttacatataccctttcctaattggtttcctaccctttcctaattggtttttctacactgtcctgcccacctttgagtggtgtttttgctttaatcttttttgcatacttacaaaccaatcagcatgcactccccattctgagtccataaagggccccagacccagccacacagaggaaccccctccctcccctgctgacccttgctgaaagccgttttcataactcgaaaacattcttctccatcctcctcacccttccatgccccacgtgtcctcattcttcttcagtgcagtctaagagttcggaaacaccaaacaaaggtacaagctctaacacaggtaagctggggcacaccagcgtggccaagggaggtccagggggggtgttgctggtcaggggtccccaccttgcgaagtgaccaagaagaaaaattctgcatcagtaatagtttcagaattaatagctcatacccctgtaaaagacaaatttactaactggagtacagtgtttgtgtactgttctttttgtcttcaaccacacggcatacagttaaaaaactgtttttcaaaattatttatgttcgttctttccttttccattccctttagtgtaaattacaaaatacttaatttgtaatacaattaggttcatttgttactgtttatactttccactttgagttttcatggactggttggtcttaattattaatttgtatcctaagagggtaaatgccagggttgtgatttaatgtagcaaatgaatagaagggcacattcagtgaggactgaaagaaatgcccttaggcatggatattttctcagcatgtttgtgcttgcatccatgtgcctgcttgctctctctctctacctgtgtatgcatagcctcagtttttaaatggcggtgtcacctttgttcatatgagataatgtgaagcttagaaccctatagattttaagattgaaaagggcttctcaaacgtaaataatgcccccacatcttcaattcttaatactaacgatttaaaaatgtaccacaaattggagcttggccttttcataaaaatgtatgtgggtacctgcaggtgtacagacacagtttacttgaagttaacgacactggaaggatccttataataagcttttaattagatattacaaacaaggaaaatataggaacatgagagctggaagaaattacctaagagagtttctaaaggtttggtttcatttttaaaaaatcaattttccctacaggaaagaaaccagaagtggacatgactgacataatagatgggcaaagtaatgtattctcaaagtcagatgcattgtggaaacaggaagagaaaactacaggtgaaagcaacagcaatctttctgaattatcagaaaacataccttagcatattaaagtgggaaaatgaatggaaaaagaggaaaccagaaacagttcccagtgtctctgaatctgaaagcacaaagctttaatcagaacaccagcagagattatggctggatagtgacaagaatgagactgccacatggtaaggaaggtagtgcttcctttccagctgctaaatagtgccaattaactactatatgaattacatgtgtaccaatgtctgctcagtatgcagagagcaactccaagaaaaggctatttttcttatcaaagtgagtaaaaaaaaaagaaaaaaaaagacacagaagaagacgagtttccttttgcaggcctctaatcatcaggaccagcacttcaggtttcggtggaaggtgggaagagaaggaaggaaaacaaactctggcaagagagagggagaaaggtttggaaagactacggaagtcttcgtatgtactagaagctttaagggcaaaatatgagtcaccaaaggcaagtgaaattgctgatctctcataaaacaccccttggctttctgccaccataacttccccttttaatcctatttctcatatgcagcatgtgaaaaaaggaccagctggctgcactggttttgttattttagcccttatgtatacacactttaaaaggctgaagaaaagcaactgtgggcagttacatcctttgtatttttcaaaggttggcagaaagtattctgtgactcctttgtatagatgcatgctttcaaaataaaaaggtatatacaactctttttaaagcttataaataaattaggtgaaaaggaagggaagtggtagagagtaacgctaataaagatttttccaggctgggcgcgatggctcacacctgtaatcccagcactttgagaggccaaggcgggcggatcacgaggccaggagatcgagactatcctggctaacacggtgaaaccccatctctactaaaaatacaaaaaattagccgggcttggtggcaggcgcctgtagtcccagctactcaggaggctgaggcaggagaatggcgtgaacctgggatgcagagcttgcagtgagctgagatcgcgccactgcactccagcctgggcgacagagcgagactccgtctccaaaaaaaaaaaaaaaaaaaagatttttcctttatgtggaattgttatagaaaatcagttataatacggcagtaatgtttagagacaccaaggacctgccaacatgacctcatcatctctccacacaagctgggactgtgctgaagttatcatccacctaaagtagggtacaaagcccactcagaatggtcacagaggtaagccctgtggggcaatacaaaaggagagtgggagacttttcccaaaggccacattctctggtttgtatcagtagatatggagcttttaaaagtttagaaataagaaaatcagatttcacattttcatgtgtaacgctactcagttctttctaacagccaaagagaaggtggtacaacaatcacaccacacaactgtcttagtccttttaaaataatgattctgcatgctacgtgttgattatcttcttgacgttcctcttatttctactttgatctagaaaaatctgatgttaggagcctgaataactctgtaaatagtaactaacacatggagtacattcaagggatatggctgctcttagtggaccacacgttatcatccttcctgtctccacactggcatctaagctgttaccccacaaccagagtcccttctactccagctctatagcacccatcggaactacgtttcaatagacgacaaggtgctaccatctcaaaggggcttttccagatgctgcccagttgaaagtcatttctctttattctgaaatcccacagtattttatacgtaattccgcatttatgcaggattttaaagatgctggccccctaagagtctcatcccttgatgatttaatcaaatgttcatctagccactgctaagaaggcacacggcagatggaactaaggttactcatcaactaaccttaatagagggagattattctggattatctgggtgggcccagtgtaatcacacaagaccttcaaagaggaagggagaacaggcactcagaagatgcaccagaaaaggaaaccagacaaagacgaggcaaaaagaagaggatgaggaggtcagacagtaccagagagtgagaagaacttgggccatctctgctagctttcaaaatggaggtagcggaccacacgcaaaggactaaaggtgaccgctagaagctgaggaggacccctgggcaacaaccaacaagaaaagggggaccgcagtcctatgaccacacagaacttaatccttccaacaagcttaatgaacttgaagcagattcaccttcagagcctccagaaatagacacagtcctgcctaaatcttgatttggaaatggaaaaaccagaagtagaaaaaccagccaagcaaacccaaacctctaacccacagaacgatgagataatgatcaatctgtgttgtttcaagccactaagtttgtggtgatttgttaacgacagcaatataaaactaacacattctccttcatattatatcctatttaatagttcaagtctcagtgggcattagaactgtgtccggaattggtgggttcttggtctcactgacttcaagaatgaagccgcggaccctcgcggtgagtgctacagctcttaaggtggcgcgtctggagtttgttccttctgatgttcagatgtgttcggcgtttcttccttctggtgggttcgtggtctcgctggctcaggagtgaagctgcagacctttgcgatgagtgttacagctcttaaggtagcgcgtctggagttgttcgttcctcccggtgggctcgtggtcttgctgggctcaggagtgaagctgcagatcttcgcggtgagtgttacaactcataaaagcagcgtggacccaaagagtgagcagtagcaagatttattgcaaagagcgaaagaacaaaccttccacagtgtggaaggggacccgagtgggttgccactgctggctccggcagcctgcttttattctcttatctggccccacccacatcctgctgattggtagagccgagtggcctgttttgacagggcgctgagtggtgcgtttacaatcccggagctagatacaaaggttctccacgtccccatcagattagttagatacagagtatggacacacaggttctccaaggccccaccagagcagctagacacagagtgtcgattggtgcactcacaaaccctgagctagacacagggtgctgattggtgtatttacaaaccttgagctagatacagagtgccgactggtgtatttacaatccctgagttagacataaagactctccacctccccaccagactcaggagaccagctggcttcacccagtggatcccgcaccggggctgcaggtggagctgcctgccagtcctgcgcgatgcgctcacactcctcagcccttgggcagttgatggacctgggcgccgtgcagcagggggcggtgctcttcggggaggctccggccgcacaggaacccacggaggcggggaaggctcaggcatggcgggctgcaggtcccgagccctgccctgtgggaaggcagctaaggcccggcgagaaatcgagcacagcgctggtgggccggcactgctgggggacccagtacaccctccgcagccgctggcccgggtgctaagcccctcactgaaacgatccttacaagatcaccctgtgaagttgttccagtttcttttttgccacataatattttgctcaaaagacatcaccagaggaagttagaacatgacagaaaaagagaacaacttctggagcagaaggggagcggtgacagggaggggtgaacactggacacaggctccagaagcctaaaccgaaaacctgaaaaccataggcacaggccaaatatcttattttacaaatgaggaaactcaggcacaaagtgaaatgatcacccggaggcgccaccactagtcactagcaacactaaggcaggcttagagcccagcgacttccataacccagtcagaacaactagtgcattccacacgggcacactgctagccacttaacacacctcatcatatttaattctcctaaccgctcttagaggaaggtgtttttatcccatgccgtacctgagaaaactgaaaaggattaagttgcttggccaaggtaagatattgggattactttccagatctgtaactactcattttactctgccacacagccttccatgacattcagcctaacaggccaaataaacattaactgggatctggacgcggtggctcacgcctggaatcccagcactttgggaggccgaggtgggtggatcatttgaggtcaggagttcaagaccagccttgccaacatggtaaaaccctgtctctactaaaaatacataaaaaaaaaaaaaaaattagctgggcgtggtggtggatgcctgtaatcccagctactcgggaggctgtgtcaggagaatcacttgaacccaggaggcggaggttgcagtgagcaaccatctgaatatctgatcataggtatagctcctctctctcaaaaaataaaaaattatgcatatacttacacacattaacaattctacatacaatatcaagttgtacatgcagaatcactgacactgtgttttacggaaaactgaaattatttctttaatgagtatttgttgagtatctgatctgttctaagaattacactaggtatgaggcatactgtggccaacaggagggtctcttgtccttaagaatactggaaggaaggagatcaaatgcaagtgataagcaataccaccatctaatcagtaagttctcaaaatccctaacttttcaaatatatatattattatatatataatatatataatatatataatatatgtaatatatataattatatattatatatattatatataattatatatattatatatataattatatatattatatattatatattatatataatacatataatatatattatatataatatatataatatatataatatattatatttgatatatatcaaatatataatcatatatgatataatatataatatatatatatttttgtctaagtctatactgtatgacaaacaacctgaaatgcaaataacctttcgagatacgattttgagtatacatatttgcctttcattgctgtttttgggagtgaaagaaagagcatggaaatgaggcaaaaagagtaacaatgtacctgtcttgcattctcaaggaataattgcttttgattgcttttagaataggtaacctcatcgtgacatgatttgctccaggagcaggaattcacttccctctgtgatcttttacaaatggcagtggtttccaaatgaacagggtaagttcatttttttctgggaaaaagtgtgaaggtatcaggatttttctcaacagtctggggtgatgatgagcatggtggttcacgcctgtaatcccagcactctgggaagccgaggcaggtggatcacgaggtcaggagcttgagaccagcctggccaatatggtgaaatcccatctctactaaacatacaaaaattagtcaggtgtggtagcgtgcgccttagtcccagctactcaggaggttaaggcaggagaatcactcgaacccaggaggtggaagttgcagtgagccgagatcatgccactgtactccagcctaggggacagagcgagactccaactccaaaaaaaaaaaaatccacacaaaagaaaagaatgtgtgaactccctctgacaagatggtatgttgtgaagaggaaagttcatgtacctgcattatccagaaaatacttccttgcaagatctggataatgtggcttctggcgtttctgcaaaaacaacaatttagcacaaaaactatgctgctatctatggaaagtttaagggaagagtaaatgttaaaacaattaaaacaagcaaataaaatgttttaaataacagtaaaaatccaacattgacagggaacagagttcaagaatggttttagatagagaaatgaattatcctacattagcgcattttctgattgaaggtaatttctttaaatgccaaaaaatctttataagatagttttactggcaatctttccaatctatttcacactccctgtctccttaatcaaaccaagtaaacaaaatgtaacatttttgatgactcactaagtacatccattactttgcagtgctgtaatgcagccattctgagaggctactgacgacacagatttgactgcctctcttcaaaacaactccagatgtaccatttggagacctagtgccctttaaggttgcaacattttctctttacctcattagcaaatcacttcttgctactgcccctctatctgaggaacatcacttccttgaactccattcttctaattcatggccaaactgagaaaacaattgtttctttaaaataatttcaatttaggccaggtgcggtggctcacgcctgtaatcccaccactttgggaagccgaggtgggtggattacctgaggtcaggagttccggatcagcctgaccaatatggtgaaaccctgtctctactaaaaatacaaaaattaggagggcgtggtggcggatgcctgtaatcccaactactcgggaggctaagacaggggaatcacttgaacctgggaggcacaggttgcggtgagctgagatcacgccactgcattccagcctgggcgacagggtgagactccatctcaaaattaataaatgaataatttccacttaaaaatttatgtaataacctaaatgtctgtgttctattaaattcatcttattaaaatcagttggatttggctattaacttgcccacgaacagctggctcggtgatagtcagcagtaacttgtatgctggtatttgcctgtgtctacaggcccaagattatgatatgccagggggaggatcaggtcaaaaatttcaaagtgaaaactaattgtgggtattattaaaaacaggatctaaatacaggttgtgtgaaatttgtgaggtcagttattaatacatggactctgtaattattctggctgttgagagttatttttatttttttgcttgttttcactttttttagtcattttaaaaaaagattgacctttagctaagtgaagcattactataacaacacactgttttcctttatgggatattttgactatataattataaatgcctttaaaataaaatttgtttttctgtatccttattggctaagtaaataccatgttcaggatagaatatttgccatggtagttccacttatccttgcattgctggtctgctgaaaggagggcatcaatcatcccaaggagctcctcagtctcctgacatatcataagcaaaaagaggatagcttttattcatgatgtgaccagttacattcatatcaataatacatgctcatgttagtgagaggggcagcaatcttggactgttatgacactttaaacatgctccaaacaaggccgggtgcagcagctcaagcctgtaatcccagtactttgggaggccatggtgggcggatcacttgaggctaggagttcgagaccagcctggtcaacatggtgaaacccctgtccctactaaaaatacaaaaattagccaggcgtggtggcacgcgcctgtaatctcagctacttgggaggctgaagcaggagaatcgcctgaacctaggaggtagaggttgcagtgagccgagattgtaccactgcactcctgcctgggcaacagagtgagaccctgtctcaacataacataacataacataacataacataacataacataacataacataacataaaaatgctccaaacatacaaacattcaaacgtctatggatgcatctgaataggaaattctgtagcacttcttcatgatcaaattgaaaataaatttcaatataaattcccactgggaatcattaatattccattacagtacccttaatgattacaaccaccaccactcaaacttttttccttttttctttttttgggggttaaaaatctgtttgtactcttaagcagcatctgttctgttaaaacattgtaacagacttctttttggtaatttttttttttttttaagaaaacacatgaacatgatttgtggatcttcagttacttcaaatattaccctcattatcgtcaccatttttcattcatggtctgaaccacaccaaaagcagcatcattattctgcccatgatgagcacgtgatcgaaagcgaaagcaggctgccagacctccacggggagggcagaagcggaaacacgccacgcacctttcatcacctaactcagcttgatttactttactgaaaaaagcagcaatattccatattttaagccagaacctttaaagcttttctcttaaaaagcttgcaaacctagcttttctcttaaaaggctctccgacttacacaggacaggcatccaagccctcttcctccatggatactgttgctaccaggtttccatgaccttctcttggaaagaactcacctactctaggcaacagttgatgctctttttttagctacacttaaataccacccataagttcctattttcaactacatactccgaatataactcagatcaagtatttttgagaattcagttcaggcttttcctttataaaaagttcagacctttttctgactgaggtctgcttcttcctcttgtgtagtcctttgggaataatcttttgaaaatgctgcaatgacaaaagcaattttcttggatttaaatctgaacattctctggtttcattattaagtatacacttctttgtctaaaccagtaaatacaaggtgagagctaagagagttaacactttagaaatgcgatttggattcaaaatgacgttaagaaaatgcccagcacttagactgaaacgatccttacaagatcaccctgtgaagttgttccaatttcttttttgccacataatattttgctcaaaagacatcaccagaggaagttagaacatgacagaaaaagagaacaacttctggagcagaaggggagcggtgacagggaggagtgaacactggacacaggctccagaagcctaaaccgaaaacctgaaaaccataggcacaggccaaatatcttattttacaaatgaggaaactcaggcacaaagtgaaatgatcacccggaggcgccaccactagtcactagcaacactaagacaggcttagagcccagcgacttccataacccagtcagaacaactagtgcattccacacgggcacactgctagccacttaacacacctcatcatatttaattctcctaaccgctcttagaggaaggtgtttttatcccatgccgtacctgagaaaactgaaaaggattaagttgcttggccaaggtaagatattgggattactttccagatctgtaactactcattttactctgccacacagccttccatgacattcagcctaacaggccaaataaacattaactgggatctggacgcggtggctcacgcctggaatcccagcactttgggaggccgaggtgggtggatcatttgaggtcaggagttcaagaccagccttgccaacatggtaaaaccctgtctctaccaaaaatacaaaaaaaaaaaaaaaattagctgggcgtggtggtggatgcctgtaatcccagctactcgggaggctgtgtcaggagaatcacttgaacccaggaggcggaggttgcagtgagcagagatcatgccactgcattccagcctgggcaacaaggcaagactccgttgcaaacaaacaaacaaacaaacattaactgcgtagagaaaattcagattctactctttgtttcttttctacttcgttcaggtaagggacaaaggggcaatgaggaaaccagtctaccagcagaatctctaataggaagctctaaataattcaatacttaatatatttccttcaatactgtcaccaccagcatccgagccaccatccttctcacatagacaattgcgattttaccatctttccacttccactttcctaaacaattcttcaaatatccagagtaaaacatgacaataaacataggatcatgttactttccagttttcaattcttcaaaacaattcccattgtctttttcttaaaacgtcagtgtttttaatactgttatatagttatttctgaactgttggtcattacactgtactcagtactttaaaagaatgaccaagagtagtaaaatttcattaagcctatttttatatgatgcctaaaacctctggctgaatagacaaactgccccatttttttttttagagtggacttgtccattatttttgtcattgttttactgacagaattacaaattcacaggcagttgtaagaaaagaacagagtccttgtgccatttacccagtatcctccaatggtaacatctgcaaaactatagtatgatagcacaaaccagaatgttgacattaataaaacctagtcttattctgatgtctccagctatacttgtactcagcgataatcaggaagtaaagatgagagaggagagagcaacaatgagagtgggaagatcaaatagggaaaaaagacttcatgttgcttaggttaagccttctggtagaaaatattgaaaagtagggcaattgtcagtgttaaatttccaatcttctccctggctgaaaggggtagatggaactcagaaagagagatgggtcagttttactctttttttttttttttttaagaagaatcattacagcttttgctgtcactccgtgtgaacagatcctttttggggtttgaacttacaaaaatggcttatctctagatttttaatggctgattcatctgttgttctttacccttatatacagctgtaactgattaaaaagcctaatggttacaaatctgagagcctcactttatattttctaattatgtttcttccttatccaaaaagatgcattaatctttatttaaaatgtgttttatctttgctgatcttttgagtctgtttaaattctaccttcttggctaattactccatcattttcacaaattatttttccttaagaaaaccaaatgagaaaattatgtttaaaacaacatatataatcctttcagctgacaagataggttaaaaacgggatggaggtatcctacatattcttggaactgtctcctaagagaatcttgcctaaactctgtcctttgagaaagcaagggaaaacaaatgtatttgaatgacaactttcattaaaattctaaccaacagactatgtaacaatttaattcactgtttttttatcactccattcatggagtgaagcttataaatcctgctaggccaagcatactgatttacatcctttcaatttaacccattcttcacacacacacacactctctctctctctctctctctctttcttccacattaaaacttttgctcttcccttaagggaagacgtgctaatttcaaagttcataaattcccaagtaaagcaatttctataaaaaaacttaaaaatttaaagaatattctaatgtcaaacatctaatagcaagcaataacctaaaagactgtcatattgattggtatctgtaagatttatttccctacgtttttaaatgatttccagtgacactgtcttctaactagaattattcttagacctacttgtgtatttaaatacattcaaggtatgtttttaaacattctgcaaattgtgttcagttttatcacaaatatttggaacattttgttttgttgtttctgttctttccatcaataagttggtataaaaatttttaaaggagagactgtttcagctaatttctttctactctcccttggtacttactgaatttaactgctgctcaaaaaagaaataaagatctaacaatgactggaataaaaatactaaggagagcagtatcagagtattaaatggtagatggcaatgggaaagtgggatagaaaacaattgggttcatgtcatatcaaaatctacagtctagatgtctcttcagaatgaaattatgggacggccaataactgaccttccaccctttatgttcctagaccatttgccaggatcttcttgtcatttatttctcagtttcttcccttctttcatgtaaatacattttcaaatggacaattcatctctaaatatataaatacctggtgaccatcactgaaaggccctgtgtcttttctgtatataatgagaaatggacaattatcaaccaccagagttagaaatgcagagcagattcgatagaagatagaaacgcagcttttctgttacaaacaagaacaagggtttcctaagaaactcagtagaaataaaattcagggaacagaaatgcagaggatcaagacactgcattttgaacattaagatagaggaactttcaagaaaattcttatttttaaatgttttaattgacaaatgaaaagtatatatttgtggtgcacaatgcagtattttgagtacacatacatactgtacaatgattaaataaagctaattaacctatttctcacctcacatactgttttgtgatgagaacattcaaaatctattctcctagtatttttcaaacaaacaatatgatgttattaactatagtcaccatgctatacaacaaagctctatgatttatttatatagtcgaaaggaaattgtaccctttgtttaaatccccaccatccccagacccctggtaaccaccatttaactccatgaatctgtgagatcaacttttttagattccactgtaagtgagatcatgcggtatttgtctttctgtgcctggcttatttcatttagtgaaacgtcctccagatttatcgatgtcacaaatgacagaattcctcctttttaaggccaaataatattccactgtgcatatctaccacattttatccattcgtctgctgatgaacatttaggatgattccgtatctgggctgttatgaattttcaaaggttattctacagagtgaagagtttcagaaatatgcacataatcaaaagctaacacttcactagttggtatcagccgctgataagactgggtgaaagaagtccccaggctgacacagtcaagagtccataaaaattgccccgagacaaagcagaatcccaacaattcctggacctgatccttcagaccaacgcctctccattaggaaggcacatctctagcaacccttgtctcccccagggatgttttaatcacttcaagtaattcacatctccatcaatattccaggataatcttgggatcttagcagaatatgaactagtttgcttcctcaaaggttcttcaagattccaggaccagttcaagagccaatgcaccctagtacttcccctcttgtagcatcaaagagggaagtcactaaaaacgcaaatcaaacgtcaggtttaaaaatgtgggaagaaggataggcccaggagaaagaggctgttaacaaggtaaaaaggtaagggttaagcaagattcattttcagtcaacgtcacaggtgcttcctttcaaagagcagaggctatgtatctttggaaagcagcaagctaaaaagggatggtgggtagaggttttgactactgccgctaatctcactcgcctctaaaaagtcttaaaaccagatacctgcaggaagggatagggtccttccagcccactttaggctaagtaaaataatatcaaaaataaaaagttttaatagctaacagacaatacttactatatgtgaggactctaaaatctcccattttatagatgaggatattgaaatacactatttacttgacgtagtcccctgactattaagagacagaacctggtattagaacccagtcagtacagttctcaaatcataatctcaatcctcataccgtactgtctctcaaaacacagcctacaatacagagctagcctgcattctacattcttatccctctttattcacgtcgttagtacctgtaatacttattagagccttacgaatgttttacaaaatctatcagacccaaagcagaacctcccctttctcttccattgtccccaaggatgcttgaatacaaaccacatccaaccgctgggatgggtggagccagtagaaacatgatcacagggttaatcagaaacttgtaagacagtagcaaatttttctgtgtttatctgtactatgtgaatcataccagatgatctggcctattttgttatatgaatgactgtcttgatttggtcatgtagttgagaggggtaaatatgagaatgtctttgggtgaaagaaggggcaggaaatgcaatggaataataaccaagataacaagtcttttacctatacttcaaaaggccatctgacatggtttgtgtccccaccaaaactcatgttgaataataatccgtagtactggatgtggggtctgttgggaggtgattggatcaggagggcggagctctcatgaatgggttagcactgtccccttggtgctgttctcatgatgacgagtgagctctcctgagctatggttatttaacagtgtgcagcatctccttccttcctctcttcctcctgctccggccacttaagatgtgcctgcctccccttctgccacgattttaggtttcctgaggcctccctagaagccaagcagatgccagcatcaggctttctgtacagcccgcagaaccatgatcaaaataaacctctgttctttatgaattactcagtatcaggtatttgtttgcagcagtgggagaatggactaatacaccatctcaaacatcacctcctcccagccttctgctttgaagaacctaagtaatatgctatcactggttgtcttctgatatccaacttatttcacttttattacacatatccatatcttacactgtaaacaccctgtaggggaaaaaatgtcaaatatcggtttaggttatttgagtaaacaacgaaagctgcaatggaattttaaactaaaaaaagggctcaatgtatcatctatcccttcaatacagtataaggcaaattcagaagcaaaatattaattaaatcaactgaattgaaggactgtacacaagcttctcatttctcacacatttaaatatgtcaaggtctattttttcttaaccctttctcttcagaaaacaactacaacaacaaaaaaacagaatttggcttatacttttatttcaacatggaataactgtttattttatggagaaagacacctccaatatttctcagtagtctgtgatctctgaggacaggtgcccatttggtttcagcatcttctccaatcccacaacacctagtaaacacacagcagacctttaataaatgtttccagctacaaaatgacatggaacaacagacattcaagtacaaatgttacttctgggccaaagaaatctgaacagacataaatccaaatgttacttttgaaccaaattaatctaaaagtatcaaggtcaatacgtaacaataaaagcctcagtttatgtaactttaagcttttttaatattgaatctagcagtttctatatatgattatgaggaaacctaataaaggtcataatttttccttttatttcacacaaaaaaaacttaatgtcacacatgcctgtaacatggagattggaaaggtggcaaagaaagagagaatgaccatgatattaaaaacctgtaagatgacaccaaattttgaaaagtttctatgtatgtatgtatctgtgtagcacatatgtaacaatattttcccccagaattcaagtatatactccacccaataatttatctcagcagggaatccagcgacagctattctaagagaaagagaatgagaaaaaaagacaccaaaagaaaaatagaaagccaaagagaaagtaaaagacagaaataaaaagaaaccaggagaaaaggaaggcaggaagaaagggaggaaagggaaggaaaaccgaacagcacacagaatagaggaatgaaaccaacgtggtttaaagaaaaccttttcttactgaaattttcagtaaaacccattcctactgaaatggaaaactatcttgggtgggtgagcggctggggtttgttatggaagagaatcaatacttcacttgacaattaccatgctaaccaccaccattttcggtatcatttcactatcatcttctcacaacaaaaaaacaaataatacatactttcccatgaggtttataaacataatctcattgcacaacagcaacaaatcatctggcaaattcttggtagaggaagtcaaagaacacgtttactcaaggtgaacagtagcctctggactgtatattaaccatacacggtttcatacagctccgccaaacatgctctaaattagccaataatttgccaaccgtcatgcaggttaccataagcctaccactaaattctaaaagcttcactatgaaaattttcctgtcaactttcatttctgacataagttgataaaagcctcacaaatcctctcttagagagactccataattttccatgcaaatatcactagactgaaaaaagtcttgttaacaccatacggattcaatggaagatgtaaaacatctttatcacgtcacaatcctgcaccatttatctcccgctcccatttggatttatacctttagaaatggcagcacttgctgtacaaaggacctaaagaaaatgccttctttactccataaattaaagctacttttcttcctgatttttttttcataatttcttgtaatgtgctgcaaataaagttagtaagactaagaatgtcgtaataccacatcgtaatgccttctttcatttaccatagtagataagtctttccaaatctggcagaactctattctatgtagcttaaaggttacataaaacacaacaaaggacttctctttcaacatttccatatcatatcatacatttccataccatagctgattcaaatgtcacctttcttgaaaattcatttaaagaaattgattccaaaagaaacctatacgtgtactgttttttaaaaggctagaatcaaaaagacaactgtaaaaaccacattctcaatgtatacaatcttaccctacaaccccccaaatactcatattatcattattttgtactcaatcaaatgcccatctcatttacaatgctggagaatgcatgaattccaaagttgattttgttgtctccttgaaaacaatctgatgagggggaaaaacatcatgctgatgttaccaataataaagccaaatgcaaataattcaggcattctacaattactgagaatttaatttaatctatttccagagacaacatgagtggctctgagactagggattgaacacagttggaactgtttccattatagcctgcaaatgctactctgtttccgtagtgcatatacctttgggatctttcttaaattctgatagtctatttacaaataaatcgaacaaaaactgccactcactatttgtatcaccaaccattccaaatttacttacctcagtattattgattataatgcagacttctagaaattatcaacttaaggtactttgcagcacgaaaaatcaaggacaaggcttaaaagaaacatcaccaataaaaccaaaagcaaaaagcaaaatacttaagtgatccttagcctacttaggattaagctgtaagcagcaaacagaaatacaagcatacactaaaaaccaatagttccatgcttactttcagcagatccttggagaaatcaacaccctcatttaccccttgcagatttgcaatgaactcctgacaggtcatcttctttccaatattctgaaacagaggcaaacagtacatcactatgacattcatggaattaagactgattcataaatatatgatgaggcagaccaataatttgtttctaaaaacataactaggccaggtgcggtggctcacgcctgtaacttccacactttgggaggccgaggtgggtggatcacgaggtcaggagatagagaccatcctggctaaccgggctatgtttagcagaaagcccgtccactactaacatgtttagtaaaaaccccgtctctactaaaaatacaaagaattagtttggcatggtggcatgcacctgtagtctcagctactcgggaggctgaggcaggagaatcgcttgaacccgggaggcagaggttgcagcgagcggagatggtgccactgcactccagcgtgggtgacagagcgagactccatctcaaaaaaaaaaaccaaaaacaaaaaacagacaaacaaacaaacaaataacataactagacatctatttacaaatacagggctgggcacagtggctcctgactcatgtctgtaatcccagcactttgggaggctgaggtgcgtggattacttgaggtcaagagtttgagaccagcctggccaacatggcaaaatgctgtctctactaaaaatacaaaatttagccaggcgtggtggcaggcgcctgtagtcctagctactcgggaggttgaggcatgagaatcacttgaacccaggaggcagaggttgcagtgagtcgagactgcactactacactccagcctgggtgacagagtgcaactgtatctcaaaaaacaaaaacaaagcaaccacaggtttatatacacatacatacaattttactgcactaaaaacatggtttattatgcttttaaaattctcattaaatataaatagcaaacttataccaaaaacttattataatgtagaaaaaaacttgaaaaaccgacgctacatttatacaatatataatacagtttttaatgaaaaacatgggtaaaaacggacatttctgagctgaactcagctgtttatgcatttatttgtgttacctacatactatcaagacctgtgaaggatctgagatttacactactttcaaactaacaagttagcctgtcacaagctaataaaatgctggcagaggaaagaagtctcctgggtgagagacaaggtatttattacttacactaacaggggcagccagaatatcaacattatcttgtgaccactgggctctagttccccaagtcccaaatgtcacagagcaacctgaatagggccacaggccacctgcacatgcagtgtgttgcattataggagagaaaccctaaccttcaggagctggaatctttaatcatgggaaatacgcctatccctttgcactagcgggagataccagctctaccttccagggagatatgcaaacctgaccgctgctgtgaagtcactacagcatcttccaaagctactcactgtatatagaaataatcttgaaaagacagaaaagaacaaaggcagtcacagcctctgttcgcaaaacgtacaggaaagtgtgagacccatggaaaattatctcccagcacgtctccaagctggtttaaggacaataaagtttaacaaaaggaaattgcattaataaagtaattagaaaatccaaactacaaaaagagcaaagatataaacaaactaagaaaactaacaaaattgttatcacagagaatcacctcttattctagttccaaacaactagtagaagctgctagctgtggaggatttttaggttccgtatagacagcaagatacatctgttacgagtgcaggagaggaacgcagagcacagagaagtgtcacaggtatcatctctagcaaaatgtagtccaagtgaatacaaagtgtaccaacatcgtaatatacctgtgaccgggcacggtggctcaagcctgtaatcccagcactttcggaggccgaggcaggtagataacgaggtcaggagttctagaccagcctgctcaacatggtgaaaccccgtctctactgaaaaatacataaattagccgggtgcagtggcggccgcctgtaactccagctacttgggaggctgaggcagaataactgcttgaacccgggaggtggaggatgcagtgagcagagatcgtgccactgcactccagcctgggaaacaagagcaagactccgtctcaaaacagataaataaataaaaaataaaaaaaccaaccaaccaaataaataaatatacctgcatacactactactatgcataaatgtatgcttttcaaggtcacgctattctttcgtaaaaggctaacagaagggtagaacagcacctagtgaattcatttgaaagtgaattcatttgaatacctacggtattcaaaatgagaaagcagacttctggagatagacttttaaaaagtagcagaggccgggcgcggtggctcacacctataatcccagcactttgggaggccgagacaggcggatcacttgaggtcaggagattgagaccagcctggccaacataatagaatcctgtctctactgaaaatacaaaaaaaaaaaaaaaaaaaaatagccggatgtcatggcgggcgcctgtaatcccagctactcagggggctgaggcagaagaatcacttgaacccgggaggtggaggttacagtaagccaagattgtgccactgcactccagcctgagcgacagagagagagtccagttcaaaaaataaataaataattaaaaataaatataaaggaggccaggcatggtggctcatgcctataatcccacactgcctgggaggcccaggaaggaggatcacttgagcctgggagatcaagactagcctgggtaacatccctctctagaaacaatatgaaaattagctgggtatgaaggcacgtgctttgcagtcccagctactctggaggctgaggggcaagatcgcttgagcccaggatgttgaggttacagtgagccataattgtgccactgcattccagctcgggtaacagaggaagactttcaagaagacgcacaggcatcattttaagggaatatgtatacacaacctcaaattcaaagacagatttgcctgagaacatacacctgtgtgccataggagtcatcacttcccacctcccctttcccagccacccttctcctgtttcacaaaataaaacaattcgtcccattcaagctgtctaaatagttacaatgacagtgctgacatttttgttgttgttgttaaaaaccttgcctctttcatcagcaaagaatgcatagtttgtatgaaacactgaaaaaaatggtttgacagaagtggctttgtcagctaacttatttagtagatatttctcataagttaaataaattaaatctgcagtttaaaaattttgttgataattagtttaaagcacagaaaggaactttaatgaaaaatattgttttgcaacagtatactgaagacgacaataactcagttttcccaatcctttccaactgtatcaggtcaaacaaggtgtctcaaggtaaaaaaataacacatacaatgaacagtcattatgatataccttggcaatacctttttagatatgttctggggagatgaataaataatgactaggtaacaaatctttttccaagtcaggtggtgtttaattctttgctttaaatgaaaataaaggaaggtctaatttagtcatcagttaatcaccaaaactattttttgatatgtgatctgcaaaattcaactgcttgtaacattatctgctttaaataaattgttattaataaacttctttgtaaaagtacactaaaatatgagtataaaaacgaaaatttttctcttaaaaaagtgtgttaattttgttacatgatgatagcatcaactactataactttaaaaaagtatcatctttattaaaatacaattcacagtatattctttcgaaccatataattcagtgatttttaataaaggtgtgcaatcaccaccactatctacattcagaacatttactccctaaagaaactccatacccaccagcagttattctccaaatctcttccaccaccctcactagggaccacctggcaagcacaaatctgcattttctttatacagatttgcctattcaggacatgtgaaataaatggaatcatataaaatgtagccttttatgactagcttcttttacttaacatgttttccaagttcatccatgttgttgcataaatcagtatttaatgtccttttatttctaaacaacattccattgtatggatataccaattgtgtttcttcatttataaattgatgaatgtttagactattttctttttttggctattataaataatgctgctataaatattcatgtataagtttctgtgtaaacatgttttcattcctcctgggcatatatttaggagtgggattattgagtcctatggtaatcttgtttattcatttaaggaactgccagactcattttcaaagtggctgcaccatttcacattcccacaagcagcgaatgagggttccagtttccctccaacctcacagacactaacatctgtcccttttactttaggtattgttatgggtatgaacgggtatgctatggttttgatttgcatttccctaatgactaatgaccctcagctttttttcatgtgctaattatccatttgcatgtcttctttagagaaaggcctgttaaaatcctattttcccttcttattggaatatttatatttttattattcagttgtaagacttctttacacattctagatataattttcttatcacatatgtactttaaaaatatcttttcccattctgtgggtcttttcatttttttcctttcactttcttgatgatgtccttttgaagcaggatatttccctgaccccttcatgggcagatatgggagtatatgagcactggagtcagccaactccactcactcaaatctgctgtgttccaccccttgctggagggagcaaacaggtgagtgggtacggcagctcgggcaaatgccttcgggcaccagcaggagtgaactctgtactggtcccgcagcaacatctggggaggggtgccagtgacccctgaagtcccagaggaagtgtttgggtgctcttttagcttggctgtctgcatatggcttaagtgttaacagctcagtggatcctctgcctttttgggtgagatggctgccttctgccagcaagggcaaagggtcagtgtgacagccttttgcaaccacacttggggcacctgagctctttaccagcatccaggagaaaagaggttgcacaaacaaattggaggatggtaaatgcaggaaattttattgccgatggaagtggctctcagcaggaaggggagctgaaaaggggacagagtgggaaggtaaatgccactgaagtttggctgtctctggccagattcttctcagaagttatgctgtcagactgtccctctgaagtcaagccacttctctctgacatccagctgtagtctccaatgtccagctgcttctcctctctctgctggctgaggctggggcttttatgggcacaggaatggggggcagagcaggccatgggtggttttggaaaaggcaacatttgaacaggaaatcagggatgtaagttctcactttgggccaccgcatcaggcttttcagcttgagggtgcagccctcactggggacccatcctcttctgcccagaatttccctgcctcttgtccctatcactttgaagcacaaaaggttttaattaggtgaaatccagtttacctgtgttttattttcttacttgtgtattttatatctaagaaatcattgcctaatccaacatcacaaagatttactccaaaaaattttgtagcattagctcttatatttagatatttgacccattttgagttcatttttgtacgatagaaagcagagattcaacttcattcttttacatgtggatattcagttgttacgacatcatttactggaaagactacttttcccccaccaaattgttttgaaactctttttgaaatcaacagaccataaatgtatgggattatttttagacacttgattatactgcaatgatctagctgttgagctttatatcagcataactcttgattactgaagctttgcactgagtttaccatgttaacagttttaagcattcagttcagtactgtttcacattagtatattcacactgttgtggaacagaattccaaaactttttcacctcactaatctcaaactctatacccattaaagagctcctcttttccccttcatgccagccacttgtaaccaacgttctactttctgtttatatgaatttaacaactttacttacctcaaacaaatggaatcatattttttctttttgtgactggcttatttcacttagcataatgtcctcaaggttcatccatgttgtagcatgtgacaggatttctttcctttttaaggctgaacgattttccattttatgtagagacaacattttatttatacataaatctgtggatgaacatttggtctgcttctacttcttggttaatgtgaaaagtgtggctacgaacatgggtgggcaagtatctcttcaaaatccagctttaaactttttatatatatacgtgcagaaatgagattggtgtatcacatgatagttatatttctcatttttttgtggaccctccaagctattttccacagtgattgcaccattttacaattcctacaacagtacgtttccaatttgtctacatccttgccaaaaatagtttctattttttttgatagcaatgatcgtagtgggtatcaggtgatacccaactgtagtttttatttgcatttctagattagagaatgttgagtatgttttcatatgcttgtgaacacttcttttattctttttttgaaatggagttttgctctcgtggcccaggctggagtgcagtggcacaatctctggtcactgtgacctccgcctcccaagttcaagtgtttctcctgactcggcctcccaagtagctgggattacaggtgcccaccatcatgcccggctaattttttgtatttttagtagagatggggttttaccatgttgcacaggctggtctcgaacccttgacctcaggtgatctgcccaccttggccttccaaagtgctgggattacaggcatgagccactgcgcccggcccttgtgaacatttctagaccatctttggataaatatctattaaagtatttttccccttttaaaatcaggatatttgatttttagatgtggaaatataggagttctttacacagtccgatattaactccttataggtatatgatttgtaaatattttattctattctgtaggttgcctttacacacccctttgtttttaaggcacaaacgtttcagtttgatgtagtcccatttttgtttttgttgcctgtgcttttggtgtcacagtgaagaaattgccggcacatacaataacgtgatgtttttcccctatgttttttctcaggattttatagtttcaggattacatttaggtctttaaaacattgagataatttttatacactgtgtgatataagggtcctacttctcttttttttgcatgaagatactgtattcacactaccattttttaaaaagtctgacatttccccaatgagtggtcttagcactcttgttgaagatttgaggatttgtgcactctattctattccattagcctgtccttatgccagttccacactattttgactactgtagctttgtaatatgtttaaaataacatacgagtactctaactctgttctttttcaaaactgttatgattatttggggtaccttgaactctcatatgatttttagaacattttccatctctgggataaatgttattgagattttgatagtaatcgtgttgaatctgtagattactttgtatagtataatatataaaaaaattaagtcttccagtccatgaacatgaaatattttcccttttatttgcatcttattattctgcagcatggtttgataagttttgaaatggagaaatcaggagtcctccaattttttgcctctttttctatattttgactattctgggccctttccatttccacataaatttcaggatttgtctgtccatttctttacatacatatacaaagtgaacttggattttcacagtgattctgtggaatctgaagatcagtttggagagtacttcagtcttaacaataaagttccaatacatgactataaaagatctttccacttttacagttcctttcttcagtattttgtagtttcacttgaacttattttgttaaatttattctctaatatcttgattttttgatgctactgtaaaattatttcacttttaatgttcattgctagtatatagcaatgcaattgttttgcaaatgctcaacttgtattttgcagccttgctgaacgtctttagtcctaataggttttttcttttgtatagtcctgaagatcctctacacacaagatcagttctcccatacagattcctttagttattcctttaattttgttttaaagacacaaaatattttattatgctacatataaacagagtttttaaaaactgaaacataatagctacatatatttttagagtacatgtgatatcttgatatatgtatatatcgtataatgatcagaacagggcaaaagagacatccatctccccaaaaattcaccccttctttgtgttgggaacatttcaattgctctccaccagttattttaagatatacaaattattgttaactatagtcactctactgcagtactgaacaatacatcgtgttccttctaactgtatttttgtgcccattaacctaacacctttttttttcctccagtttgaattttgactcagcaatgttcatgcctagacctcttacttctgtcgttggtacagcctgttcctgctgctgctgcttcttggtcttcaggttctccctatgcttgttcagccagtggcacatgatacaagtattcttgggccacagatctgggggctagtatttcttgcccttgtagaacttcctgaggtttgttttctgagtttggctaatgacggtgagaacacaggcaacagatttggaaatgactacaatctaagagaactggaatgtcgggcacctgtcacttcggcgacatacatctgggacaggtctaccttcaggttgtccagctgtcttagcagctcctcttccttcttgcctcaaagatcctgagccttaatcttggctacggctgcaaaagccaccaccgctgccaaatgccccgagggaaagagaaaagtgcccattaatcaacctttcaaaaccctttctaaatcccctgtgcccctcctcctcctaccttctggtaaccaccaatctactctctaccttcatgaaatctactttttaagcccccccaagtttgagaaagaacatgtggtatttgtcgctctgtgccagtttacttcacttaacataatgacctctgtgttccatccacattgctaccaataacataatttcatcattttctatggccgagtaatattccacttatatttatgtaccacattttctatatccattcatctataaattaacatttaggtgaattccatatcttggctaacgtgaatagtactacaataaacatgggagtgcagacatttcttgaatatactgacttcgtttcttttaaatatataccaagcagtgggaatggagagtcatatggtagttctatagtttttcaatgagcattcacactctttttcatactgtctttttcagagagtgtatgagtttccctttcttttcattctggccagcactcattgtttattgtctttttgataaaaaccattttaactcgggtaaaatgatatctcctgtggttttgatttgcatttccctgtaacactgaacatctattcatgtatctgttggccatttctatgtcttcttttgagaaatacctattcaatcaaaaattttgcccattttaaaatcgagttatttgaccatttgctgttgagttacttatatattctggttattaatcccttttcaaatggatagctcaaaaatatcttctaccattctgtagcttgtatcttcactttgttgattatttcctttactgggcagaagggttttagcttgatgggacaccacatctaaatattttagcatttgttgctcataatttagaggtcttcccctcccccgccgaccccctgcaaaatctttactcatcccaccattgtagtgtttccccaatcttttcttctagtagtttcatatttttagttcttacatttaactctttaatccaagttgaggtgatttttgtaaattgtgaaagttaagagtctagtttgattcttcttcataagcatatccagttttctgagcaccatttattgaagaaactccccattcctcaaagtatgttcttggagcctttgtcaaaactaagttggctataaatgcatggatttctaggtttctctattctgttccactgaccaatgtgtctatttccatgccagtaccatactatattggttaccatggctctctctctctctctatatatatataatgtataaatatatatataatgtataaatatatatagtataaaatatatataaactatataaatatatatagtataaaaatatatatatctaaatatatgtatatatataattttttttttttgtttttgagacggagtctcgatctcttgcccaggctggagtgcagtggcacaacctcggctgactgcaacctatacctcctaggttcaagtgattcgtctgcctcagcttcccgagttgctgggactacaggccaccacacctggctactttttctatttttagtagagacagggtttcaccatattggccaggctggtctcgaacttctgacctcgtgatctgctagctttggcctcctcaagtgctaggattgcaggtgtgagtcaccgcatctggcctggttcttctttaaatgtctgacagaactgagcagtgaaactgtcagatcatgagcttccctttgatgggagaccattttattagtgctttgatctcgttactcattactggtctgttcaagttttttctttcttcaaagttcccgatgaacttcgtggttcttgaatcttcttggtagtttgtatgtttctaaaaatacctccacttctcgtttttccaagtagttggggaatacttcttcataagagtctctaatgattttgtgtttctttgtatttctgcggtatcagtagttatgtctctttttttgtttctgattttattgattttggtcttttttcttagactagcaaaaagtttgtcaattttgccttttgtttttttgagacggagtctacctctattgcccagactggagtgcagtggaacgatcttggctcactgaaacctctgcctcctgggttcaagcaattcttgtgcctcagcctcccgtgtagctgggactacaggcatgcaccaccacgcccagctaatttttctatttttagtagagacagggtttcaccatgttggccaggatggtctcgatctcctgacctcctgatccacccacctcggcctcccaaagtgctgggattacaagtgtgagccactgtgccttgccaattttgccaatgttttaaaaaacccaacttttcatttctgttgaccttttaaattgtttcttaaaatctgaacttcactttttatgctctgacctttattgtttccttccactaatgttgagtttttttcccatgcttttctagttctttacagtgtttcattagattgtttatctgaaatctaagtttaagaaaacattaacacataataactatacatatttatggggtacatgtgatattttgaaatatgcatgtaatgtgtaataatcaaatcaggatattttggatacccatcacttcaaacatttactacatctctgtgttgggatcatttcaaatcttccagctattttgaaatattcaacaattataaactatattcatcctccggtgctatgaaagaataggacttattccttctaactatatgtttccattcgcctccctttaatcccaccaccaccactatccacagcctctggtaaatatcattttactctctatgtccatgatatcaactttttaaactccctcatgagggagagcatacaatatgtgtctttcaatgcctgacttacttcactcaatataatgaaatgtaattttatccacgttaccgtaaatgccaagatttcattttaatggaagagtaatattctattatgtatatatgttacattttctttgtgtattcataagttgatggacacagattaattccatatcttggctatcaagaatagtactgtagtaagtacagggatgccctataactctgacattaatttccttccatttggataaaaacatagtagtggggttgctggatcgaatgaaattactcctgggttaaatttattcccaggttttttcttttgtagctgttataaatgggattactttcctgatttctttttcaactagttcattattagagaatagacacactgctgagttgtgtacactgattttttaccttgaaactttactgagttcatctatcagatctaagagtttcaggtagagtctttaggttcttctatatataagatcatgttatctgaagaaaggacaatttgaattccccttttcaaacgtggatgcatttcttttgcctggttactctggctaggacttccagtactatattgaatatgagtggtgaaggtgagcatccttatcttgttttagttcttagaagaaaggatttcagttctgcctcagtatgtagttagctgcagctttgtcatacatggcgtttactatgatgtgttctttctatgtctaatttattgagtttttttattatgaagggatgttgaattttatgaaaccctttttttgcatttgagatgcaaaaatatataattatattaaaaatataatttttgacctttttgtgacgtatcatgtttattgatttacatataataaaccatcctaccatccctggaataaaacccacttgatcatcgtgaatgatctttttattgatttgttagatttggtgtgctggtattttgctgaggaattttgcatctaagttcgtcaggaatactggcctatagtgttttcttattgtatccttatctggttctggcatcaaggtaattctggcctcatggaacaagctaggaaaaaatccctcctctccaatttttcggaatagtttgaggagaactgatgttagatcttctttgtaagtttgtagcattcagcagtaaaaatctcctgggctcaagcttttctctgttagaagacattttattactgaatcagtttcattactcattattgatctgttcaggtgttctatttcttcatggccaaatattggtagtttcctcatgtccaggaatgaatctgtttcccgtaggttccaatttgttcagacagttgttcacgatagtctctaacaatcttctatttttgtgggatataagttttactgtctccttttttggttgggattttatttgtgtcttcttttttaatcttggttagtctatccagcaatttatgaatgttgtttattctctcaaaaaaaaaacccaactcttcatttcactgatcctctgtatagcctttttttcacctctaatttagttctgctctgactttattatttcctgctgttaattttgtatctggtttgttcttgcttttctagttccttgaggtgcatcaataggttctttaaaatctttctactttcttcatgtaagtatttgttgctattaaacatccttttatcatggcttttgctgtatcccacatattttgatatgttgtgttcccattttgatttgtttcaagaaactttttgtttcttatttctccttaaatccagtgatggctcataattgtggcttaatttccttgtatttgtacaatttccaaagttctcattgttgatttctagttttattccatcgtggtctgagaagatacgtgatattatttctatttttttaatcgttgagactacttttgttgtataacaaatagtctagcctcaagaatgtcccatgtgataagaatacttgttctgtagctgttggacaatatgttctgtaaatgtctatcaagcgcatttgatctaaaacgaagtttaaatccaatacctctttgttgatgacttggctagatgatcagtccaaggctgagagtcagttgttgaagacacctaatctgattttattggactcagtctctccctttagattcaataatgtttgctttctatatctgcatgctccagtgttgggcgcacaaatatttagaattgtttaatcttcttgctgaaatggtccctctaccattatagaattaccttctttgccgctttttggcttaaagtctattttatctgatactagtgtagctactcatgcttgcttttggtttctgtttgcatggattatctttttccatcccttcactttgagtctacgtgtctttaccagtaaagtcagttttttataggcagtatatagttaagtcattttttttttgtttttctattcagccaatctatattttttaaggggggaatttaaactgtttacattcaaggttattattcagtacttaattcctgtcattttgtgaattattttttggttttgtgtatcctctcatcctgttctcctcttatcattgtggtttgctggttttctgtagtagtaacacttgcctcctctatttatttatttatttttttgtgagaccgacactcactctgttgcccaggctggagtgtgcagtggtgcgaccttggctcactgtaagctctgcgtcttgggttcacgccattctcctacctcagcctcctgagtagctgggactacaggtgcctgccaccaagcctggctaatttttttgtatttttagtagagacggggtttcactgtgttagccaggatggtctcaatctcctgacctcatgatccgcctgccttggcctcccaaagtgctggtattacaggcgtgagccaccgcgcctggcccagagttttatacttttatgtgttttgattatgacagatattgtcctttatcttctaaatgcagggctcccttgacctcttcttgtagggccagtagagtggtgattaacttcaatttttccttgctttggaaagcatttattctccttcattttttatatcttccccaggtataatatttttggctgacagttgtgtttttttgtttgttctgcttttcaccactttggagttatcatttcatttactcctggactgcagtggccaaagtaattccatccaccacgttgatttcttattaaccccagttccaagaaggcctctaagatttccagtttatttttacttaagagcatgtacttaccataaatcccattcctaggtcaaaacaatgtaaatgttattgtacttgctataatcaatgcccttaagcagttatcctacacagcccttctgatgcatgcatatcctttttctatggcatataagccctaggtcttgggagtaaaggcacagggatccaccatctttgtctcttgaagtacctcccaagacacaatccctattaaatgttcctaagtccctattaaatgtttctaagaaactgaatttgtcagcctctttctttggcctctcatattccttgaactttgggggtagggttgtatagacttttccaccgtggaacatggcctggaaggtttctgctaagaaatttgctattagtgtgatagggatactcttctctgtgacttgacccctttgctgtatttagaattctctttttcttggacttttaacagttcgactatgaagtggcatggagaaggcctttcagggtagaatatatttgaagatcttcgagcttcctatatctagatgtctgtatctcttccaagacttgagaagtttttacctattatttcgttaaatgggttttctatgccattacccatctgttctcttccaggaaaactgaaaattccactatttcgtcattgtatgtgttacataagctttcttcgtttttattttttttaaaaatgttatctgctcaggttatttcaaaagacctgtcttcaagtttacaaattcttctgcttgatctagagtctgttattgaaactgatgattatattttttattttactctttgaattcttcagtttcaggatttctatttaacttctttctgacatctttgttgaatttctcatacagatggtgaaatgtttctttgcattgttcatctgttttctgtagtacctgggttttcagaaatattttgaattcattttcaggtatttcatagattttttttaatattggcatctgttgctggagaattattgtgttcctttgatggtttcatgcttccttgatttctcatgtttcttgtgtccttacatttatatctatgcatctggtgtaacatttgcttcatccaactctatggattgggtttcgaagggaaagacatttttttctatagagctatctatagagttgtttgggtaaggcgttttggctttgattctgggtgggagaagcagtgcagtctccatatgacttctttgactatctttagcatcagtggtgtctatgagttcctcagtggataaagctgtggcttttagtaacggctgtagtgaggctttgctagtgaaagggacatcaggcaggccagttcttaggcaacagtgatggcaactctgggatggatatgcaggatctcggtcaacacacgtggatattggtaaaagcaggtcaggaggacgaatccttggtcttcaagtggattgtctgtgtgctagcagtggcaacaatgggctgagtgaatgggtcctcaggcccttagatggtatgcataatgtctgcggctgcaacagcagcagagggctaacttggggccccaagctacagctttgggtgccagcagttaggggtacaaagggcctagtggccatcaccgagcatccaagtggcacgcagctgggtggcacatggccgtaggcagggcagtggcagtctcacttggtcatgctatataatcctttttatattttgttgaattaggtttgttttagaatgcaagaaatattcataagggatatctttatcatgacttgtctcattttggtatcagggtaatagtgctctcatagaattacttaaaaagtgttactctttttttctgaagggtgtaaaaaaactgatgttaaaacttctttaaatgtcgatgcaattcacaagtaaagccatttgatcttaggcttttctttgtaggaagttttctgattactaaactcttcacttgctaaggatctattcaggttttgtttccttttgagtttcagtagtttttatctttctaagaatttgttcatttcatctaggttatctagctgttgacaatattcacttacagtagttacttccataaggccaatagtaatgccctcttcattactgattttagtaatttgagagttcttttactcatggtcagtctaattcaacttttgtcagttgttgatcttttcaaaaaacaagcttctgatttcattgctttttctctattactcttctattctctgtttaattcatctttgctctgattattctttcccttctttggactgagtttgcttttgtttctttcattaggttagactgtaaatttgacatttttctaaaatacagcaatttagagcaataatttgcaatttggcaattcatcagctgtataccataagttttttatgttgtattttcattttgctttttttgttgttgttgagacgtagtcttgctctgttgcccaggctggagtgcagtggcacaatctcagctcactgcaacctccgtctcctgggtcaagtgattctctcacatcagccactcgagtaactgggatgataggtgcatgccaccatgcctggcaaattttttgtattctgaagtagagatggcatttcaccatgttggccaggctggtctcgaactcctgacctcaaagtgatttgcctgcctcggcctcccagactgctggcatgagccactgcaaccggccaacatatttttattttcatcactatcttttagttcctcttgtaaattttttttggacctattggttatttaggagtatattgtatgactacataaatgtcctttaattgatttctaatatcattctattatgtccagaaacatgttttgtatgttttcaatccctttttgcgaattttgtcctatccttgagcatttttcatgtacactttaaagattactctcctgtcatcaggtatctgttagatctagttggtttttatgttgttcaagtctatttccttgttgatatcgtgcgtggtgattctaagcattatttaatatacggtgctaatttctcaataaaacaatttctccctccaattctgtccattgttctttcacggcttattatgtgttcagaaggaataagactttttccctacactcatacaccactcaacacaatagtcactgaagtatgtgggggtttctccacattcacaaccaattctccaggagacaccagttgggtgttttataattcaattataatactatgtatctgctgatttcatgagctcatacaggttaagggctcagccctacaagatcaccccaagtttcgggtgtcaattggtagcagtgggttgtcagttatacttctgaccaatcagctataaatgggggtttgcaggatcatctatctgggtttaatttactaggagggctcacagaactcagggaaacatttatccctttaatatcaaagatattgcaaaggatatagataaacagtgagataaagagatacacagagtgaggtctgaaaaggtcctaagtgttggggcttctgtccctgtgatgttgggatgcccaccttccaagcacatagatgtacttgccaacctcaaagctctccaaaccccatactttgggtttttacagaggctttataacacagacatggctgattaaatcaatggtcagtggtattaactaaaccttcaccctattcttgctccctggaggtggggtgtgtgcggaaggaggggaggctgaaaattccaaccctctaatcacatggttatttcccctaacaacctgtccccttgctgagcttatctaggagctcaccaaggcttgcctcattagaataaacaatgctcctatcattcatccaaggcatctaggaaccctgtgtcagaactgctgtcactcaggaggtccatttcaagaaccaggagcagagaccaaatctgtatttcttatttgtcatagtatcactggggcttatattgattggaagtgttttatcaccttgatgaaatgacccttattataaaatgttcttccttgtttctaggaaaaaatatcttacctagaccttctggatagcttgcctcagattctacattagcacttgctgctccaccaagcattttaggttatgaagacactttctttcctaaaacttcatgaaccaagttctcctagcttccaacttttcttctgcagcttcctcacctctctcgaccttcatagaattgaagagactcagggccttgctctggattaggttttggtgtaagggaatactgtggctggttggataccctatctacaccaccaaaacttgctctgtatcagtaataaggctgttttgctttcttattcttgtgatcaccggaatggcacttttaatttccttcaagaacttttcctttacattacaactttattaactgtctggtgcaagaggcctagcttctggcctatctcagcctcactaaacttaatcatttctaggttttgattcaaagcgagacgtatgaaactcttcctttcacttgaacacttagaggccattctaaggctattaattggcctaatttcaatactgttgtgtctcagggaatagggaggcctgaggagacagagatgggggaatggccagcctttggcgcagtcaaaacatatatatttatcaattaagtctgctgtcttatatgggaatggttcattgaaaaatggcactgataagactcgcttgacgcagggttccatcaaccttcactttgttaggaaaaatgttcagtgactgcaaagtgtaataaagcaaaggacaataaaatgagatacgcctatacttaaacttacaataaaaagtttccctgtggtcccagctgctcgggaggctgaggcaggagaatgacgtgaacccgggaggtggagcttgcagtgagtcgagattgcgccactgcactccagcctgggtgacacagcgagactccgtttcaaacaaaaagttttccaatttaaacttgaagaagagatactatttaaaaaaaattcttttgggagattcatgaacaagatatttaaaggctacagagtcaaaagtgttttttcaggacaccattaatttctactttaaggaattattaaaaacatcatttaagtaataattgtcataattcataacattttaaaacagtaaagtctatgaagctattttggtctatgaaatcatacctcatcctaaattcagatttactttaactgcttatttggcagtgccttctgtccaatttcaacagtgaccataccattatctatgtcagcacaaagataccaatttgactcacgtggactttgaaacagccattaggaaaaatagcagttaggtgggcaagatggatatatagattcagaccaacaaaagccaattcaaatacttggagtcctacgcagtaagcaagtattagtacaatcatccaatagactgtaccttaattttctttactggttcagagaataaagataatgtggttttctatgtgttaaaaatgtccaacaacttctcgaatgcttgactagctgaagttgcttttatctgttgattgtactcctctgactcactgatcattcttctaggcaagaattattaggaacaaaaggtgaggagtcagatcagtccattttgctgcttactggcacatatttaaacacattccttccactcaggcgtttataccatttccaaagggaataaaagtaaaatgaagtctttgtcatcaagaaatactcctcacgatgtctggatttttttctccttgtcatgtaccaggctgtctcaattattttaaaatactattattcaggcaaacactactcaacgaataaagcaaattctaatcagtgattttgtggctcaaggcttcataagtatccaagagaagctcatacactatcacagttccattcattttcttcccaaattagttttggataactttgcataaaagtagttctgctctgaaacaaatgttgaccagttgcatgccaataaagtactttaataatactttttcatattttaaatttcttcccattaaatcaataaagcatggagatttgaaaatgcctcctgatgcattgagaggtacagaaatggtaccttgaaatcaatatattttctatcaaaacagatgcaactaaagatgaagctctggatcattacctttaaaatcagtaggcattttaatcaaacttaaaaaatatcaaataacaaaatagatgacaaagtggaaagtttaaaaaaaaattctatttggaaccccaaaattccaggcaggcccaattcttaaatatttggctaatcaaggtatcatcctttatgggagcaaatattaatcaaaagtcaaaatactctctatatcggaggcctacgtcatcccgcaacaatttaaggctactctctgcagcgacaatattaccattttcaaatgctttcttatgataaaaagatgttttctctgtttgtgttcgtttaaagatacattaaatgccctttagagcaaagttccttgataaatttatcatttctggaagaacttatcctcaatatgtttaatacattcccataaacaatttttagtaaagaatttggggaaacaagtgtccaagctctagcaggtttcgtgaactaagggcaagactccaaaacagacaaattctgtaaatttctgtaaaggaccagagagtaaatattttaggctttgcaagtcatatattctgttacagttattcaacactataattggtgtgaagatgtaaacaactgggtttggctatttacgataacactgatttacagaaacaagccccagatggattttgcctatgagtcataacttgtctaccccttgtcttaaagaaaaccagaaggaagtggtattggtactgaggacaacatcgtgagcgagcaagcaaacaggttaggcatcctgatgtattctattctccaaatgcaggttttcgctttgttaaaataaagggcactttcccctgaccataacagagaagcagctcccaacttctgttgcaataacgagagcaaaggggaaaatgaagatggagaatttcattcatatcaggagcagccagaaaccgtatacaagcttcggcaccaaactcagcaagcgggtgaccaaatctttgagcgtgccatccctggcaatctggggaatgtaacctacaaagctctgaccatcgcctaacttaaaatcagccctaggagagctgcgaatagggcagctgtgtcaatcaggtattcactaggaaagctgacaacagcatatactctgattcagaggttgaagaattaagcataatgattctaaaattcttcatttttgatagtgtcaggtctggaagctttgcggaaaacgtgcttttggagaaactaaaagccctcatcatccattggtaaaatctggcttcataaatctcaggatattaaaaacacagcaggcatactctcccatatgacaattccacctcctccaacatgttacaataaatggtggaaaggcatactactgatttggtaattacttcagttatgtggctctgctgaaagctcctgttttgcttttattttgcatgctttgctatcaaataagtttgattatgtcatgctgccctcaggtgtccattcctttttaaatgtatgactggggggcaaaggaggaccctttgtaaattttaaaaccaggactacagtggatattcaatgtgctctctcacaaaccctaatcacagagctcatttaagtgctaaaagctcaacatttaggaatatctgatatgtcactgggacttctcccacctgtcctataatatcctgcctttgaaaaaggaatcagagtggtaaaaagaaaaaaaggaactaaaaatagtaccacagcacagtggttctcaaagcgtttcagagatactgttccagatgtccatgaggtcaaccctatttttatagtaacactaaaaacatttttttcattctctcaaatatacagtagagttttctagaagatgcatgacttctgatacactgcaaccgactataaacacaaacagatatgagaatctagccatcttttactaagccaaatataaaaagactagcaacaattttaagtgctattctttaatatatttctcacttaggaaagtatgactattattcataaatgtgttattcacttaatgggtttttaatgatttaatgcaatttaaaaatcttatcagtttcagttccagataaatattaatatgtaaacaaaagattttggggcttctcaaaaattttaagagtataaagctatcctgggaccaaaaagttttagaatactgaaatatcagacttctattgatatttcatggaaagcacttcccctaaaatttgaaaagataaacacacctaactcactgtcaaattacaaggactaaccaaacaatttttaacttgattgctgtagcaggactggcattaaagtaagcaacaggattggaaacaagagtcaggggtttcagccaccatcatcctcattcctccctccttcctccacaatcaatttgcagaaagtaagaaagagcgaaactgacttagaatttgacctgctttccttgatcacgttctataacagaactgtgccaatgtaaaaagcttacagtgataagaagactgaataatgtgtaagttagataatatgaggtccctcaataagccccactgacacaactgattaaagctaccctgaggtattttccatatataaacctgttcttaaaaaagcaaaactaccaaaagtgggaggctagagggtggggaaaggggacaggtgaaggaacagaggatggaaaaaaggaaagaaggctttcattctaagaggtcatagaatccaacaaaattgaccagtgcatgattaaactatggcatacttagataaggattcctattaaagtctagaccattggcaatatgatagtaaattatattctcaatttcaatttacaattcatcatttttagatcataacatttttcttttttcttttcttttttttttttttttgagacggagtcttgctcgctgcccaagctggagtgcagtggagtgatctcggctcactgcaagctctgcttccaaggttcatgccattctcctgcctcagcctcccaagtagctgggactacaggctcccgccaccatgcctggctaattttttgtatttttagtagagatggggtttcaccatgttagccaggatggtctctatctcctgacctcgtgatctgcccaccttggcctcccaaagtgctgggattacaggcgtgagccactacgcctggccaacattcttctataaaaacatttcaacacctaatggttaggttctcaggctattctctatatccttattgtggagacagaaagagtattggtgaaaatgaacgccaggccccactagaaaccctctgcaactgtgagatctagccctgatccttctcttaggaccaccgagaagctgcagggatgacggccttggggccactgtgtctgggaagctccaagtcaggtaaaaacatagaccaaaagcttctcaaggtgataagcaaccttggcgaagtctcaggatacaaagatcaatgtgcaaaaatcactagcattcctacacaccaaaagtcaagccgacagccaaatcatgaatgaactcccgtttataactgccaacaaaagaataacatacctaggaatacagctaacaagggaaatgaaggacctcttcaagaagagctacaaaccactgctcaaaaaaatcagagatgacactaacaaatggaaaaacattccatgcttacagaagactggaagagtcagtatcacgaaaatggccatactatccaaagcaatttatagattcaatgctatccccattaaactaccattgaccttcttcatttaattagaaaaaaactattttaaaattcatatggaagcaaagaaccacccagacagtcaaagcaatgctaggcaaaaagaggcaagctggaggcatcgtgctgtctgacttcaaactgtactacagggctacagtaacccaaacaacatggtactggtacaagaatgaacacacagatcaatggaacagaatagagaacccagaaataagactgcatgcctacaaccatctgatcttcagcaaacctgacaaaaacaagcaatggggaaaggattccttatttaatacatggtgctagaaaaactgggtagccatacgcagaaaactgaaactggatcccttccttacaccatatacaaaaatcgactcaagatggatttaagacttaaatgtgaaacccaaaaccaataaaaccctaacagaaaacataggcaataccattctgcacacagacatgggcaaaaatttcatgattaagatgtcaaaagcaattggaataaaagcaaaaattgacaaacgggatccaatcaaactgaacagcttctgcagagcaaaagaaagtatcagagtcaacagacaacctacagaatgcgagaaaaattttgtaatttatccatctgacaatggtctaatacccggcacctacaaggaatttaaatgtataaggaaaaaacaaacaatcacattaaaaagtgggcaaaggacacaaagagacacttctcaaaagacatatatgcggccaagaaacatgaaaacaaccttaatatcactgatcaatatcgcaaatcaaaaccacaatgagataccatctcacaccagtcagaatggctacattattaaaaagtcaaaaaacaacagatgatggcgaggttgtgaagaaaaaggaatgcttttacgctgttggtgggagtgtaaattagtttaatcattgtggaagacagtatggtaattcctcaaagacctagaaccagaaataccatttgacctagcaatcccattactgggtatatatgtaaaggaacagaaatcattctgttataaagatacatgcatgcatatgttaattgcagcactatttacagtaggaaagacatggaatcaacctaaatgctcatcaagggctggataaagaaaatgtagtacatatacaccatggaatgccatgcagccacaaaaagagaatgagatcatgtcctttacagggacagggatggagccagaggtcattatccttagtaaactaaggcaggaacagaaaaccaattaccatgtgtgctcacttgtaagtgggagctgaatgatgagaacacatggacacatggggcagaacagctcacagtggggcctgtcagagggtggagggtgggaggagtaagaacatcaggaagaacagctaatgaatgccaggcttaatacctgggtgatgggccagttagaatggtgatcattaaaaagtcaggaaacaacaggtgctggagaggatgtggagaaataggaccacttttacactgttggtgggactgtaaactagttcaaccattgtggaagacactgtggagattcctcaaggatctggaactagaaataccatttgacccagccatcccattactgggcatatacccaaaggattataaatcatgctgctataaagacacatgcacacttatgtttattgcggcactattcacaatagcgaagacttggaaccagtccaaatgtccatcaatgatagactggattaagaaaatgtggcacatatacaccatggaatactatgcagccataaaaatgatgagttcatatgctttgtagggacatggatgaagctggaaactatcattctgagcaaactaccgcaaggacagaaaaccaaacaccgcatgttctcactcataggtgggaactgaacaatgagaacacttggacacagggtggggaacattgcacaccccctgtcgtggggtggggagagggaggagggatagcattaggagatatacctaatgtaaatgacaagttaacaggtgcagcacaccaacatggcacacacatacatatgtaacaaacctgcacgttgtgcacatgtaccctagaacttaaagtataataacaaaataaaataaaaaataaaaaaataactctgtaaggtatcaaaatagaaaaaaaaaacaaaacaaaactgggtgacgagatgatctgtgcagcaaaccacgttggcatttgtttacctatgtaacaaacctgcacatcctgcacatagacccctgaccttaaagttagaaatcaaaagatctttgcaaataataatttaggaaaaaaagccaggtaagacaagacaaacacggcaccaaggagataggagagaggactccaaaggagaaggcagtgctagcacagtagaaattatgaccatggatggaatctacagcaggggaaagctcagagagaaaactgaatgccaacgatagctttcatggcagatggcatcacctttcaaggcagagggcatcacagatacagagaagcacagacagaagaggtatccacagggaagatattatcctgcaggacgatgagaggatagcctgcaaatgtacttaacagctgccagttacaatagtgatcattacagatgcagagagttcttgaggatattaactctatgaggttcatcaatatcatggaagtctgtgatgtttttgacagtgaaaatataaaatagcacaatatgaagctgtggggaaaagcaagagagatcagattgttactgtgtctgtgtagaaagaagtagacataggagactccattttgttatgtgctaagaaaaattcttctgccttgagattctgttaatctataaccttacccccaaccctgtgctctctgaaacgtgtgctgtgtcaactcagagttgaatggattaagggcggtgcaggatgtgctttgttaaacagatgcttgaaggcagcatgctccttaagagtcatcaccactccctaatctcaagtacccagggacacaaaaactgcggaaggccgcagggacctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtaaaagaggaaggaatgtctcttgcagttgagacaagaggaaggcatctgtctcctgcctgtccctgggcaatggaatgtctcggtataaaacccgattgtatgctccatctactgagatagggaaaaaccgccttagggctggaggtgggacctgcgggcagcaatactgctttgtaaagcattgagatgtttatgtgtatgcatatctaaaagcacagcacttaatcctttacattgtctatgatgccaagacctttgttcacgtgtttgtctgctgaccctctccccacaattgtcttgtgaccctgacacatccccctctttgagaaacacccacagatgatcaataaatactaagggaactcagaggctggcgggatcctccatatgctgaacgctggttccccgggtccccttatttctttctctatactttgtctctgtgtctttttcttttccaaatctcgcgtcccaccttacgagaaacacccacaggtgtgtaggggcaacccacccctacatgaagcattaaatttttaaaataatttttataatagtcattttccactactaataaaccaaatatttatccactatttaagattctaggctcctagaaagccaatgcaataattaagtttatagattagaaaagaaataatgaattcttacaatctatctcacactgaactccacatttttttaacactgttctgtgacaaaacctaaacatactttcttccttgattatattcttctccctaccagtaagttgtactagatatggtttcaaccctttccaaacttacaacccaacactaaaaacattagtaaggtcgtgcctgatcattaaactcagaccacagggcatgatactcaacatgctctgagtatgtcaagggtaaagtatatgtaggaggcccagcccgagaaagagagctacctctaagaaccacaaccaggctcttataccaattgtacatggtgggctggcttctgccaatactggagaacagagggatgctggacaaaactgctactgaaaatctcaagccttgatgttaaaaggtacattttgtcaaaaaatcttgattaaaaacaatgccctggctactgcctcttaccatggcctgaccttggccagccactgacttgtgtatctcttgtgactttctagttgtggaactggccagctgactatgctctgatctatctcactcctcactgctatgcaattctatacttaaccctcctaccaccttagaacaccagccctgggtgataatcctgccaggacggtaggaacctgactaaactgtgactgaagtacaagcaagctagttagtggtaggaaacagaacgcatttgaagatccatccagaaagggagtaagtataaacttattctgacatatcaaatcttatccataccatttcaaacaaggttgaagaaaaagactttcaactcttaccttgttgatagttgaaacaatattcaataaaacttagttccaatatagcaaagaaagaaactctagagtttaagagaaatgtatctgtatgtgtagaagtttaatttacataagtattttgtagataaagaggcatttcaaaaataaaacaaattatatagcaaattcaccacacgactacaattataaaatatttaatttaagggaataaactacttgcagacaagtaaaaacaagtagatactcttgctaggaaaatgatatatcagtcacatttttttaaaagcaggtactgaattctccccccaaatattgtatatacttcagattgttttttatctagcctaattagagaagtttaacatgatccaacatgaaattaaaacacctccccagtgttttcccatcatagcacctcagcaacctgctaccatgtcttcagtgaaacctgactaatgaggtcagcctagccaataccatcagagaggattatttggcttccatgaacattgtctcattcacctctgatccttacccaaatggcaaagagtatggaaaggaggaggcacacgcatgctatatacatgtttgttgaaggggaaagttagaaaaagaaagggatttcaacatgtcacattagctaaatgtaagtaaaatattagtatacattccattattttattagtaaggaaattagcaggccaaaccaaggcccatattaatgcattctcagtgcctcattcctcagagtaaaggaaaggttcaccaagagcagccaaaacaagttaatctcccaagaggggagtcagacctcctcataggggagtcacccctcccctactgaaagcatatgaggacaagctggtcttggcacttcttagaaagatcatgctgcagtattgctattatgacacaacggtaaggaaaaaaagaataatggttgattagtgtattccccatgaagattattctggcatcggatcaagtaatgggtggtcatattctaggtagtatagcattaaggagaaggtgaaaaggagcagaacagtagaaataattcattttatctcctgcatgattcgatttcataggggccatgctgacaagtcaaacagacactaaaacaacaacaaaaaaatcaggcaatcatgatgcaagagaagctacatccagaattatggattaaaaacttaccacctagaagaataatttatttttaaaatgaatccagaggagaaagatagaagaaacatatttacatggttagttcttatgatagctactatatattcaacagacttgtaacagcatgcattatggaaaactaatacataaaacctaaatagacaatcccaagtatatcgcacacatttttaaaacagagaactacttatcaccaaacacatgatcctgaatatgacagagattcactgttattgataattttctccctcttctatcagtaattttgccacgactgccaattattaattatccatgattggcctaactcaaggtaatattaaaatgttaatttatgtaaactcttttccatcccagttgccaagaagaagcaggatgcttcatctaatctccttacaattccttgtaagtctaaagaagagcaaatgtcctagatttgcagctctaaacctgtagctactgaaacctgggtgtccacagctcatctagacatcaagcatgctgagatatctaataaaaaataacatctttattggttgctacatttcaagttcttatgattcagatacatgcttatgtaaaagtattattaaagctatattagctttttaaaaatgcaatctaggatttagtagaaacaaatcatcaaaaatgtgacaaaagctctaagagatctgcaacctttaaagagaaattgcaatattactgaatttttttcctcccaccattaaacttttctcagttaacagatgctaaacgtacaactcttttatgttgatggaacctcaaaatatctagtgtgaagggaattcttcacgctggtgatcactgacttgattcaatgttatatgtggccaaacgcactcaaaattttctcctttggccagaaaggctaaggaaaagaagggtgcaaagagcaactgttatcaccaaacagccagacaaagcagtgaaaacttgcttggccagtaacacgaaaaaagtggtcatgacaatccactgactggccatccctttaacaagctggatgaacattagattgcggtagtcatgtcaagattcacactgtgaaatgcctgcatttccacatggtgtattagccgtgctatactgcccaagaatgcttcctgaaagtattttcttttcatctgtattatctctggacacgtgctacctatgtttacaagccactaagtgattctaaattcacctcttatatatggcaaaaggaactttctagctgagtattttgagatatgttaaaatgatgttaaaattaggattctatcactatatctcctgtttgctttctggtggtggaaccctttctccctgaaccccttcctcttataacagctagtccaacttaatggtcccatagagctccatggttcctttcttaaaagggaacactatattttccaaaaaaggaaattatgtgactagcagaatatctaaatatcaattttttatatgtaatttttaaattgtaagatatattacggcaaatcaagggataatatactctacacagacacctgattttctcttcaaaatacaatcagaattcgttaaatatggactaatctatacttacttagagcaaaaattacttcatagtcccaggttcatttattttaaagagtattatgaagagttcgagtaaatgctaaaattctacttctacaaaacttgcaaatttatatataattatacattttaacactttatcttgtatcttaagtagatgatgagacggtaattagtttgttttattatttcaactagtaaaagactagataagctgaggggcacaagaaaggctgagttattcaactcactatggtatgtagggaaaacacaattcacattttcagatctaatttgtattctctccatcattatctatcaactgtaattctcaaccagaaaacaaaaataagtaaaagctctgtctgccatctactggacaaagaagacacagaacacacacattactgctaaaacaactccagacaccaggacgatggatttaaagtcatactctgtgctagcatgtgaaataaaaaaattatttcttttttcaaagatttctttttattcacctgccatgggaaccatgtagagaatgggaaacggggaggcagaaaataaatgtgtttgaacataaaagcagagataagcccgacatgttttggatctaagtttcacaaatccacacttacgtggccatgtagatcggtattaagaagcattattgcacaggtaaggcaatggactccatctaaagaaagatacaagaaaaaaaagcatgaattcgcttttcactgttggactccaccttattatcactaataggatacactcagaacctatgaaaacagtactgtgctaggtacaattagtcctgttttaagaaacaaaaaatggataagaataatttatagaaagaacctcaatgcacagaactggactccactgttgataagttgttcttacctctctggaggacagtttggtagtagatatgtaaagccttcaaacaatgtcttttgatacaacaaatcggcttctagggctttgcactacagcaataattagtgatctatacatagtacaaggatatccagacaagcattgcttacaatgggagacaagtaaatatgagcctccaaagacacattactgttaggttaaagtcatataaaaatgttctccaagtagagttaagattctcctttccaaacactacaattagttgttctcgttactctcactctgctaattctctacacaagtacagtagacaatagcagtttcagatgcagtaaaaatcttttcaatttacgctaaattagaaggtctaattattgcactcataaattaaagccagggtattttcaaaagtaagttctttagtatagtaggtgatttctgttatcagtgtctctaaatagacactaccaaatggctaaaagtatatttattctagtaccactttattatcacaagttctacatatatttaaaacaaattctcgaaagtattttaagaactcagcagccaactctcaaatatcctcatcaacagccaattaagtcacgaatccatatttcttattttatccaagaatgtaaacatattcttagatttgaagaaggttctaataaaaatggcccacttttatctccttcattctcttgtcagggctaatggtgacagagatagtgaataactggtctgaatagcatcagtttaccgataggaatgtgaccttaatcaggtgataaactaactgtgactgcagccttggacatggaggggaggttgaggcaagcaccttggccaataccaagtaaactatccaggttaactggcaatactgaagctaagaggtaattactatttcttgggaatctagtctcagtgatttactccatcatctgtaagtttatgaaacattttccagtcacaagtcaaagtgcttcacttcaaacactgaaaagtgtactttattgcaggaactgaaatggaggaaagatctctcttcacaaggtaggtccacaaacaaacagtttaccattaagtcacttactttgtaaaaatagtgtaatatgcataacctcatagtttattaaaatcatcaacaaaagtttgtggtcagtatagtacaattaatatcaaacgaaagcaccagagacacagcgcaaccaccagtgagatttgttaatttttccaaaactaactccaacactcaggatacatgagctttcatcaagaaacatagagaccaaatgtataagaaataagaaaactgaaatttcattcattacataaaatctcagagtgacaaaccatgaacaatttaaagaaagtacgctgtcacactagagaagtggaaaacaaaataatttaagtaagagtagaggatatcatgctgtccttaaatattatgcttttaaagaatatttaatgacatgagaaaatgctcacaatgaaataaaaaggcagctaaaaacaaaactctaattccaatttgacattaaatattaaatagactagaatgaagtaaacagaagtgttaatagttatcactaggtaactgaagatacataatttctcacaataaaatttaactttcataataaggaaaataaccattgatataaaaaagaaattcaaggatttgtatcagattaccttgtgaagcaatggtatctgggttacaataaaaatatctattggagaagtgtattaaaactctctctcgttcttgagtttctcccacaagagagaatgctttaaagaaatacctacaagagaattaaaaatttaaacagtgaaattttcgaaaatgctatcacactctttcatagttaaaagtcaatttatataaacctaagatattaattatacaaagtaagatattatgaagttatctccccccaaaaaaatcatttactagacagccattcaatataaattggtattagtatttaaattctataaaaagcactgtgggaggccaaggcaggtgttcacttgaggtcaggggttcaaaaccagcctggccaacatggcgaaaccccatctctactaaaaatacaaaaattagccgggcatggtggtgggcgcctgtaatcccagctactcaggaagctgaggcaggaatcgcttgaacccaggaggcggaggttgcagtaagctgaggtcgcgccactacactccagcctaggcgacagagtgagactccgtttcaaaagaaaaaaaaaatgtccacttaaaagatgacagggtgataacagagtggtcagtacatcaagaaagccttgggaaggtaggtaatttcctcattatgaccaagtgtcaagtagccaattttaaaaggtcagatttaaaaaaaacaaagaccgcttaagactcaatacatcatcataaaggctatgttttaaaactctacacgcatcagggtgcttctgtcattttgttacatgactgtcatctctattaaagccactatggattgcattgctttgtgcacaggagatttctgttaattgtgtctgttatcacattttaatattaatttgttataggaggaggaaattgggagatataagtaatttattccttacataatggaattagtttatgtataaaaatatctttaaattataggaagtgtatcaaaaaccacacattaatctactcggagtcactaagagcactgtttatttgagatgaatccagatgaccctcacttgacaatgtagattcattttcctaaacatgagatgggaaggaaaaaaaaaatcattcaaaatgtctaagaaatcttactatggtaaaaaacataccatgagcctcatttctatgaaaattttgccttcttccttattataggtataattaagattaacaaactatatattgacaaaactttaatttttcataactttaataaactacatcagaatgcaaggcaaaaatacagatctttcatccactgataactgtttttgttagaaaatctgagtacctttgctgcatgaaaagagccccacgataaatcactgcagtactacactccagtccaaacatcctcccttcacctcccagacctcagtttcttgatttgtaaaattaaagggttacactagatgatctcagaattcttccagacatggacattttataaatagtgttgaaaattaaatgctgactaggttttaccttcagctacttagaaacttgtaatacaatataatgtaaaaagtgagaatcagtgagttttagacaccttcatttgaaaaggtcagaaaaagtggatattgttgcaaacagttttatagatactttctactgattatgctgacattcatttttattccactgaagagttaattccaaagtatcaccttaaaaggctattggggctaggtgcggtggctcacgcctgtaatcctagcactttgagaggctgaggcgggtggactgcctgaggtcaggagttcgtgaccagcctggccaatatggcaaaacctcatctctactaaaaatacaaataattagccaggtgtggtggtgcgtacctgtagtcccagttattcgggaggctgattcaggagaactgcttgaacctgggaggtggaggttgcagtgagccaagatggtgctactgcactccagcctgggtgacagagcgagactctgtctccaaaaaaaaaaaaaaaaaaaaaaggctattgggctatagtaagcaaatataataagcaaatacttaggaaaaaaatctaattctaattctacaatctataaactgtgtgtgtgtgtgtgtgtgtgtgtgtgtgttaaactcatcattcaaaaaccaaactccctactcaaaacaattgaaaacagggtcttgaagaaatatttgtccactcatgttcacagcagcattaatcacaatagcaaaagcatggaagcaacccaagcgtgtcctgaagctgacggtggtatatatattccccataatggggtattactcagccttagaacgggaagacattctgatatatgctacaagaatgaaccttgaagacattatgctaagttaaatgaatcacaaaaaggcaaataatgtatatatcaatttacattacagtagtcaaaatcatcgagaagagaagtagaatagtgtttgccaggggctgggggaaaggaggggaaggaaaaaaaaagtcattgtttaacgagtatggagcttcagttttacaagaagagaatcatggagatggacggtggtgacggctggacaacattatgaatgtttttaatgccactcattgtatacctaaaaattgctaagatgaaagattttatgctatctgtattctaacacgataaaaaaacgaaaaacagaaaaactcctacagatggcattttttatccagatttgctttgctaccaattgtttaccacctgaactcaggcttaccagtaggtgtagactatcaattcatgtgtcatttcgttaaatgaatacgtttttcttactctttgctgtgtttaatatctataatacaatttgagctaagttcacaaactacaggttaaacgtcccaaacccaaaaataagaaatctaaaatgcttcaaatcagagatgctccaaaatctacaacacttttcagtgctgaaataaggttcaaaggaaatgctccctaaagcatttcagattttcagatttgggatgttcacttggataagtataacacaaacatctctaaacctgacaaaatccaaaatccacaacacttatggacccaaacattttggagaaggaatactccacctatacatggaggtttaaaaaaaaaaaataagattctagctagaagacattactttcttctctaagaactaatcatttgaaagcaatgacgagcagcaaggaggcttagtcatacctgagtgactgatccagcgtcattcctgtaaaatcaaaaaacttcagatattcttctgcaactagtttgctaaattcgttgctataagaaaacagaatagacttggttattgaaaggtaaactatttaaaacacacacaaaacaggagagaattcagactccagcaatgggtcagaacgtacttcttgccaaggtgttttgcaacatctgatcttttgaatctgtccagctgataaaggcgtttggccaaccttttggctgcttccacattgctgctggtaccattactgagattttctggggtctccttttccaaaatttcagtgctccccatttcagaatgagcttctagccgtgttgttttcaccccagcattgctatgataattgataaagagagaaaataatagatttttcttatatggcaaaaaggaaaatatctgatgaaatattgatagttttcttttagttcagctacacttagatgagatcactgtatgtttaaatattcataaaaattttttcagttaccatattttaaagaactaaagaacagattgcctaaatcttaggcaagcagttcccaaacttttcagtctctagacctttacattcttagaaggactccatacggctttcacttatgtgggttatacctaccgatatttaccctcgtagtaatgaaaatagaaacattttaaaaattcactcacttaaaaataaatctgttttacataacaaatactataaagatacaactattgttttccagaagaactaaaattcactgtttttttaaaacacaaatttctttaacagctggcttactacaagacagttgaattctaagagccatttctacattcaatcagtaacaatatattattttggttgaaacacattaagaaaatgtgccctcactcatatttcattggaaaaaagaaatattttaatatccttttcagataattgtggatattcttttttgatacaacaccaaagtgagacaagtggtagtttcttaaaggatattcttacttgcaatatggaatctaaatttgtgtcgattaactttttgtactcttatattaaaatctatcttatactttgaatggatcttttaacccttacatgattttgtaacatcacacattggttatctgcaaaacatgtgttgacacatttcattatataaccttaaaaaaatcatattcactaatgtcaccattaatgaaaagtctaagtattgggaagctgccaaacctttgcgggcagatacaagttttccaaaatcctaacttttgttcaaaagctcaaatgtaatcatttgctacaaattattatcagctgttttccttaaagtaataggcttactccattttcaagaaaatgtttgccaataaccatagtttgtcagtcattctctcaaggaaaaatgacattcaatgaaaaaagtgactagtttttagccccaacttaaatgacagacgaatgtttttcctggagactaccaggaacagaagtgctttattcccatttcatcacacacaaaattaaaaagacatgatctcaagcgctgaaatgaaataaactgtactggtttcatcaaggatttttttaaaggtgaaactggcctatatttttattttgagtgcatgacagtggagaatacgatgactagaagagtttggtgccgctgccttaagttctactaagacctccactattgtttttgcaccataagatatcaacgcagtgaaaaacaaaaatagtgttataataattagtgtaaaacaattttgatctcataaacctaactgaaggaagaaagctccacaggcaacacgttgagaactccgccctagaaagggcttaaagactacagcctgtggtcaggtatagagggttctcttgtatttataacagtgaaactaatgaggatacattaatttccaaatctttatcttaacttggaagtaagacatgctcataataaaatgtgcttacacggccttcgaacacacttaccacagatgctaaaccaagggcggtcagaatttttccataatggatgaaataataaatatcgtaggcgtgcaggccacatatggcccctgtcacacatgctgctttgttgttgttgttttgttacaaccttaaaaaacctaagagccatgccagctgggctgaattgggcccatggatgggagtttatctgcccttgctctatcccatagttctttaacttggcttgcattaagcacaataaccatttactgtctaaaccaggacactctaaaggggaaacggagataataaatccttaaatattctattataatcattacaaaataaataaagaaggcattatcaataaaaaagcagtactgctaatgggcattgtttcttttggggtgatgaaagcatccttaagacagtggtaacgactaaacaactctgaatatgcccaaaccaccggattttatactttaataaagcaagtgatacagtatttcaattatctcaatggtgttatgtttttaaaaatctgaacctaaaaaataggttgtaaacttacatcacgaaatgacaaaaaccattgtagtaaaaataaatgcatttctaagcagaactgctccatcttgtcacttattctacctcatttacaagttcccttttcccactgctctaccaaggaagcactggccttatgcttcaaggtcactgaaaaagcagccagggctcctggacaaccagctggtataacaagtagctgcaaagtctcatactccctcaaccaccacaggattagaaggagttaactgtccttagcaactcttctccaagcacactttatcggcaagcacctgacatcctgcccttgaaatgaagctctaagaatagggaaaagagagagagttttttagactcaactgtgtaaaaatgtcaactcacacattcccagatgataccatgggagaagctgggaatacgaagttaggtctaccaaacccatgctggcttattttgccatagctattaatggtaatagttcagttattaaaactctaagtcaaataccaaaccacagtcaatatcaatggcagaacagcaggcattaactggaactgacccaggcaaactaacatgtatggtaaccctcaacaccttgaacagtttcccaatacacatgcctaccagttaaaataaattgcttcattatgataaaatctccatgaaaatacatttttaaatgcatgattttttcatcctacatcttcctttatagacttaacattacatggctgggtgtggtggctgaaacctgtaatccctgcacactgggaagccaaggggaggactgctttagcccaggagtttgagaccagcctggacaacacggtgagaccctcctgtctatgatgtaaacatttttttaaaaagagacttaacactaccattcagttttgtgaaatctatcccatcaggaaactgaataatcattatcgacagtataacctataataagaaaactcacagtagaaatttcttttaggcaattcatggttactttgtgttttcccatacaagtgacagaaatgtaaaatatttattccaagaactacgttaattacaatcaagtactttttataattatacaaaacacaaaacaaagcccttggagttgtgtttccatgtgtgcttttcctatcatgtagtaaaaacacatgtcaaagaaaggattttcttcttaattaaaccactactcactgctcatttcccagggaaaattcatggcatttatttaatcattctgtgcaaacaatgtaattataccacatatacagtactggcccaattttgttcaaatacaagaggcttattctaatgagaacacattttaaaaatttattacccaaaatcattccattcctcatgttactcattctccatatttgccccttttctactatgctgcccagtccagatgatttcacctaattttcctcacattcaccaaaaccatataattgcaaaatctgtgtgcatcagactttctggatcttcttcaaaaaggtttcagtaaaaggagaaaataaagcacaaaggataaatatgtccctagatggcttcattctgtccatttcacagtttaggagattatttgaacaagaaccggaattgctccttttaaatcagaaagcttgacaatatgatggcaatataaacttaccagcaaccatacagacaccaagaagagcccatcgcaacccctggggtgcgcctggaccatccttcctctccgaagccccgtccagtattcttcagctcccaagttcagtgactgccgagcctcacagccttccaagaacctggctccctgtgaggtcacactactatgacctcacattctcagccgagtgttcattgttgcggtttctgtaatgtttctgcagttctaataaaaacagcagccagaacacaagggccactgtctatcgagaacgtaagaaacagtgagcccagcctcgttcacacttgataaagccaactcagtgatccctctcggaggggataacaccccattttgttttcttgaatacacaagacattgcagctctagtctgctgagcattagatgcgttctgtagtttggattttctcttttctatggttgttttattttccctctttttcttgatcaaatcactttacagcctagtaaggttgcaaataaataaatccctaccagtcacttaaatgtgtaagagacttcccaaaaggttctccctgtgttctagaaaatgcttccctggggcctttatttctgacctccaagtaaacatggtaataattctctcatcaaaacactgcatcatcaaatgaaggaccagatcattgactctgatcaccatgccttctcacaaccttttgaatcatactaagattggcagattttccaaataaaaatagggtacccaataaaatttgaatttcacatcaaaaaacagtgtctagtgtaagtacgtcccaaatactgcacaggacatacttatacaaaaatattattcatcgtttttctgaaattcaagtttaactaggcatcttatattttatctggcaaaacttcctgaaatgtttttttctaaactttatttcaagaattccaataatggtgttccatgattgccaactggtagcttattcacaattagaatccttctggattttttcacttgtttctgcgattttattcctactgtttttctacagttttatcaagactttgttgcctataatctactgattcttctctaacgtcctctaaatacaaaaaaaacaaaacaaaaacaaaaacacaaaaaccctcctctgtgttttcatccttctctcttgacctgcatgctaccaccacaaatgtgataatgtagccactttacacaaatcctacacaagatccatattctgtagcatgtcctaaggccttttccaagctgaccccaatttcttttttcaacctgtcctctaccatttccctcctacttgaaccacacaaatacaagctgtgctcccatgccttttacgtatgttgttccctttgccacactcatcacccccagccctaccatgccaaattctgtgaactcttagtgctatcttttaaaatctcatcgctttcacctaccactgtcttgaattctggtttgaatcctcaacacaaggggcggctgaaggtactcaacagccatctgctaagagaatgcaagaacacagccatctgccatgtctacttcctccactgtcttccatgctatgctatcaataatggtatgtggcactaattttccaattcactgtagctaatcctggaaaaaaactgacatcagtagaatactattgcctgtataaaacaatatactcaatagtgtactgttttactttcaatttttcccagaactttaataaacagtatactattgcccgtttcatacaggcaatagtatactttgaatttaaatttaaaatttctttaaatttttatgtaattgtggtaataaaactaggaccaaaaagaagttaggttaaggtgtcaaagctccctgtatgaccctgtatttataaagtgtaccccaagggttgtacatagaaaataataacagccacctagtcgagttgaattttatacataacttaggcaaaggcaaattagaagaatctcaaggagtgagaagaaatgacttcagctgcaagtggaataaaaagaccagtgggaacaacatgactcctttgccattcttcaggctgatgacatagaaacacagaagactggaaccaacagacaagagggcgggtacaaacgcacagcttccagggctgaaatacaagtcagaagtaagtacaccatcagcaaaaaataagtaaaaccctaaatcataaattgcctctgaaaagggaaaagaaaataattttgtccatcattatctatggcatttatttcctaggcattgtagagagcacatcatctaattcccaaagaaatgtaaatgagaagttattcagaagagccatagcacccaccatggtaccataaacctaataggttaacaatggttaggcatttactatgtgccagcctctgggcttcttcctagggattgaattgtcagtcttatgaaacaggcaatagtataacccattttacagatgggaaaactgaggcaaggagctggacatggtcagtgagactccaatgctttactacttttataagctttactactatccattttgctcctgccagtcatcttctggtatgtctgtcttcaatgattcaatgaatacgtatttaattccctatactgtgccacatattttaggtgcttggtagactacagtaagcaaaacagaattaaaaacttctaccctgggtggggaggggagctaaaaataaagaatttaataaataagtaaattctacatattagaaggtgacgtttgctctggaaaaaaatagagcaaagatagaagaggaaccctaatttggggatgagggtggaaacatttttctacgaagtggtcatggtaggcctcatggagaaggcaacatttgagcaagatgtaaaggagataagccttgcaaatatgataaaataacagcattccaagcccagagaaggcccaaaggctgcagcatgttagatgtgtgagggcaagcaagaaagccagagtggctggggcagaggcagtgaacggagaatacccagagagcaaatgggcttgtgggatggaggttcccacattttctcgactcagagtctttaatatgtaagttttttatgacactccaaggccaaaggaaatatattccatttagtaacagaataatagtgtataaatgcttattaagtttggacccaacaatttacagtcatttgaaaaaacaatacatacaaattgaaagaaaaatcatttttattattaaataacgattgcttactaatagatgtgtgtgcctctgggccatatgacttcctaaatctcggatcagactgaacaccgccactcatttgttttctcatagcacttaatttttatcacaacaactggtgaaaatccagctcaaagctatgacgtcaaaaggaatatagcacaatctgatgttgacgctgaactagctgttcacatgatgtttgacagatgatgaggagagctgtgtttcccttgacaatttaaatatcctgagaaacacctgtgagctcactgcaatgccccagaacacctctgcagagttggggaacgactttgttgtttaaaggccttgggggccactatggagactggtttttactcctagtgaaatggttaatattgaagggttctgagtaaagatctaacattaatttatatttttaaaggatcactctaagtattgctttgaaaatagactggagaagcagggtgaccagtcagggggtaatgcatgtgccagggaggagctggcttgggtggcagtaggggctataggtcccggaggacctgccaactggtcctttgggagggctgagagaatagtagttaagttttagtcctgagcaacttcaagggtggggttaccatcgaccaagacatgaaagaccaaagttaacacaggttgtgagaaaaagaagttccatttttgatgtgttcaccttgagatgtccattggctatccaagtaggatgtgaggacacgtggagatttcaggaaagacacgtgccagggtgcactgcagggaattctcagtcgctggcctgcggtgggccctggcattcttctgtttaaggaccaagatgatcctgatgcactgtcagagctttgagttacccctctaacacacaggaagtcactataggtctaaagagaggaacaacaatcagacttgggttttggtaagatcagttttgcttgtggtgtggagggaaaactgcagggactcaaaattgagacagaaaaaccagctacaaaaggtatcagaatagtacagtcaagagatgagaaactaaattgcgtgtctgtgtgaatatgaaggaaaagcctcctccgaaagctatttagaaggtaaaatggaagaacgggatgagtggcttgagatgtgcatggagctatgttcaagggtgggtacaagactaaccctgacttaaaagctggtggaaggtgatgccaccaaacaagacaatgaacacaagaggaagaagagggaatgggtaacagtgtgcacacatggaaagaaacaagcactcgtggaagaccaggagtttggttcgaagaaacgataggtacaaggtacacacaggttaaccaggcagagctgtctggtagcaatggcaaccatcccctgtctgcaagaattcagtagatgtgaactagtcacccttatgttggtggagggaatcacctgggagaggctagagcactcaacatgaccaaagaacaccaaagtgcgccaaagaaatatgtctagcagtagtgtattcatttgaattctgttacaacagaagaattcaggggtctcccttcatttgttcaggaaattctacctgtgagtgttcagtttgccagcaagcaatgattattaatttagaagatgccaaaagcaattatctgctggagaactccagttagaccacccaagttcaaacactggctccagtggtcaccagttctgggaccttaggtaggtaaggtcatcattgtctgtaacccttaaggtttttagctataaaacagataatagtatcatattcacaagctgttgtgaagatgagatgagaagatccatgtatgatgcttggcatgtaagatgtctggcatacggtaaacaaaaaacgtctgctcctatcaccagatccatcttcgtcaccaacaccaccagcatcattaaggttatgatgacgtgagataatacatgacagcactttattaaatataaatctccatacaaatgttagttagcgctcagtaggaatacttaggacaaacgtctcaaatgaacctgttttcaacagttacatagaatacattccctggaagggacagcctcttatgatttaagactctttataaaggaaacacacaaaacctaattagcagaattcctaagagctatttctctgttcagcacagaagacaaaattcagtcttcaccaataaaaaattttagtaagcatcacatacagattctgcccccagccccacccgccgcataccttccaaatctcagtcctttttctcagccttgctttcactattccagaagagggcacccacatgcaaggcagtgccatggaaaatgacccaaactcactgtatgagtcggggagtctgcatttgctcctgaggcactggcttccaacataacaactgtacttttcacccatgtaggggttcaaacgtttctaggggcatgatgcaggttttcactttttgttttatttacttatttatttattttcctatactaagttgctgctcttgtgggatagctctcacatgagaatgtaatatgtgcaagtcaatgttaataaacccatattacaatcatttcaaatgaataatttgcaaagaaactcttactggatatccagctttagaaatagaaatacatttagatgcaaacaaatgtatatgctcattgtttgcatagaagcttctttgggcaaggtaggatcagtgagccccatttccggtggacaagacaggaagagtgactcacttacagtctgaccaactcatttttctggagtcttcttaagatgccattggacattctcttctgtctgaatttctgtcaggttgaattagtatcagtgtatatgcactggacatcagaagctgggcagcaaaaggcggcacaaagcacaaagtagacatgccttatgtggataagaactacaattttcatatcttaaacagtttgtttagtgtttatgttaaagagctgggtacccacaccaccaccagtccttagaatactcacttcctgtctagtgcacaggtaaaatatacttataaatatgaatttagtttgatcaaatactctcctttcttgattaggtaataaatgctacaatctagccagggaatattagagaagttctggcctcccattgctcccacccccttttctcttctaactcttccatcttctgggatacaagaggctgaacaaatattttctatggttatataatgtccaaattttaccatctctattggtatattctgccctttcttcaaattcttttttttgtggggttggaggtgtgggggatggagtctcgctctgttgcccaggctggagtgtagtggcatgatttcggctcactgcaatctccacctccagggttcaagcgattctcctgcctcagactcccgagtagctgggatcacaggcgcatgcccccatgcctggctaatttttttgtatttttagtagagatggggtttcaccatgttggccaggctggtctcgaactcctggcctcaagtgatctctccacctcggcctcccaaagtgctgggattatgagagggagccactgcgtccagcccctttcttcaaattcttacgacaccttttccagtgtcctatagcacaggcgttgctgtgtttctctttggcgtgtttggaactgcgtatctgttctgcagtgtccctctcctgctgacacacccactgacgacatggccgtacggtctcaccttgcacataacttcactttctctttatgcacgctacaggcagtttctacagcagcagcctgacaacatatcctctctacactgagtttcccctaagtgctacctactacaactacactgaaagctgctctatgcgatatagggaaggtttcttggattcacttaattttgtgtgcaatgttaaaaaagaggaaagaattagtaccctggcaagaatacaaggagtaagaccctccccttaggaaataaaatcctatctctgtcacttcctgctttcatctctttaaaatattccagctcccctggagacagatccaaagggtcatcttcatctggggctatgggattaacaggggacgtttccactctttagtacccaatatgaatgaattagtaataatatcaataaatattttgtcttaacatatttttatgaagaattccagaatgtttactctgtttaatacactattttaagcactttatactaactcacttaatgcccttgaccttacgataggtacttccatcattcccattttacaaaaaaggaaactgaggtatggtgcagttaaataactttgccatgaccattctgccagcaggaggtaaagctgggattggggctcagcaatggcggctgcagttgtgcattcagcctcttaactaataagctatgtggctttctaaccgatattactacaggttatactgcacgcataactttggtgtatataggaacaaacatttctactttttaaaggacatctgtatatgtgtttactatggttgcataattaagtatacacaaccaaacctgcacaaattttcactccaattatttatttaaacattgactatgtgccagcacatttctaagtgctaggggtgcagccttgcccttgtggacttttaccttctaataagagagagaaacaataaaatacatgaagagttttccctctgttcctgcctttcaccctcccacaaatatctgaacatgttacgactcacacactgttccaggtaaatattaggtctaataaagcatcaacagatgaaagtccttgctttcaaggagtttacactcagacagtgacattcataagtgccttggagataaatatagctaggtatgcaagaggagagggaggggttgctattttattcacagcactcagaaagtaccatgtgagtagaaaatagaaggaactgaggatgtggctttgcaagctatcttcagatcatttcaaacaaatgcaggcctgggcaagatggcgtttggtaagttttaagtgatggcccagaggagcctccatggctggagaggagtgagcaaggggaagaggagttaaagagtcccaaggaaggcctgaattcacttacaatttcaaagtagtcaatcacttggaagcttcaaaattaactgccgattctccaacttccacaatcggagaaggtacaacaatttacaaaaggttattagtatcatatatgtactttagacacatgttagcttccaaagttcgtgggctgtttcgcagttccccctgtaattctgcagtacctctccatgaccatcacatcatctaagggtccagactcttatcaatcacctaattcaccctgtaggtcatggattcagagcatactctccccagcactgtgccccgagggctagtctgtgatttttctaaggctgaatccttatcttaatgaaatttctaacacagcaccttggataatggctgggctttaacatacgctcagtacaactgtcctaaatcaaattgcaagaagcttaaaggaaaagtcaaacaactgtgtactcgtctcaatgcagctatcaacttgagtagaagatgcccaaaagcagtaattcaaatgttttctttcatgaatctgtatacaaagctgaaagtttctgagttttattgtaagcaatttccttattacggaatctagagactctgatcagcggaaatcatctgccaatgagctctctctatgttgcagatcttttaatgcttatcccttattgttgccaaatggggagcaacgtgaaaaagtggcaaaagcaaagtggacagaatgcagcggtgaagaggggaaggtcttcagctcttaatatctaacctaagaaaactaaaaccatgattactaaatagattatatgcattacgttttttgtttttggttttggtttttttgagacggagtctcactctgtcgcccaggctggagtgcagtggcgcgatctcggctcactgcaacctctgcctccccggttcaagcgattctcccacctcagcctccctagcagctgggactacaggcacctgccactacgcttggctaatttttttcatttttagtagagaaggggttttgccatgttggccaggctggtctcaaactcctgacctctggtgatccatccgcctcggcctcccaaagtgcttggattacagacgtgagccaccgtgtccagcctacgttacctttatgaaagacaactattgttgtcagtttctacgcttttaaactagtttttccttcccttcatttattatattttaaagtagggagctactttttttttttagggagctatacatgatcttactttgccctttgatttcacactagcgcctcctagaaccaaactacctgtaaggcgaggagggtgagcgctgtgttctttaatgtgaattagatgttatctgccatctaactcaatctcaaagtgtttggtattttaagactgaaatcatggcattttggaggtaaaaagaggttagtgacataagctggaacagattcagttattgggcacaagacaggacaatctgctctgcaaataaactgagaattaaagagacccagtagacaacaaatttagtgaataatgtcctctccataccccccccaacaaccagcaaaaaaaggaaagaaagaatgaagagtctttaaaatcagttgggaagaaaaacattgcattttctggctttctaaaatgtgacaaggcctttacatttataatcttatattagtgacagtcagaacctcctaacagattgttagagtaaatttaaataggaatccccttggactgataaatgggggcaggtgggttggggggaaaagtcatccctgccagggctcacaggtaaacaagcagaattcagggcatgtctgcctgttacatcagagacccttgatgtgatccagaggaattgtggagtaatctggacaagcacctacctctaggccacaaggacttaagaaagtgaactggagaacttcccggcaagactacctaacgactgttcatatcaaaacaactggtacccagagacagaactcctgactccaaatccaacactttttgtccactgcaccattgtatacagcagagatgacaaggtaaacagctgttgacaaagccaggctttccagagggtaggtttagtcaacaaatactttgacaagtatttttcaaggaaactaaaaaagacagagtctaaaggagaggataaagtaacaggcagcacaaaccagcttgaatcaccaaaaagaatccttcagaaccagatcatgagccttcatgaagggaggggatgaggacagaagcagccagagatgctactcaatagaaacaaaaaaagccctccccaaactcttcccctgaacctctccagagggataaggcaaaagtgctgtttttggcaaaactatgtaaatacaaattcatatttcattagttcctagacacattttttaaatatttcaaattctttaaaattagaatggatttttttttttttttttttttgagatggagtctcactctgtcgctcaggctggagtgcagtggcgcaatcttggctcactgcaacctccgcctccagggttcatgtgattcgcccacctcagcctcctgagtagctaggactgcaggcgcccaccaccacgcccagctaatttttgtctgtttagtagagatggggtttcaccgtgttggccaggatgatcttgatctcctgacctcgtgatctgccagcctcggcctcccaaagtgctgggtttacaggcgtgagcctccgcacccagccagaatggttttctcatgcatcaaccagtgtgaaccctggcagccaggtggctgtcagacttttattacctgtgcacaacgcaaaattatactgttggtttaatcttgatttaattgatgtttacagtgtcttcaaaaagatgctataaaaggtactgagacaaaagtattatttatgcaggcaagcatcgagaatatgccaaagtcatttgtatgtaaaaatctgtaagtttaagaattattagaaactccaagagaaagcactgtgtcatagttaattgctggcatttttttccttttttttttttttttcttgattttgtatttaacaccattttctccaagtgaaatggcatattcttttctggcagtagcagaaaatatatgaaaatatacttttaaatatgtaaaatataaaatataataaattaagatactgacttatctcccaatcaatagtatcttagattcaaaaaatttgatgttgtttgttttcactagtactgtcatcccttggtatctgtggggtactggttctagaacactcccctacaaaataccaaaatccatggatgttcaagtccctgatataaactggcactcagtatttaaatataacctatatacactctgctgtataccttaagtcatctctaagctacttttaatacctagacaatgtaaatgctatgttaatagttgttatactttattgtttggggaataatgacaagaaaaaaatacgaacattctcagtagagatgcaaccatttctttttttttaaatctattttccatctccagttggtggaaactgccaatgtggaacccacaaatacaacagtctgctgtatgcagttgccttaaaactcagtaacatttaattctggttttcttttctcttttgagacagcatcctgctctatcacccaggctggagtgcagtggcggaactgcagcctcagcctcctgggcacaggcaatcctccctcttcagcctcctaactgggaccacaggcgtgagtcacaatgctcagctaatttttaaaatgtttgtagacacaggggctcatgatgttgcccaagctagtctcgaactcctggacttaagtaattctcctaccccagcctccccaaatgctgagattataaaaggcatggagtcactgcacccagcctaacgtttaatgtttaaaaacaagattttattctgtttattttcatttataggtcatgacattcaaacaatgacggcataaaaattccttctgctttgggcaaaacaaggtattttgaaattcttttttttttttgacatttaattctaaagttttatggccaattcctcaaacaagaccattcaaaaagctacagaaattctctctattcaacgccttttaaaatgctatttttcagtgtagctaaatgagaatgatattttgtaagcactgctattattagagactaagaatacatttgagattattattagaattttactttttcattttccaaaaaaaataataccaggttccaaaaagctgcaccttgagattataggtaactattcctcatgaaaaaaaattacaggttggatgaaatttgcgtgaattagttaagaccagtatttataatcaaggcctaacaaaattacaagctcttgagtttttcctaacaaaactgaataatattgtttctcatttgtgaccagtttctatggaaatgaacaatattccagctaattcaaacactgctgcagataatattaaatagcaatgtcattttaattccaaaattttgacccccacaacacacacacacacacacacacacacacacacaccccaataacaaagctccaattccaggtggctcttaaacttctatacccatggcttcaaataataattttgattttaagtcataatttagcctctcacttcaagtgttttgagaagggaatacccacacacacatgcacacacatgcacacacaccacacacacacacacacacacacacacacaaatggttgcttagaggacaacctccatcctaagaaaaaataagactggcaagtaatcgagttctttaacttctaagcccccgactgcagagtcacaatgcaccttagtacccttagcaaagacaataaagacgtaaaagtccttcagaaaagaaaaaaaattttctttgtttcaccaccttgataattttttgtttacttcctatttactttctatcttttctacatgcaacacactctttgtgaaacaggcattccaacttttgctaagctattagatttacacaataaggtttttttctacacagaaactttggttgagaaggggccatgggaaggtcttgtacatgatacaaagaaatatcctaagaagaagtatgatgcatagccctaaataaagtctgtcctgtgtcccatccagttctccaaaggacatcattcaggcatcacttgacagcagaaccaacctgtgttgttcctttagtagtagtacagtccatccccgggagtgtgttccaagtaccccttcaccaccccctaagctggacaaacatactcttaagagcaatactccacctggtgcgagaataaagtagaatcatcctcaaattcaactcttaaaatggcaaaagtctgtgacctggctgtgatgtcctgtgtcaaactgtccctcctacgccaatatctccctagcgacagtctctgcctcctgacctaaatgacataagctatcagtgtgaaccactaagcaattcccaactatctgcctcaagaagctgcatatcagagatgaactcagaaaacagcttgcactcatgttttatgactttcagagaacactgacatttcagaatgaaattcaccacggaaaagtcatatgctgacctccctagtatattaaccccatgtacatctcatcttctcaaataaaaaaatccatgtcagatgaccaggttcaggtattttaaagtttacagcacaagaatatttgcttaaatgtgcttctcctaggtcctggcactacctcactcccatccagcacatgtgctcactccaaaaatggcaagccgatccaatcaatcagctcttgaagtttcaatttaagctccattctttaatattatttctaaagcatataatagataatattaatctggttttataaagaaggaggaaaagggagaatggagagacaggaaaaaaaaaaaaaaaaccttatcacttcaataactagaaaagcatacctgaagccaaaatagacctgccagtctggaacttcccctcagaggatacactcctttcttcggagtctgcagaaaataagatgcactttggcaccattcttcaagctcgctttaaaatttctccttcaactataatcaagtcatctagacagtctaagttttacattttgaattcctatcattggaactagggctgataaaataaaaactaaacatcctttaaatcagttaaaagatctttaccctagccactcaaaataagaacaaaatacaagtaaagtggcaataatagcaaaggcgtgaattctcccctcccctttattcactagaggtatgaaaagtcctgccctattgatgatcaaaccgccttctgggtcctgccacaagagatcctgaattccgcaacttatcattgaattctgcaatgtcaccagctgcaagtcacccaagagatgacgtttctacaccttgtcacacagtactgtcacatgctagtcactccatagcaactaaaatacttgcagatgtaactctcattgataccatttaaaacttgcctaagtttttgggaaaatgaggacaccatacctcctctctccttacaattacacatggtgctttatcttaaacacactcacacacacacacacacacacacacacacacacaccccattccatgttcacaagtgtttcctaatacgctgacaaggcggcctagaaagcactataaacttagtggagaaaaagtgaggtcaggcatggtagctcaagcctgtaatccctgcactttgggtggctgaggcgggaggattgctcaagcctaggagttcgagaccagcctggacaacaccgtgagaccttgcctaaataaaacaaatttccaggcttatctgtacatgtctgtggtcctgcctacttgggaggctgaggcgggaagagcacgtgagcccaggactttgaggctacaatcaggtatgatcatgccactgcactctagcctgggtgacagacatggccgtgtctctaagaaaatcagtaacttttttaaagtgagacccaggctatgtcaattttccaaagacacaaagatacttagatataaagttagaattaaccacatgtatctgtcttcagtcctagagtaccttccacagtaaacattccactgcccttatatagttgaaaggaaggcaacatggtgaagagaaaagaaatgataaatttggaggctcaagccgaccaaagttcaggtctcagctctaaattatgtcacctttctcatccttagtttcctcatctgtaaatactaaggatcagaacacctgccttacagggttactgtggggattaaacaaaatcagtaactcaaaattaggtattagtcttaagatatttaagactttaatggtttctgcttcccagaattcttgattttacaaaatagaaatagaaaaattaaattctgcgcaattcccagaataaattcaggggccatctatcactggctaaggcatacactttattatctatggtaaatgctacaaagaaatgtgtagtgtttgggggaagcagtgaataagaacagagatcaagatggctttgtcaacacctgactgcgatacagataactagaagagtcaaattagatccctaggcagagtatcaataacacacagtacttcagccagcgtgccagggcatacacgagtccagcatcatccttttagtcaagtatttgaacaaacaagaggacaagaattgccctctttccataagtccccccaaaacagtattctataaaaccctagtgtgctctaggctctgaaaaatcaaagctataaaaaaatacacacatacaatgttttaactttccagcatttctcagatttatttgactatgaatcattttgtacctaaacagaatttgaaaaaccctgcctttctgcaatactacaatatactagtgcagtccctgaaacttatgtgtgtattagaactacatgggaaattgttagaggcaactttaggtcccatctcagacctaaagtttgagaacccaaaagttagttatatttcaaaaggcatcctaagttctaaacaaatttagaaaactactgcaccagtaggtttttagagttgtcagttgtgaagaccaccagactctccaaattcagtgtctgtaagagtcacctgggaagcttgttaaaaacacacatggccaggtaccacccccaagagtcagattcacaggttctggggtgcaacccggtttgagaatcacaaatggtctaactaggcattcagtgtccactggctataagcatcctcaccgtaactaccttgtattttattagaggataaataataattagggatatgagtgttgaggggaagagaatcctattcactggtacaaattaactcagagggtttcagtattttgaatgaagatgatttcttctttttccagtcccagctcaaaggagaggatgatttaagaaattatgattcatactttgaacattactgttttaactgatcaatattttcaatggactgagaacaacctgtgaaaatctgatctcttccctaacctccacacgcaactcattgctggctttaaaagcattagcaaaatcagcacatcccacagggatctatgtagtcgattcacagtctcttcatttgatcagaatcaagttcttccgtatttccccctacagcaaaaaggtcctgggatggttaattttacgtgtcaacttgactgggccacaggatatctagacacctggttaaacattgtttctgggtgtgtttgtgaggctgcttctagaagagatgagcgtttgagtggtggactgagtaaagcggatggccctccccaatgtaggtgggtatcatccaaagcccaaaggcctaaatgaataaaagggtagacaaagtctgaattcaatctcttcctgactgctaaactgggacatttctcttttctgccctcagagctcctggttctcaggctttcatactcagactacaatctaaattatcagctctctgtcgctcaggccttccaacaacaccagaggcttccctgggtctccagctcgcagatggccgatcgtgggacttcttggcctccgtaatcacgtgaaccaattccctataatgaatctcatgatagatagatagcacctattgattcaatttctctggagaatcctgttacaattacactactctctacatgaactggacccaaagagaattgtatcagtagcaatttcccttctaacttgcctagtccaacttactatatggctcatcaaacagcacatcttattactttattattaccttatattccctgtgatgtaaataagattattcctcaagatcttttgtatctttcccttgggaatataaattgaaatgttaccatcaaagaaggaaagagtcatattacctacagctgattttggaacatctactgtgttatctttgaagtttgaagaatgcatgtcagcctccataagtttggcaaaggccctttggaaaggcttgaaggttttgtttttgatttttaaaaatctaattatggctataaacacccaggatcaactttcattttgtactcaacactgagatgaatatttctaaagccagaggcagtgtactttctacctttcaaatgtactgtaagtcctgggccttaagtgctataatataattagtaccagctcataccaaagtgatatcaatggtatgataatattatcagctcacaccaaagtgatatgaatggtatgataatagtatcagctcataccaaagtgatatgaatggtatgatggttctgacattgtttcgtaccaatattaatgtcacagttaagagcagcagcttaagaggaaaacaaagttctctcactgatatcagttaccaagcatgcatccacacctcctgccgggcaccatatgaataaagagcaaaatacagctccctatacccagaacttcatagtctagagagtgaacacaaactctgcacagaaaactatatgcaagacagaaataatggaccaactagtgcttcaatgggaaaaggttacaccacacacaaccctgaaccaaaatgtggcatttaccaggtggagagaaaggaaagaaaagttttcccagcaccagggataggtcacagaagacagagacgtgtaagactgaatggcttgtccaaagcagtgcaagagccaatgtcactagactacagggtgcgaagatggggcagtcagagaggggcgtggaatgcttaggcaagggagctaggaaaagactttaagtgggtacgaaaaatggccagattcaagagcggtaactaggtggtattatggaaggtgactggattaaatagatagattaaatgaattggaatttataaagtgcttaaagcagtatctggcaagtaagtgctatgagagtgttttttaagagggtgagactgaagatgggggtaggtccagttagcagactcctgcaagggtcgaggtgacagatgagaaggattccatgtaaagtaatcaatacagggtggatggagcaggattgtgagtaaaaaagtaaaaccggttgaatttgaggccaattatatatgagagatgaagaagagggaggactcaaggtagacttcaaggtttctgacttgaacaccttggtgaatcatagtgcctttagccaacctttaagcaacacaaagataagccagacttttaggaaggcagcagattaaaaaaaaaaaaaagaagcaaaagctagtatttcacaacacttaaatcatttgggtctcataaactccatacaaggtagacaatttatatatacatatacatatatataatatatatatgtatatatatatatatatatatttttttttttttacaaaaaaaatgaggttaatgagctattccctgaattgcataattaaaagttgcaggcagcagagctacaagctatgtcctctggctccttggctcatggtaatttccatgtcacagatttgccaaaggaaacatatcatcctcatactccagctttctactttttctcctaagccaactatagaaagcagccaaaaatccacccaaaaaatgactttagttttatagttgctggttcttccattgaaggctttgttgtacctccttattagtaatgggaaatacccacaaacattcaagactcaagttcatttatacgttacagcaacaaccaagtgaccacattcaagcttcgatacaagaaagccatcttactcacaattttttttttaattctcttgacaaaaggtattttttacgatgaaaagtcaaactactggccaggcatggtggctcatgtctgtaatcccagcaccctgggaggccaaggcaggcagactgctcgagcccgggagttcaagaccagcctgggcaacatggtggactcccatctctaccaatcaatcaatcaatacaaagaaatacaaaagttagctggggctgggcgaggtggctcatgcctgaaatcccagcattttgggaggctgaggcaagcagatcacatgaggccagaagtttgagatcagcctggccaacatggcaaaaccctgtctctattataaacaaacaaacaaaaaattgggcatcggggcacatacctgtaatcccagcactttgggaggctgaggcaagcagatcacatgaggccatgagttcaagatcaggctggccaacatggtgaaaccctgtctttactaaaaatgaaaatataaaattcagttactaagaggctgaggtgggcggacggcttgagcctgggaggcagagattgcagtgaacagaggttgctgctactgcactccagcctgggcgacagagtgagactccgttaaaaaaaaaatactgaaaatttaaaaattagttgggcatggtggcatgtgtctatggtctcagctcctaacgaggctgagacaggtggatcaactgaaggcacaggctgtagtaagctgtgatcatgccactgtacagcctgggtaacagtgagagagaccctgtctccaagaaaattttttaaaaaacgggcaaattatctaacatttagaatttgaaaagtatgttctctataccatagaaaaactaaaaactcatttaaaaaacacacacaagggagaaagttttaaggttatctagtaacccaagaatcttgagatacatccaaattcttccatagttccccagcaattagaatggatgtcattccctttatctaaaacgttctagtgcctatagaatcccgtccatcaacgccctagcatgctgttccagatttgctgcgtttggctgaccaagtcttgagcctcatttcccactaaatttttcccttgtacactatgtggtctttggctcatgttattgtttcctaagcttcaggtgtcctctcccttctagcacacacatctactcctcctgcaaggctcaaatcagatgtctctatgaagcctgcggaaaccctcgactgacatgacttcacaatctcgtagcactgttgttaagcctctaatagggcacttctttaactgtcttgaaataaaatacatgagatgaattaaaggatactctaccgtttgagagaatttttactacaattttgtaaaaagacatttttaaaagacaaccgtttcacagggcctgatagtaaaaaataataaataaaaataaaaaataataatcacaaccataccttcttccccaaaaagctctgaagataccaaatcttaataactttattttattttattttatttttttgagatggagtgctttgtcagcgagcctggagcgcagcggtacaatctcagctcactgtaacctctgcttcctgggttcaagcaattctcctgtgtcagcctcccgagtagctgggactacaggcacgtgccacaactcctacaaggttttaccatgttggtcaggctggtcttgaactactgtcctcaagtgatccacccaccttggtctcccaaagtgctgggattacaggtgtgagccaccgcacccagccagtaattttctactgaatgaaataggctccagatcccactgagtcctcaagctccaaggaccttgctatattaaagcctttaggtcctacaagtgctgttgctgaaatgtgctcaagttatatttggtgttcccaattaaactccaatagaccacacctaaaccagactcattgtgggtgactcttgccttacaacaagttttatacaccaaaacttctgggcatctcttttagtcatttcccaggaggacacagaacacaggcacaatgcaacttgtttaaaagaacaacagaaattatcttctgtcattcaaagcagaggagcagatatcaggtatcaaagtacactttggttatccaatcaatcactttcatttgttggcttttgggcaaacttttttaaaaaatgagttacctaaagaacaacatggtcgcgaaaggagataaaaagactgcagcataacccgaactccaccccttcggaaggcgtagctgtcctttggctgcactgctcccactgcagtgtagacatggaagtatctgcttcccgtttcagggttctctaatcacagactggattctttcaacctaaaccatctatgagaacagagcatcttggggaaaggccaataccattttcagctatggaaaatacctacaagagccatttactggggaaggagcttccctgaaaccattcattctaggaggcaacattgttaagggcagagaataatggactgcctatccagaaagcgaggcagaggcaaaacaacttagaggttaaaagcaaggacttgtgacaccgaccaccttggttcaaatcctgactctgacgtttgcttctgtgcctcagtttgcccatctataaaatggggtaggagtgcacctaagtgcataaaatagggcagctactattaatctggttctgaagctaaacgcctgcatgacctcaatcaagtcacttaacatctcagcttcctcatctgtaaagtgaaagtattaaatacacacccttctgcagctctagaatggctctgaacttaagtatagtaccacctaactcaatgtaccaggattagcagtctcaacttgcttaattttattagtcatatagtaatttcacataaaatcagtttgatcaccgtatttttagttccagttctccaaggtcaaccctcagttcaacatgacatcaggccagatgccgtggctcatgcctgtaatcccagcactttgggaggccgaggcaggcagatcacccgaggtccggagtttgagagcagcctggccaacatggtgaaacccagtctctactaaaaatacaaaaattagccaggagtggtggcgggcgcctatagtcccagctagtcaggaggctgaggaaggagaattgcttgaacttgggaggcggaagttgcagtaagctgagatggcaccattgcactccagcctgggcaacaaagtgagactccatctcaaaaaataaacaaatgaaataaaataaacaaacaaacacgacatcaaacaggttccctcatgaagacatgttgcaaataaataagctatagaaaatagccaaaaaaggatttggtcttgctattcatattcagttctgagttcagtgtgtaatttatagtaacagaataaatataacaaaaaaaaaatagaaaaagtatgggaagaaaggtaagtttactataacttgagaaaagttgaaacaatgtctttgtattaacttctgaaaacattttcataaactggaaccatccaggctcacaaaagcaaaaaccttcctttctgttgccaacaaaacagcaccaaatacttttatgtacattcctgtgttttcctccaactgcctttttcactctagctcttgaaatatggtctttattataggtggagttctcatactttatgagccagcctgccattttagatgctgtaaaagcccagtggatgtatcactgcaaccctaaagagtaaggaaattaaaggataaaagtataaagtatagggttatatcttgcttcacgtccaaggatgcacagaggtcatctatgtataaaactgcttttttttttcaaattcctcaaaactgtgcacaactccagtaaacagaaggcaggctttcccttcagttctgcatagattcacatcaggataaaactcaaacgttttgggcacaggcttattggccacactcctttcaactccaatttccctacgccgctacttctgccaaccagtacagctcactgtggttgctcaagttcaccaataacatgtcaagcattatcctccaacccccttttaactgttaacttaggaaacactgagtgactattgtgtgtcagacataatggtcaacatattagtccattctcacagcgctaataaagacacacccaagactgggcaatttataaaggaaagccgtttagtgggctcacacttccacatggctggagaggcctcatcgtcatggtggaaggcagaggaggagcaaaggcatgtcttacatggtggcaggcaaaagagcaggtgcaggggaactgccctttataaaaccatcagacctggtgagacctattcattatcactagaacagcatagctcccatgattcaattacctcccaccaggtgcctcccatgacacacggggattatgggaactacaattaaagatgagatttgggtggggacacagccaaaccatatcagtaaacaaggcagatatgctctctggcatggcagtttgaggttataattgagcagccatgagagatgatttttaaaaagcaactatgttaaagatgaatgttatttttaaagatttaaaatgttactttaaaggagcaatgcaatagaacacatagcctagtctaaggacatcagccttcctggagaaagtgacagcgaaactgacactgaggaccaggagcaggaaagccccaggcaagataacaagacatattttaaaaagcaagggacattcactcaggttgaagcttgtgggacggaggtgagacagtgtgaagaacacagagcaggcagaagatgaaggtggaggtgagcagctgcttcattatgaaggctcacactgacagcaccatcaaaacacttttccctttgcttgaggtccatcttgcactttcccaataggccagtaccatttattagaaaataatcagataactaaatatgtgacatgccatcttagcaggtataatacattttaacaggaactttgtggaggcagtgctttgaccagaaagactgataaatgagtgaaattttaaggctccaagacaagccagtggagaaaatctttggggttaaaatgagttttccactagtttcattcctgtatttgctgtgtaagttaccagagcattccagttatctagacagcatttagttatctagtcagaataattatcactaaaaaatacaacagtgtaagacatgtgctacctgccattacaattattatcctcattttaaaagatctagcacaataaattgagaaaaagaaatgaaagaaaaaatagaaaaaggtagaaataaaataattacttgcatataactgttgacatgtaaagcccaaaaatattaagcaaaaaattacaactagtaagatagtcagttacaaaaatataaaaacaatagctttaataaatcatgagggaccagttagaaaacataactgaaaaaaattctaccaagaataaaatttatgaagtagctaggaataaacttaagaaaactaaaataaggaaagtacaaaattttgctgagagaagtgaattacagttaaataaacactatgctcctgcaataaacattgtaaagatgtttctctcactaatccctctaaaatgtaatccaattcaaagagcacatgaaagataagaatgtagagaacttgaagaaaatatatttgaatgtataatttcctcataaagaaggtatttctaacctagaaactagcagaaatcatgatttaattgagccttgattacatggcaacaccactaagcaaaattaaaatgataaatggatagaaaaacacccattatacaaaaggcaatactatccttcaaatggaaagggcttttgggtacccataagagaaagattaatacaacaaatcaaaaaatcggcaaaatacattgtactgagcattctaatcactgcatccttgtgtcagggctagagaagtcaattcatccacagcccctggcaacaggccccaagagcctcagctctctatgctgacctcagctgactggaacaggagtgaccagctgataaaactgatccaacagactgctcaccctagaaatctgggccgcggatacccatgcacttaaactatgactgggtacgtgaactgaaaggtcacataaagtaggggctgaactaagtggcatggcacaccaaagccaggtagaatgaagagttatatagaggaacaaagacgccatgaaaaaaagggagagtagagatggcagagagaagcagacccttcagttcttgtgtctgggaggtctcactgttccttgcatcctgttcttggatataaacccaacgcctgtgacatccatccaatacaattaattcaagtaggtttacagtccactgcaaccagagtctagaccaaaacagatgtgagcaagcaattcgtaaaaaaagggtaagcagataagaattagacatgtggaaataaagctcatccatgtcaaagacatacaaattaaggtattcagatagctttttcagccattaaattggttaagataaaaaagcacttagacaaaggacagtcaagtatgcgaagaaatacaggcactcatacattaaaggcagaagtacaatctgatatatattggactaggtctaacaactcttaaaatatgcatatcctaagaaccagcaattatatgtctaagcatttattttaagaaaagaatcataaacatacccaaaaattacttaagggtatttactgcagtgataattataataagaccacaaaagaaacaaatttacaacatatcactgtttttcacgcattactcatcacctttttgacttttacagatccttatacctcatgtattgatttactattattaagtcaggtcatgatttttatttaacttagtcttccaactagtatttattgagtgcctactacatactacattccaggaacttttctagattcaggagtgaccaaaacaagacaaaaatccctgccctcgtggaacttacattttagaggacagagaagtgataagtaaaatacgtagtacgttggtaatacagccaaggggccgtggggaagcaggcaaggagaatatgaaaccgtgagaggaaaagagttataattttagaaaaggcaggcaggtaagtgcccaacagaagagaatcattaaaaatgtgaagtgggagagcagggctctggggatgaacacttcaaggagaaagaaaagcaaaggcaaaggccccgaggtggaagcatgcccggcgtgctcagaaatggccaaagaggccaatgcaactgaagcagagtgagcaacaagagtgggaggagatgaggccacagagcggtgtatgcggtgtagatgggggggcggatcgtgtagggacttggaggtcatggtaaaggctctggctttgactctgagataagtcaacaaattgagaaaagactaaagcagggtgttagttgcaaagatatgggaataaaccgtgctcacctggatcacttgaatgagagtagcattcagagtggtaacacagttgagatatgaatgtattttgaaggtagagctgaccaaattgctgacatgctgaatactggagacctagcgaaatcacctgagtgagatgccaaaaaggtgctggagactcccgcatttaatgggctttcaaagtaaccgtaaccctgaactcacgtttgatgcagcagttagaatttcaaatacacataaaataaaaatataattattaaaaagcaaacatgctcaggtgttccctacagttatctcaaatatcatcaatggttcctgcaacatactttcggaatcagttattttaaataaatcagattacctttacaccatagaataccaaaaggacattaacttatgtggattttatttatctgtgcacatgcaaactcaaacacaaacacacagaggttggaaatgcatatattaatactaaaatggtaacaatactaattttttaatagtggactaatagatttatttgcttctttgtgcttttcaagttgttttcagtgaatatatacatttgtcccgccatatccatgagggattagttccagggtcctttctggataccacaatttatggacgctccagacctttatataaaatggtgtagtatttgcatatagcctacacacaccgtctggtacactttaaatcatctctagattactgataatactgaatacaatgcaaatgctatgacaataattgtttttctgccttgtttaggaaataatgacaagaaaaaaaaaggtctgtgcatgtttaggacagaggtaaccatcctcccctgacccgcccaatatttttgatccacagttggtttaatgcgatgtggaactcacagataccagggctgactgtactttgcttctaaaaaaaattcaagtttcttacgtgtttttttttttttttaatacacatgcagaccttgctcaaatcaagttttgtttccggtttgatctgatggcaaggcttttaactaaatatccagaaggagagaaagggactgagctaggagcctacaaggtaggagtgaggagctatggtcagaaactagaaactgaatcccagatagcagtgacagagacagcatatatattcccaaaaagtggatggcttatcacatgcaaaaactcaagatccagacagtataagatagacagcgaatgtgagacgctcttgaaccagccatgacccagctctgggtcactctgtagaccaggggccagctctccactgagacttcactgctttgtggtaagcaagtcttcctgacacaagccaatactatgacaccatgtatttataaactactcaaatgcttccaagtaaacgtcacttaaaacaggtaaaataaacattcctatgcatacgccaagctcaagaggagtaggagcaagttcaataaaaatcagagggggctctaaaagaaactaatcatgcttctgctctctgttctaatagtgtattcctcataggtaactgggattaagtggaggttttaggtcaaaccatttagttcttgatgttttaatactcactggcaaaagatgataaatgtagatagtaactgaaatgagactaaactctaaaagtactctaggccaggcatggtggctccgtctgtaatctcagcactttgggaggctgaaacaggagaatcacttgagcccaggagttccaaaccagcctgggcaagatgacaagaccccgtccctatatatttaattaaaatttaaacatatttaaaaaaataaaagcactagtcatctctgagatgttcaagtaattctccacttgaattaagaacaaggatggctgttcactaatctcaatcagacccatgatttgtttgatcttgaagatgccagttgtctatcaggcagatggctagtaggtaaggggagagtcactctgggatgaaatgatagaggactgttgtaaatacctgtcgtgtacagacacagctccctaatttctctactaaagaacataattatgaaaggttttaagttatctcattgatcaaatgaatcatatggcttaactcattaataatttgtgaaatcatataatgccatctgacacagctcatactgtattcaccttacaaccctgagtgggacttttaatttctaaaacaatattctgccaatgacagtagcgcttcagttctgatttcatgtagagcgatggctttatgtgatcaagaaacattaagtacgaaaaattacctaaaggtcagcaatgcctcaccatgcttggaaagtgaacaaaacgggtttccatgaaaggaaatcgtctgaccctcctttgtgtcttctgctttacaaaagcatttctgcgcttcataaatgtaaatattattcagtaaatgtatcctgtcctctttaaaaataaataaatgaagttggggcaactgagtatgtgcaaaccaaagttctgtttttaaaaataatgttccggctgagcgtggtggctcatgcctgtaatcccagcactttgggaggccgaggcgggcggatcatgaggtcaggagctcaagaccatcctggttcacatggtgaaaccccatctctactaaaaatacaaaaaattagccgggcgtggtggcgggcacctgtagtcccagctacttcgggaggctgaggcaggagaatggcgtgaacccgggaggcagagcttgcagtgagccgcgacagcgccactgcactccagcctgggtgacagagcgagactccgtctcaaataataataataataataataataataataataataataataataatgttcaagaaaaaagtaagacttcagtggctcacaagctagtaaactgcatttcaaaaggttttgccactaggtcttatttgtttctcaatcatcttaattggtctctgaatatcctatagatgaaaagcctgaggaaaaggcttatcatacaaatgggatgacagacaactcaaaaccaactttaaaacaagcagaagggagaggcctttaaaaagggaactaaagctccaacactacttcctgcactgagctctctcccaaacagccaggctgcttgcagctcatcttacccagaagagccgcaattgcttcccaggatcctaacttgagcacagacataccatttacaagtgtaaatgtggtgagttcatcagtttctggcattaccaatacagagcatggacagaagagacatttcaagtccaaattttctccatcgaacttttagacacaaactcagctgaatgtttctatgtttttataggaaaatattttcttaagcatgaaacaggataaacaccaaaaacagtggggccaagtttgccttgtaaaagatctattgtccaaaggtgaatttccctggcatctcttgcgacatgagaacacctcccatttgcttttcctcccacaactcctcagctctttaaaggtggagtctgtttgctgcagcaaagccaaggggaatgatggttccgggcagtcacagaggcggcctactttaaggagaaacacttctgcaaatgtaagcaggaaccaggtttactcacccagagaaaaacacgtttcctcagaaggttttgcagctccagtagttatagaacacaccactcaccaccagcatcaccactgtaagtcaactccacgtggaactcaagtaagatcagagttctcctccaagtatcttactcatcacgcaaagcaacacttgggcttggctataactctcccatgacacagggatgacacaaattagctccacactgtgtcttccctgcctcccacacagtcgatggcagtggactgacaaatgtggtagttacttagcaatactttgtggttatctcacccacatcattcacagagacagacagtgccacccttccataaaaacttctcccctcccacaaactgttgaattctacataataacttacattattacatggaggaacaaaatactggcttgtgcttagtagaaagtagtcattccatggacctttaagaatcctaatgctgatcctgttgttctctaggtcttgagcaaaatcactccacagtaaatcaaaggaatgtgaatgccaagtgaataaagccagaagagtttaatgagaactaccacccacctgcaaatgtcccccccacatcattctcagcagctaagcctcaaaccctcaatcactctgagtaataggtggggaagttgtgtggggtgcattaaaccaaaatgtctcaaacacttgtgatgaacatgttggcctcccaaagatgacctgaagggggttggtagggttggtacagacattctgctgtccttaaatgaaccctagttggtctactcaagctgagaaaaacatttcagtgggatctatcatgagctttcatttgtccccactgtcattcaaagcattcagacaaaaacgatagttagtgtgtactaagcacttccgatattccaggttggtctaagacgtttacaggcattaacacatttaatcttcacaacaatcctgcgaagtaggtattattagtatgtccacctggcagatgaggaaaacaaagcacaggtgctaggtttcccataacacggcaggccagtggcagagctggaatgtgtatccaggcagtctgactttagagaccacaccctgaactacagcttatcctgcctctctgggagaggtctgtcaggccagtgtgggacagcagattcacagacagcagtcagattggagaggcacatgatgataatattctggaatacagaatatataaagggaattctagttccaatttcactattaacggtgtgacattgggcaagttgtcttacttcctcgagatcagtacattcatctgggtgtgtgtgtgtctcgagatagatgaatgcaccttgcccctctaaaattctactacagtctactacacttggtaaggttattagaatatcatgctctattttaaaagtactaaaacaagaacctaagtagaggatagaaagcagaagaaagtcccatgatttcagttgggtaaaaatcaagtttacaacccaaaccacctactaagcctgctgccagcattgacaactcaggcctaaggcagctaggtagtaaccacactaattggatggcttagcagactgctgtgtttgttatggctggctagtgtgtatgccaatattcatgcatgctcaggcactgcgtggaaaaaaagtctgttgtgtattctcagcgagggcagcccactaaaacacagcaccttgggagtgctggggaggcccagagagtggagctcagcagctcccattcaggctctcaacaaagcagctctactttcaaacagctgataaaacttaaagttcttagtaaatctttatttttaagagtgtctgctatttaaacacacacacacacacacacacacacacacactgaatttaaacactcactagcatggagagagcagacggggctctctaggtctcatgtggaagagcaggcattgtttgaagtgggtaagaggcaggacactggtgaatgtgtgggcttctctggtctgtgcccagctagtatcaaccagtcatgcctaggcgactcaagtataatgaagatagccaaaattctttgagttttcaagagacctccatctggcgctaacatgaatgaaccatcttcaggaagtctctgaaagacaggcatagaaagattcttctacaccattccacctgggggagaagccctaaacacatgaggatgacaaaatgaatctaaacacattagctagtaaagagaccctaatcccttcattaaagactttaaaaaaaactagacttttgatataaaacctactctatttctaaacaatacttcagaccagtggagaggtagggaaggaagagctgccagaaaccctgcccacgtgtcacaggagcagaaaggcagtggatggctctcctctgctgtttccaaggccaaaaacccagtaagacctcaccatcttcccatgttaaccaggatttccaaagtcttggaataccaagaagcaaaaagtacctactgctgggtccataatgagcctggcatctgctgacagaggattacaccaactagcatttggcccacagccagagcagcttagaccaaagccacagctactctatgcgacatcactatgtgaattcccataaacccaaggcagctgaagactgcacagttccaaagtctacatggcattttataacccttttgcgctgtagagactacttagaagtaggacataaaaatgctctcataagggatttacatgggaaaaacaattttggttctctttgagagcaatctggataatttaagataaatagctctcacaaaattgtatggctttggccgggcgcggtggctcacgcctgtaatcccagcactcggggagtccgaggcgggcggatcacaaggtcaggagatcgagaccatcctggctaacacggtgaaaccccgtgtctactaaaaatacaaaaaattagccgggcgtggtgggaggcacctgtagtcccagctactcgggaggctgaggcaggagaatggcgtgaacccgggatgcggagtttgcagtgagccgagatagcgccaccgcactccagcctgggcgacaaagcgagactccgtctaaaaaaaaaaaaattgtatggctttactagtatacagactattaatattcagtgaagaagagctcttcagcaaaggttttagacaaacatctatcagggatgaatgcactgattaaatgaagcctcatgcaatgttaaggtacagaagaagccttcctcagaagttccctcttgccagaacacatggaaccaggcatggactttccttgagcaaaaacccatacattttcatatcattcttttataaagataaattcattttccatgttattttttccacagtcaatatgccactcaaaaaggctgcctttgctatagctgttaataaaaacataaaaccatcagtagtattagaggaacccagtagcaagagttattgctctctttgggaggccgagacgggcggatcacgaggtcaggcgatcgagaccatcctggctaccacggtgaaaccccatctctactaaaaatacaaaaaaattagccaggtgcggtggcaggcgcctgtagtcccagctattcgggaggctgaggcaggagaatggcgtgaacccgggaggcggagcttgcagtgagccgagatcgcacgagactccgtctcaaaaaaaaaaaaaaagagttattgctctaggtagacaagttgcagcatgaggaattagaatcaccatacctaaacatctgagcaaaattcaaagaatattttaatttctccattttcttccctttcccttcatataacgaagtaatataagaggtattaggaaaacccctcctccatggaaagatacttcagagcactctgtattctgggtttataatgcgttctcctcttctaataacagctttgagatacaatttcagtcctcacctaacacccctgacccaagggcatcaaaaacggtacaaagaatagagaagtagagaagtaatgagtgtgccatactgttatttgttgctaatctgggctttgtgattaagggaactaatatcaaaagcatggtaaaatagaggtatattccagtactgatgatggtggtgatggtgatgaatgacagttgacaatatttattgtgcacttactggttccaggtaccatgtcaagcacttcacaagcattatctcaattgatcctgacaatatctccaggaagtaggtcttctataaccactttataagatagactatttttttttttttttttttacccaaggcaatactgtcaggaaatgggcaagctgggctatgaagacaaatatcctgatttaaaaaaacaaggttaaccctacacaaggttctgtccattgggttttgagttctggtcccacaagacagatgtccagcagctggctctatggggttccaaattttaacataattatgggaagactcccatcaataccctttaactcataaattacctataattatctaagagctgtatctccccaggattaaaaactccaagagttctgataattagtcttcaaatacgaaggtaccatggaaagaaagaaaataaagttccccttctcccttgggtcccctgagaattctaaagatggtgaaattttttacaaattgatcttttccctgttgtatttcattaatatataaataatttaagatagacacttataccttccatcagaaactttaaaactctaataatgagtcctaggagatctaacacctttcctctttttagttcaaggtcttacatggaaacaacttaaagtagactttatcttgactaaacatgatccccctcttgtctactatatttatagctcttattgttctctacccttgagcccaaaccacattaagattgaatcacttctactgaaaacacactgatgctaaaaaagaaaaaaaaatcagactagaacatactggatttgttttcatttccaaccacaacccctactccacattaaataggatggattgctttctcagggaaaaataagattattagaaaagttagttagaagcacaaaaaccaatgtgtaagagagactgttcacttagcagggctcctctgctatggaagattttaaccaagagaagaatcgtacagccaaattccagaataagctactctgcatagcatttactttgggtataaagaaaatgacatcactacagcgctgggatccgaaacaagtgtttcatacaaagctggttacaatgatcagttcattccaaattggtgggaaaggctttgcactaaaatctgggaatgtacagccatggatggctcaaagcacgtcatgggagttcaaactggcctagattttctaaaatcttgttatgtaaaggggataaaattttaacttgaggataagtatattctaaaggaaaaacatgaggtaaaaatatggtatcttgtctattagaatattgctttgaaagtaaaaagaatatttcattactaccattctgatttgagattctgttactccaagaagctggcagcataaattataggtaatttatgagttaaagggtattgatcatagatatgactttgaagaggatggcgagaggaacggctgtcatctcagtagtgagctgaagaaaccctgcgtctcctggagtggatggggtcccctaggcctttggcggctgcactgtcccactcacatggtcctgtctgcattctcagacttactgacataagcagggtggcaactccctcatcagtccttcactcgtcacttccaggtgcatagcacggcattcggaagacaggtgcgtccacactgagagtgctctggggcggcccccaccaacactgtgggcagtgtcagccacacccatgagggccgctggacctctttcactccctcttctccctccctgctgctgacagcaggagtttcacaggcctactgcagcatcaattagaaatagcagaagagggtgggtgtggtggctcgcacctgtaatcccaacactttgagagggcaaagcaggaggatcatttgaggccggtcgttggagaccagccagaacaacatagcaagaccccacctctacaaaaaaaattaaaataaatggcggaagaagggaactcaaactggtcacttagtctcaggattttatgggaaagaatactgaagttactgtttggaagaaaataaacacatctaaatgaaatcctttatatttcttgaccaatagcatgaataattaaatgcatttgtaataatctccactcaatactgttcgcctaaatcaatggtatgagcctagcgaaagcattccactctctgggagtgactagactggtattctttgtagagatgggatgtatattaaatgcttatcaatttgactataaagttaccctgtggaagcaaaagaaagagagatagaagaaagatttgcagattccctcatgatcaaaaaacattcttaataagccatttaacgcatgtgtttgaccgtatcagtagcaatacaaatgttttgattgtgatatcattaccaagaaggcaaaggtaaatatttctctagagaaacagtgatattccctgctaaacctcactccaaggctcaagggcacaagtaggcccttcaacctgaatgccaacatttaacagaggctgtggggctacgaatgtccttgaggcttttgaagaaaaatcagatgaacagaaacgtagggggcggaaactaacgatagaacagtttctaccacgccctgcagggaaacatgttccttgtgaaggtacaggggttcgaaggttctactgctactcctggggaaactcacaccaggaagccatgaatgtctctgggaggttgtattcctggcagagagggtcacggactgctgacaaatgatcaacaaatgccaacaaatcagtacactgaccaaaagtaacaatcaactttcaaacatcttgtggtaacctggacttagtgctgtgcagaaattaaaagacggcctctgcctggatagaagttgcaggatgcacgggaggcgccggcaaaaccgactggtctcaactccctttgccctcacttgccacatctctctaggggtcttgctcatgaagagggaaattacagattatggcaggttggtgctggaaaaaaccctaaattgtttggcttggcccaacaacctcattttaaagatgaggtcagctcagaaacgggtaggtgacacagccaaagacagagctcatgtgaagtaccaggaaaaccccaggccccaccctgccaatcccatgctcccttaactctaaagggagaaaaattcgcctcaatttgtgcctacaatacccatgtcctggataagcaagagtcaagaaattcccgatttggcctcgacactgcctttcacctcttacatgctggtttcacttccgctgctgaggcgcacacttctgctttcatgcgagaaaccaggcccctctgaaaagggatggagaagaggcaccatcaaccagtcacttgagccaaggaaaagagactgcagtatgatctcctactgtcctggtgcttcccttcctggaaaaggtgcaattggggtttcaaagtaaatatctcccatcagtcaactcagagtgaagataaccagtggatgttacttccatgaaagaacaatgcaaaacgtcaagctgtgtaggcagcccaggaagactgcaaaccagccaaaagcactctctccctccctccccttgctctgccttaatcactgggcaagctatgcacactgttgctacttttttggtatattctacctgctccaatcccagtatcctcgttgttttcaatttgttttgaataaacgatcctaactggtcacaaataactaatctaaggagccagaattagtatgatttcgtaccgtcaagtaatgagttttcagaggtggaatacaccatgtgaattatttaaccaaatctaatttttcagataagtaaaagaaagcttcagagagagatgaagaacttagatataaacagagctggggccagagccaaagtctcctgactcccagcacaatgcttttctggtgaccctctgtggcacccgcaaacacaaggctaccctgggatcagagtcacgctggccttggatgtgcaatggccatagcagcataacaacttaaagtcctcctccatgaatggctagtgagaatcagcaagataggatgtgggctgcagaaacaatcggggagacatgagcctggttaaatattcagggaagaaaaagacccatgacaactcaaagaatgttgaagataaagcagactgcaaaggcagggaagagaaagaaaagaggggaaggaacacgtgtcatcaagaaagcaggtgaaaagaacagcatcagaacacaaaaaggctagctactgatcacaagatacacaagctttcgagagttaaaaaaaaaaatccctaaatcctgttacttcctttacagtgaagtaactttctctaaaagaaggcattcactgtttaaccatgttggtgtacagttacatcagacagtcttcagatgtgttttcctaaaactgaacgcaacacaacataaatatgacttctaccccagccaacaaaacatggattttgatactgaatacatactgcgtagggcaaccccacccttggcctgcaacctagcatctgcagatggatctcttagcctcttgccagagctggtcccctggttgcatggccctgagacctcccaagaagaactgggtgccacaggaagagatactgctgactcaggaaatggccacctcccatggagaggcagccaagccaggcatgcaactgagaagcagcttgtagcagtggtgattaagttttaaacgcttaataagactgcggctcaaatctaagtgctgtatgttctctctcatgtaggggtgcttctagaaatattcttgtatgtatgtgtagtggtgggtgcctatttttgttgttactaaaaatgtttttctcctttaaagaaagaaattactatcaaaacactggcttgttgctcacagaggagtcccagaatgaccagtaaactcaccctaggttggggcggaatgcagagacggtggggattatggtctaggttgtttattgtcatacaaaaatgtggcaactgccattctttggctacatttcaagcggatacttcttggttccctcatgtttaagcttttaagaaatgctcagctatgcaatttccacaaagtcaatcaatgatgaattcaaagctgtaatgcaagatgagacagatttgcttccaaaggtcaagatgtcagaaaatccaaggccaaaatcaccttagatcacccttaggtttatcttctacacctgttggccatatcgctgcctccagtcccgaagcagcatttatacacctggcaactaaataggtattcatctacttgttagaaaacttatgcaaggtaaagggatttagtaaaaagtgccaagtcctaaatcaacagaatttccacttacattgcaaatgaaagggtctaaaacagagaattccaatcacagacaattactcattcattgatcttcccacaccatctatcatttctatatgatgaaacttcggctcacttcttggtgcctgtctaaccctctagattattacagtactatttttggccatgcactatgcatcagacacctcaactgccttctcttcagtcgctcatatcagccgagatgtaaactacggctgaatggtccgctatttttatgctaacagcacttcaatatttttcatctgcctcttcttacatgttggccgaggtctatactaggtatcatttacatttctagaaacctgaaatatcggcattatcctcctactcacaactatggcaacagcattcataggctacatgctcccatgaggccagatatcattcggaggcgctacagtaattacaaatctactatcagccatgccatctattggaagtgaccttctgcaatgaatctctgaggtggattctttcctcttactgactgaccttgtcttttgaaactatgacttccctcatgtctaaggtaaacttttctccttatatctaaggtaaactgtttcaaccagaagcacatcttccatgggtctccaacccttggtccaatcgatgagttccccaagggacttgctagatgcacaagttctagcagccagtgactgtttcccaccactagagctattaatgagccttctggttaatcagctgcagagacagatttaactcttcttgtttatcttttcagcagcaaaatactgaagaaatacaaatgttatcctattactgtcatctaggaattcagtcttgccatgggaaagctagactaaaatgtccacacaggatagatgtacttctctgttcaacaacatacagataataaagagcttgagaaaaccaggatggatgaaaagcattgaaaaccagaaccacagcaatgcaaacatctcccacatagcctggcaaaggcccctcccctgtcccaaagggattgttgcctcacgctgaaagatattcattctccatgtcttctcatggtggcatctctatttcagccaccagctgtcatgacatcctttctccctggctcctttcaggtactcacagctcctataacaatggatctgagacccagaagccctgatcaaagatgatcagctgtggatgattacaaaacaaagcgatgtcaagatcagcagattataggcaagacaatttgatactcatccttaacaccctgtcacccttaagagattttcattcatttagttctcagaagtcaacatggcatctcagctagaagttcagcctcattactcacttgtcctatgttttctaagacaattgtcgtaagttatttaaaaggaggcaaaaattgcccagtaagacggtgaatacagcaaggtaaaggagaagtagaaaaggaaagatagtcactatctctcctccccatgcacaaaaaggtcttgtagctcaaccccctctgcagatgggcaaactgaggggtcatgagaggacgcgactcttcccaagtctcaccatcaatagcagagttggaccaacagaggttcccctgctaaaaagcagggcctcaataaaggaccagctgaatcaacaaaagggagtggcttccttaagaacatgctgggcacagaaactctattgccccccctcccttctgaatacaggttcttatgcataccaggagcattcaagaacagaggggacaaaagatctccacaaaagcgagacaaagtgcaaggacaccagaacaccagacagctacaactgttccttggcctgcgaagcatcaacagttcagtctatctcaacaggtaagaggaataagccactgtcctttgaacatccaataagataaacaaaccaaaaaatccacagagcactctgcagtccatctagcactttcccatagttattttgtttcatcctcacaatagtcccatcttgcaagtaaagaaactgaggaccaaggaagtcttacccaaagtcatagctggtaaacaacaaggccggaagttgagcctacatcttccaactccatattcagcaccttctactctacctccacccaaagatattcatgacaaaaagccaaatataacaatagaccaaagggccaactgaaccacagcctccggccagctaaacaatgactaaaatcccagctggaacccaaagcaggctctgtctcctcaggacttcaggacaggattccagagtggattcagaccagccctctgctacgaggcaagctcttcgctctcctacaggaactctgggttaatcacatgtcccacagcagcatggctggagctagacctgtcaagcacattcggctcttggtgacacaacccagctgtgcaggcggttcccatcaagggagctccagacattccagacactgtgccacggaattgcagggagggaccgagctgcacagggagctggcaagcccgacagaactttccctaccacatctgtacttctgcaacaacaaggcagtttcaaatcagctcccaaagagctacacagattctgccttgtgaggatagactagaaactgacagtggagattccttctggagagtgggaccaatggaacttttaccgttggcattgtattcctttcataatatctttgaaaactagatcaaaattcaatctaaaacccataaggatgacagtctacactggaaagtggtgaaggcaaaaagaaactgacatcaggtgacgtaaactaatcacacaacagttttaaacaagagctttagaaacactgaattaaatgtaagacctttataaagtataacaagattcttatttacaaattttacaaaaatttcccttgactgttaacagaagaaattgagccatttttgaggcaggaaaaaaaaaagtctttagtacttaattcttttaggcattttcacatactttatctcatttaatctcaataaccatggaataaaaatattatctacaagtgatagaccaggaaactcagaccaggcactcagagaagctaagcagctttcacacagctgcacagctaccaactcctcgagtgtaaagacagaaagggacaatctaggaatacagacaagtcctaaaaaagctgccaccactgctgggcaaaggcaacctgcacctatgaaagaacccagacacaatggccagtttctgacagtcctttcttgagtgggtcacatgctgcctatggggtacatgtgtacacaatgctgctccccatatttatgaaactgacatgccctccacactacatgagcacacagatgttttcacaaagtgctgatggacctgcggtaatctacccattttcctctcccagcccccgttgccactgaaggctgcatttgagagatgcccaactgactgagacgagaacagaggtgctaccctggaacctggccacaaggaagccctgatgtgtttacagtgtgagcttgcccacaacttcaaattcatcaccatcatgctctaacatcgaagtcctcacgtgcctcacataaggaagcacaatttaaacgtcataatagccaatgatcattaatgtttactgagctcttttagagcagaaggaactatggtaattgcttcccatgcactacacactagttaatcctcacagccaccacccctcatgttagatactattatcattcctatttcatacacgaagaagctgagcttcagaagtggttaagtaacttgctagagaccaaactgtaaggagtaaaactgaagcctatgggcctatgactcctaagtcagactcagagccactctgcttatgtctctcataaaatatatttcatggcctttttccctcaaatattctctttgtcatttcttattaaagttatgaaacaaaatgtccaaacagaagaggcaaaattgttatactgatgggctagccagacaaatggcattataaaaatactggaaataggaacttacaatccatagtcaaggcaagcaatgccaatgttaccaatgcatacccacaaatacacctgttataatcattgactaccctggaagatcaagccctggagttcttgctgggttctggatggtcaggaattattcttcaatcccaggcatcttgaaaatggacataatatcaacggactaggctcaattccccttctttagcatcgttgacctcacttatcccctgcctgttgaacatcacaacagaaactttcccagaaagaaaccgtgaggctgaaattccctcagctccagggggaaaaaaaaaactccctatgcccttttcattagataactggttaatctttgaagtttcagtaaaacgttgaattctaaggtgaatcacctttccatactaacagcacagccaactttcccttcagagcagtgatataccaaaataagaatgatagccttgtgcagtagtcattacggaccccactacatgactaagctcaaattagtgaccttccacagcctggatgaagtttcacaaagggtagctggagttcacatgcagtctaggaacaccaagctatgtctaagcgcctcaaagagcagcacaactccactagggaaaaatctcattttgcccaaacattgtagaccctgtaataaatatactcttcatttgtcatccttatttagaaattaacatatgatcattttcctaagtctttcctaggatctccttacaatgcttttcatttgaaataatctattttcaaatccaaggaagtttctacaattacaattatacataatccagcactgcctaggaccagacaaagacaatacaccaatttccagttaccttcgtcagcaaacagtctgcccataattttgtcaggaattgaagagcattctcccattccatctgctcagcaaactttcatcttccgcaagggctcttttaatgtacttctaaagctgcttctgttgcaagtacaaactgctacacactgactccgcagtgacattctcccagaatgccactggatccctcaggggctcagggatacgaacttgaaagaagttgaaggaggacgtccccctcttcccagcctcctctctcaacacagcttccctccaagagacctgcttcaaaagtccagacccaatgaagtcactcatgacctcacaaacctctagtttaactctttaagagccagatggcaagctgacagcagtcagaaaaggcaactgtctaagcttatttggagtggttgccgtttaagggaaaggagacatttgtccagcatcgttcaaaacaaagtaactttgccactgatttggtttaatagcactaaagttttttgaacaactattttatagactgcaatttcctacagcacacacagcctggtcctaaagaaatgactgaaatagacaacaaaatagatttaagtcattaatattatacacaatttagctctgttaaattcacacttgactgaaatagacaacaaaatagatttaagtcattaatattatacacaatttagctctattaaattcacacttaatctcatgtaatttgtgattttctattttcatttctagttttgttttttctgctcgtggatgtgaaaatatttattgtcctgttggttgtccaaagcctgcttcagacacgtaagtggccaggcaacacacacagctgtcagacacaggcaacaactgccacagaggcatccgagaaaccagggacagcaggagttgagatccactggaagccgtggccgccagacctaaccaatggatgccagagtgtgtgtcagccctaacagggataggagaccagcctcacttcagtttcttttccatgcttttcctggggatcctgctatttttgttgggatacggggattatgaggacctggagatttaaaagactaaaaattactttctaaacagaagtggataaaaattatacactcgaagaacatgtaatatgccctttcaagaatgttctggtttaccagaaaatgattatacttaccatgcagtaattttattcctaaatatatacccagactagagaagttcttccatgtgttcccaaaaagccacatgaaggttctgtgcacatcgccatgctgtttgacataatatgacagtcaaaatgcccataaatagaaaaatgaaaaaaataggttatagtatgttcacataatgaatactatacagcaattaaactgatcaaactagggctgagtcaataagaatgaatttcaaatactgaggaaaaaagggtaaagacagaaagggacaatctagaaatacaggtatgtcctcaaaaagcagccaccactgccaggcaaaggcaacctgcatgtatgaaagaactcagacacaatggccagtttcacaaaaggaaacaagatagcttgtatatgaagctgaaaagtgtgtgaaacactgtctaatgattacagatgcacatctctaaaggaatgataaacatcagcagctcatggttacttcactacgtagggaaggaaagagaggaatgagatctgggggcataaagaggagaggagtttgcaattcatctgaaatacttttatttcctaagtgggatgatgagatcacaggtgtttattattgtctacactttttggtatgcctcaaatgttacagaagctttagaaagccaactgcataatgactacaacctctttgagtgcagcaacacctgttcagtctggacaattaacagaacagggggcaaagaggttaacaattcccttcactctcaagtccccaaatccaagcagctgctgctccttctgccatagttcagctccttctctctggcatgtcaccctgctccacgccacccacaaccctttacacatagccaactcagccttcacagcccacctcaaaatgcagcacccccacaaggacctccgtgacatcccacgatgcaagtaacccccaactcagaaccatgaagcctggctctctgggctctgcactagagttatttctgaagttatctgatctgcctgtttgggagacaccttagtatctactatagagcagctgctcattaagttcttcattcaacaaaaactgagtgcccagtatgtgctggccactatgccaggggttctctgagtcccaaaacgtagaacttgagaagaccacggcctaacagaagagacaggcctgtagcgaagtataacactattaatactacgtgctgaatcctcaaatagttgctaagtgaatgccaactacgaataatgaaattttaggattgcttcgcaatagtaactattcaatacatcttattttctctatactaaagactttataatattactcttgacaagaaaatgtcaccttgtttgcgttgaggtggggcttctaaatagagtaattataaagacaataaaagaaactatcattaaacctcctcagagtcaaggaattgaaggctcttagaattattattacagaaaaacaacatctcaagtcaattcgattttaccacagtccattcatactgggtgactttgaagaggttttaaagacatttcaagcatttcaagcactgttattactgataatagccaacatttattgagtactcattaagtgccagtaaatgattactgattatgtgccagtaaatgacttagacagagaattgactaaaatttgaaccaaagcactccgacttaagaacccacactcttcgccaccaaccatacgtttcctaagcaggaaaatcaatcaatccctgctgatatagtttggagggactccctatcaccaccacacctaagacaacagaagaaatcatttccaggttcacagccaggagcactcactttcccaaacctctgttaggagaatcctcccctccaaaagcggagttacctttaacaggcccacatccccctgagaacggggactggctcaactttgtattctgcctctaagcaacttgcagtaaacgcctctcaaaagcagcttccagtaaacgcttcccaaacttcaacgtgatcatggatcacctgggaatgtgttaaaatgcaaattttgctcgagcaggtccagggtggtatctgagagacacatttctaaccaggtccaggtgatgtctgttagtctgaggcccacacctgggagtagcaaggtgttgagaacctaggctgcgcatcagaatcaccggggaagcttttaaagctatccatgtccaggtgccactctaacaaatagaatctctgacggtgaaggctggagatgagaagcttacagagctccctgtatgattctaatgagcaatcaagtttgagaactactgtgctacagctttactactcaagctttgctccatggaccaccgttgtagaccagtgctttgcaaacttccacgtgaatgtaaaccacttggacctcttggtaaaatgcagattctaatgtagtaggtcagggtggggctgaggattctgcaattctaataagctcccaagtgaatgctgttgggtggcaagatggtgagtaaaaacatcagaaaatctcaggagttcagtgtgtgtgatttttaaggctttccttttgtaattttagattcagagaccagtagaatacctgcaaatagagcgtcaggcacaggcataagaaacagcatatgaggtatggggattacaaaatggaagcatttatctaacattagacaggacagagattaatattaatcctcattagcattcatgagaaacttatttaccttcccttgcaccatgaccactgtctgtctcaagtactaaaaatgaaggctctgctaacagcttgagccaattcaatagacagacataccttggatatattgctggttcaattccagaatgctgcaataaagcaaatatcacaatagagcaagtgatacaaatttctggattttctggtgcctataagagttaggtttacgctgtagtttctcagtgtgcaacggtattttgtctaaaaacaacagtgtacatactttcctttaaaaacaaactttattgctaaaaaatgctaatgatcatctgagtactcagcaagtcctaatctttttgctgatggaaggacttgcctcaatgttgatggctgctgactgatcagggtggtggttgcagaaggttgcggtggctgtggcaacttctgaaaataagacaaaaatgaagtttgctgcatcaatggactcttcttttcacaaaatatttctctgtagcctgtgaggctgcttgatcatcttttacccaccacaaaacttttttttttcaaagttaaagtcaatcctctcaaaccttgccactgctttattaagtttatgaaatattccaaatcctttgtagtcatctcaatgaggttcacagcattttcatcagcagtagacttcatttcaagaaaccgctttctttattcacccataagaagcaactcctcatttattaaagttttatcatgacactgtagcaattcagtcacatcttaaggctccacttctcgttcgcctgctatttccaccacatctgcagttatttaatctactggaagtttcaaaccactcagccactcatgaaggttggaattaacatcttccaaattcctgttcatgttgatatcttgacctcctcctcccacaaatcataaatgttcttaatggcatctagaatggtgaatcctttccagaaggttttcaactgactttgcccagatccatcagaggaatcactatctatagtgactacagctttacacaatatattccttccaaaaaagctcaaagtcaaaattactcctcgatccatggtttgcagaatggatattgtgttggcgggcattagaactacatcagtcttcttgtacatctccatcagagctcccgggtgaccaggcgtcttgtcaatgagtagcagtagtattttcaaagaaatcctttttttttttttttttgcctctaagcagtaggtcttaatagtgggcttaaaatagtcagtaaatcatgctgtcagcagatgtgctgttatctagcctttgtagttccattcctagagcacaggcagagtagatttaaggataattctgaagggccgtaggattttgagaagggaaaatgagcactaacttcaatttagtgtcactagctgcattagctcctaccaagggtcagcttgtcctttcaagctttaagaaaaggcgatgcctcgtactctctagctaagaaagtcctagacagcatctttttccaatagatggctatttggtttacagtgaaaatgtgttgtttagtgtagctagctttatcaattatcccagctagatcttctggataactcactgcagcttctacatcagcacttgctgcttcgtctagtacttttatgttacggagatagcttcttttcttaaacctcataaaccaccctcggctagcttccagctttttggctgcagctccctcacctgtctcagctttcagagaattgaagagagttagagccttgctctggcttcggcttaaggaaacgttgtggctgatttgatcttctatccagaccattaaaactttctctatatcagaaataaggtgttttccttattattcatgtgttctatgaagtagcacttttaatttccttcaagaacttttcattgcattcacaacttggctgtttggtgcaagaggtctagccttcagcgtattctggctttcaacatgcctttctcaccaagtttaatcctttctagaattttatttaaagtgagagacatgagattcttcctttcatttgaacatttagaggcattgcagggttattaactggcataatctcaatattgtgtgtctcaggcaatagggaggcccgagaagagggagagagagggggaacagctggtttcatggagcaatcggaacacacaaaacttattgataaggtttgccacgttatatgggcatggtttatggggccccaaaacaatgacaatagtaacatcaaagatctgggaccacaggtcaccataacagatataacagtaatgaaaaagtctgaaatattgagataatgactaaaatgtgacacagagacaaaaagtgagcacctgttattggaaacatggcaccaacagacttgtttgaggcagggttaccacaaatctgtaatttgaataaaaaaaaaaaacagagtatcttcaaagagcaataaagctaagtgcaataaaatgaggtttgcctgtagctctgtatttcagtttacagagggcttatgaagtgaaaaacaagattaaagtactgtaaacaagacccttttgagttcaggcaaatttgtattcctgtgtaaaacaccttcagagaacaatttactcaagaaagttggtgtcttttttcctccccaaaacaaggctcaatggataacatccaatgttgcaaatatggtgctaagagacctctgctaagatgaatatcacttcctttaaaagttaaatattgtactgatatatgaataaaaatattgctgtatcatctcgatcaattaaagtattaaccaccattccatttttatttagatctatgattctccttgtaatcacttatacctccaatgtctgttatcatttgatgccattctttgatcaaagctcatccaagtaacaggcgccgcaccatgctcttcacaccagtagccaccaatatccagggaattactttggtttgtttgttttaaggtttaaaccacagaattagaatgtctccaggaatagctatttgaaatccaggaccatttcctgaagtcatcactaatttataaaagaggcaccaaacagacagggagggcacaagaccaccagggcaagggctgtctgaagggcactgaaagaacaaccaatgaccagtgcacttagcttccatcctgggctccctgacaatcgacccactgctggagaagggacaacacacagaagagcttccaggaaactgaccttacagggcacattttctacagagatggcattagaaggacacataagcaaaacccaagtgctcctgtgtgagcccctcctcacagtcccatcctcagcccactcctcacccttgagagccctctcataaccacagctgcaagtcttacatctaaaagggtgactccaaagtctctccagtgaccttcagtcccatattcccaccagcacttcacaagtaaccctctctctcctccaatttgacctctttatatctgatcacactaggtgtcctcctaccaacctgctgcttcccccaactccagtgcagggtttcttgctccagccagtcacccatgcttgaactctcacaatcattttgactcagccccatgtgtcctagagtcaaacattcatcaaatccttgcatctttctttttaccaggctatttcttatctattttcttattattccttagactcttagactactacaacacccatgataggtttaaaataaatatccacaaattagaacttagcaaagtcttaccacaaaactgcacattggttgataaggctatttccatcttaccaataagcaatcagaagttccacgaatgaaaagacctccccgagaacaagctgccagaaaagaggatggcttcacctcttctcttcagtctcaaccctccaggtttattccacctaccacagtgcactgtgcttcatagacagaaagtgatttctaaggaagccccgtagtaagggtccgatgcaggacttctgtccatggccgagtggcagaataacttttctttgggttactactgtcattggtattcatttgtatttaatgagctcctactgggtaccggacattgttaggccacttgactttcttttcttgatttttgttccatctgattaatctcgtttcctcctccttcctcctttacgagataggtattattcatttcattttacgcttgcagagggtcccagattttatgtatttattcaaaaatacgcacctagaaagtgaaacaattcgaaaccaggaataaatggctctgagacctagaagagcccctaacccacatcactgagcaggaactcctttgtggtttttaaaaaaaaaaaatcaaatcaccattacactactttggaaagaagccagaaagagaaaaatgagaacctcttttttgactgaacaaatttaaaatgtaaaagaaaaggattaaagagattactggagcaacagcaacaggctcatgaagccacaaggcagcagaccttcccagcaccaatggcagaaaagaagcccggagctccgtgggcagccagatctctccaatttcacaacatgaaaatgttgttctctgtcaccagcttcactaatgtcacattattttaaattattcttttaatatttatatattatattaaagtgacttcaagtttaaactgggatgttgaaacagtttttcaaatcgcacttcaacaaatttctacttcttatttcacatgaattcttcctaagcggacaaacaatacagatagagaaaaactgaggaagaaagagaataatttccaaacactgcattccatttgagaaggaggagaaagaaataagagcaaggcaaaaaaaaaaaaaaaaatccccacaaatatcaaattcagagtgggctgaagacagactgaagcgcttccctcaggcagatcagctgcacgcagatgtaattcacctgttctgccatacccgttagtatcccgagcaagatctgaaaggaaaacttggaagcttagatataaaatagatcatcacgctacaaaggttatttcaaaaagcagcttcatatattccaaagaaccaaaaaagaagttcctgccatgtcacggtatttgctatttctttttctcctgtccaaacccaagttcaatggaaatggacaatatccagctaatggtcacagtgacaacacttgtgccttaagaacttactgattgaagttgtggtcatctgctgataagccggcgagcgagaagcactcagacacaaaggaacccattgaaacgtgtataattgtaagtctctaattatcctttctaattttggagccatgtgacaggacttcacacagcaccgctgacccccggtcagcctgagggccatgtagctgggctacatggggaggggatgctcctctttgcttcttcattgatatattgtgttccatgcagaggctgagctgtttccggctgacatgtggctcactcatcaacaggcaggcagagcaagcacctgggagaatgcattaggctggtgcaaaagtaattgcagtattgccattgaaagtaatgacaaaaaacttaattatgtttgtgacaatctaatagtccatccagatttattccaggattttaagaggcttttcaccttacacagagtgagccgcttgatgtcacaaaggtatttaatacttttaaagacaaatagacacgcactcaaaaaaaaaactgtctttcccaactgcatactagaatattatagatttggaatattttcttctttgacttgagtagagagagtaacagggaagaacagtgtccctctggccgccaaaggatggctgagcccaagactggaaggcattcctgagagaaggaactaagtgctacaacaccacaatcagccttcccaacctcttgcacctttctttaaaagagcaattcagccgagaacagtgtcatcctgtgctcaaaaaaaaaatcactgtccaataccgccactgaaataatctttaatgacaaagtaaagacagatcttgaaacagaaaaggatttaagtaaatctaggcaatagcaaagcaaatacatttttgttttgttgaagatatctggtcttgttctagatctaccatgaaatcattaccacttggtccagttcagcatagctcagtaagagcacgggctctggaggctgactgcctgtgttcgagggctgagtatgccacttaccatctgtgtgacctttagcaagttactcaacctctctgtacctcagtttccttattcggaaaattagaacactaatagttcctttcttccccctatagctcattatgagaacgaagcatcatgtgtttactaaataaatcaaacctatgggccacatatgacacacaattatgttcagagactagctaaagtaataatattttttacaagctagcgactaacactttatacattaaaatcaatatttaatttccttggttcatgtctaccaaatatcaaggaggcgcgatcaggggagaattcattagtcttattccttttcttttaagccttcctcagagctcactttatgcaatgtactcagacccccaccactagcaaggaagcaggagaggcgagtgaacacagatggaatggaggcatggccactgcttttatttatgacttttcttttgtaaatatattaatacaatgggaaattttttttcctttaattctaacacttgggccctcagtgcttggctgaaggacaggcttaatacctcaatgtccacttccttgcctcggcagagggatgttttaacgcagatgaaattttaaaaggccagctcactgattgctttaaaaatgtgtggaaacgtgtgtattattgacctggtaaattttccttcaaattgaatgcatacaccaccaccgacaacaacaacaagcagctctacatttagaacttagtttcttgaaaacagaccatctcagacttccggctttatcaacacatggcatgagagaaatccgatcaaaagaagaataacaaaataaaagacccaacacctagcacagtgaatgaatccggcctaggagccagacaacttgaattctactacggtatctgtcacaagacagccacgtggctttgggtaagatatcccaccaaactggaatacagattctatgttatatatatatatatatatatatatatatatatatatatatatatatatatatatatatatatttttttttttttttttttttttaaaggctatctgaggccccttcaagtagtaaaatgttctcattctctaacccacaatagtaacacaattcttctttggttacaacttctccaaatcagcaaggaaggtagaagggagtaaagaaaaatatgggtttttcagtttccttaaaatttcttaggatcattaaacctgccctaccttttaaccttgaatagagacatacatcacaaaataaagcttcctccacctgtaaccacttattatcatatgccaacctcaaataacacaaaatgggggagtcctgccaagcttgtctgtccaagccactggcagtgctcagcacatggtaggatgaccaccaatcaggaattgtacagtaggagtgcccagactcggggagaggcaagctggcgcgtctccaaggtgcttgtcactcaccactagaacgtggtcctttaccactagacaagatctcctggtttgacaatgcaggtgacacagctgaaactttatctcaacacggcctgaagaataccactgtctaaatatgagatgctaaaatactatgacctactctaatattctctcccaactctgtccatcctcgtgactggcacccatgctggcccaaatgatgacaacctcctgttctaagtgcacaagccgcacatttaataaacctttcacccagttccttcactggtgttcatctctcggcttcacttacaaccactccctgtggcttttgcagtgaagcctcttagcccaaaactcttccactccccaaaccatgtttggtctgtaatataaacaacttccactcaccctagaaaactgagtgggaatttcagtgcaattatctgcatacctttcctacagcgttttatcacaatttgcagtcctcagagacgaaggtgaaaggggaggactaaggtggcaccctccactgaggagcaccgcctcacggggacactgctttcaggaatgcctcctcgccagtactcttccactgagagacactctgatctcagagatacaagaagtctagatgtggactaaccaggcaaccagttcatatgcacacacttacccaggctctgctttgtaccatgtcctgtgcgaggtgctttagtctctattaaccctttaaatctcacagcctcacaacacactggatcattaaccccatttcgcaaataaataaatccagtttcagagaacgtaagtggcttgcccaagtacttcagaccaaagtcttgtggttttgacaccttgttctttttattctcactgtgacccagtaagacaaccaatatccacaatccatattcacaagaaaatgcatagctacaatgtcacaaggagccaatcctgaatttgctcatctaatgaactataaaccttcaaactggttatagaaaatgctcagcacagggcagactgctcaaaaagagaggtccattgaaaacctgtaatattaatactggctttttttttttttaacaaaaaacactggtattatttaatacagctttaaacagctttaaaatagttgatcaccatttaacacctcccaccagctccacacaaacatacatacatacacacacacacacacacacacatataccaaaacaaaattcataaaattgtcacaggtagataacctgaggatgacgagcatgaagaaatgaaacgctggataatccataaatagtcgcggaatccccaaataacaggcatggtggatacaatgtacataatttgtcattttatctcccagatagattaaaaatcctaaagtagagagagaaaataaatacggagcctagaccaagatatcagctctctcaagcatctgtctaatcggatccttccttcaacacgtcaggaacaggaagacagaacaggaactctcagagcaaagggctggaagagactttgctgactgtatagtccaccactttaatttccaatgaaggaatctctgagctaatcaaacaatcttcttgaagtcttcaaccaccctcagtgccagactaaagctacgatctctcagtgttcgtttcacagcaccacgtctctgccatcatcggagctgataacctcactcatcatccccaaatatttgtttggtatccaatttatatatagtcatccaggaaatcccacagactaaaatgatcacagtgtgccaatgtgacaaaccactaaggtgtgtctttcctgccctaaaactcaaattactttttactcacatcatttgcttatgtccacagaaattggccaaatgatttaaatatatattccacactcagatttcccagaaaagaaatcctacaaaaaccaccagcatgaaatgaatgagaatgggacgagtaccttccccagaaagcaatctccggggtgcctttcgtgtagatggagtcgctggcatcattcagcccattggtgacgccactagaatagcccatcacgatgccaccatctgcagacacactcaggatatcctgatgtcctccccctgatgtcctctccaagaactgaccaccttctttaatgcgctgttgtatcattggagtgaggggcatttcaaagctaaaatagctatcaggctctgagtataatgtctccagggactctgcactgtagtataaagaagtgttgtccaaaatggtttcaaactgggagctgtacacgtcggtggagtcctccgtatatccaggcccaaggatgtcttcatcttcccccttaacgtgctcctcttgttcgctgatcctggaaagtaaataagagtgaagaattccaatattaggttaatgtctttatttctcccacttcaaccatataaaaaggacaacattctgaagatctaactcttctattcattgacttatatcttaacatatttgggaaggaagctatgaaatataatcaggttgaaaaattcttggcatgcatgtggctaggacactataaatactttaataaagtttcaaactagtttcctaatgtgtgaatacatctggtccaatgaagatatgaataaaatattcaattctcattttagccaaatataccgtacacattcagattatttgcaactaccagcattcctaattataacagaagcagataaatatatcatggaaacttgatacggcaaaatttcagtaaaaatacaccaaactttcatcagttgattaatactttctgatttaaataaggccaaatgctctcaagcagatgactgcatcagaagccaagagctgccccctgctgacaacagagcagcactgcagagagatttcacgtccaaaattagatagccaattaacggcctaacaaaaaggcaacagaagcaaggctaaccaaagctttgagagattagaaacagctcaaaagtcaacatacagggtagggcattcactttggcacacaaacgtgaacaattaatatgcagcatgttctacaaatattaaaaacgaacattaggataactaagtaaaattaaaaacttgggagatagatcactactaagagcaagaggtcaagagttagaaaaaccagaagctgaattttggctgtctcaattactagctatatcacttgaagcaactttacttaacctctctgagcctcagattcctacaaataggaataacatagaattaggaattatctattaagcatctcataagtcatccacattcccaggtattactggaatccacattcagcattgcaattggtttgttgtttttaaatactgaaggtcacccatgggaccaaatgcttgttcttaatggctttccactgcacttggcataaactggaccgttcctaagatgatgctcctccctacctctccacactcactgcaccccactctcccctgctttttttttttttttttgagatgcagtctaactctatcacctaggctggggtgcattggtgcaatctcggctcactgcagcctccgcctcccaggttcaagtgactctcctgcctcagactctcaagcagctgggattacaggcatgtaacacaacgcctggctaattttgtatttttattggagatggagttagccaggctggtctcaaactcctgacctcgggtgatctgcctgcctcggcctcccaaagtgctgggattacaggtgtgagccaccatgccaagcctcccctgctcttcaggcattagccacacagggagagtttcaaatcttcaagcctggcacaggccttggcttcacacatctgcaggaagcacacactagtcagggagctcagcagcctcctgtgcacatgctgttccctctagctggaacattcttcctaccccttctctggctggcaaactctttccttcctcacgtctcagtgtaatttccatttccacagaaaagctttgtccaagccatcaactaaactggcctcttccctccatccaaattattcattcttgtaggtctctgttctttccttcacagaacctagcacactttgtgatcctatacctattagcatgtttatgtgatcaatgtttatcttcagtggtaaattccatgaggacagtatccgtgagccacatctattttgaccattcctttacgcccagcatcttgcagtgtcaggacataggagacaattgaaaatatttgtgggaagaaaagaggaatgaattattaatctgaacaacagtaaaagtgcatattccagtgggaatataaacactgggccacatgccacatatcaaggccgctttggagggaagtctggagagctgatgggttggggaggggagtgggaaggatcctgccagtgatcccaaaggagcaccactctcagtgggttttttaactgcagaggaaaaggcatttccttacaccgaacaaaaaaacaaaaaacaaccctcggccttgacacagatgctctcccgtataaactataaaatgtggtgtcatgagggctgacagaagaaaagatggtaccaattagaagtacagtacacaacaaatgactacgatcaaagggagtgcagaaagatgggtcacgtctgccatttatccagggtctaagctggtgtagatgtcagaaatgcagggaaagaccaggaaataccacatgatgtcaagtttcaatcataaaggccataaatctcataagtaggagttaaacaatgagaacatatgggcacagggaggggaatatcacccaccgggccctgtcggggtgttgggggctaagggagggatggcattaggagaaatacctaatgtagatgacgggttgatgggtgcagcaaaccaccatggcacatgtatacttatgtaacaaacctgcacgttctgcacatgtaccccagaacctaaagtataatttacaaaaaaaaaaaaggccataaatcaaaatatatgctacttgtgagaagaagaaattcccatgtgaataccagggaacaactgaattataaaatctacttctgaccccctgagatgtcatttcaaaacataggaagggcccggcacagtggctcacacctgtaatcccaccacttagggaggccaaggtgggaggatcacttgatgcgaggagtttgaaacagcctgggcaacaaagtgggaccccatctctacaaagagtacaaaagttggccaggtgtggtggtgcacacctgtagtcccagctactcagagggctgaggtgggaggatctcttgagcctggaaggtcaaggccgcagtgagccgtgatcacaccaccatactccggcccgggggacagaacaagaccctgtctctgtataaataaataaacaaacaaacataggaaattgagtgggccaagaacctctgtgttcatacatgtatgtcggctggactgaaggcattggtgttatacccagaagaaatgccaaggttggaagtaccagctatatagggtgtgtcaaaagagtccaaaccttttcatattactaaagatgactgtggggtatgttagttaccttgacgttgggaaacttgaaatctgtcaaatgttaagaaaatgtcagaaaagaattcacagtttagtgttcacagtctcttcagaactctgtttccctggtccatgcctaacggatgactttataacaagatcactttaatatctgagaagcttaggaggaatcttagcttagaaggacctagctcacagtaactcatcttatattccatgataacaagaacccaaggtattgtgattgagttctcatatcaagtacaggataacagttttctatgatatgtaccaggcatctgagacagcagggctactatgggagctcacctttccctgtctctctctggtttaggtgtcttctcaagatgctgtttgttttcctgtaggaagacttcatcctctccactctcatcaagacgcacaggggaaaatgtccccgagctagtgccaggcctctctgaaggagctttccaggattcatcccaaacattctcagttaaactacttgaattacacaaaccagctgatgagatgagatggcgtggcactttggaagactctttgctgtcaggagaggctgttctttgcagtgatgtctcaaaatctataggatgctgggtctctctcttgtctcctcctgtccacagtatttccactccttgaaattccacatgtttgacccggcctgggcgtcccatggagctgcttcgatcacatccccctgggtgctctctcccaagagcagacctctgctctttcaagaaaccaacactgcctgcagagtggcaggtcactgctgagctcccgagggaggccaaaggacaagatggctcctgcacacagacagcccctttcctcccattattcattatctgggaaatctctgcctgagtgtctccagttaacagcgcggtgagatctttctggatgctcaaataaaaactttcctccgttgttacttcagctgaaagaggtatttctggtaaatttttttggccagcagggagcgttttgttgactctctgtgttttacgactggcagtgtccagctctttttccacctgctgaactgaaaaactagaaacagcatcttggtccagtacctttgtagcctgtaatgttccggaaatgattctggcttctgtggctttcagagctgaaatcaaagagtcaatgggctgtaaactttgttccttgagatgactttgagagggggcctctctgacatcttttggtccttctgtaacactgtcgagcccagagtggcagccagtaagaggctggacaccctgctgctcttgtgggtggcatggcagagcctcaccatcaaattccagagaagcccttaggccttctccaccttcctccatggtcccatattctggaaattcatttgtgacatttggtgggagtaaagtgcttcctccatgatcacctgtgaagagaacacaatggacatatgacttgttgtagaaagacagggcccagtaggtaataatgcatattcacacagattaggcactcaataatacttattaacttgattattgcattatatcagtcctcccaccaccctgtaacacacactcctcatgacactacagtgatcccttctactcagcctacgcgagtataaccacaaaactttcggcctagaaggcaatctaatgacacctgccatatttaactttgcttctgatgtcccatacatgaggattcagaacctcagttgcttcatatgcaaaaaggggttacaataaggatatgtaccaacttccaaataccactcatgaaacagcaactaaaatgtgtatattgggcttaacactaaagagccctatgatctagccaacagtatctgtgcagtgcaagctccgagacagagcctctgcaaaatgcttatgatctatttaaactcagtcaatatgttttttctgccagaagtctccccttcattgttgggtttctgtggagggaaaaaatgctttcaaaacatccctgaaaaataagaatgaagccaacatggaatgagaaacttagtgtgttgagaaagacttccaggaacccaactacggaaaattcatttttctcattttattcatttattttcccaattgacaaaagtttgtttatatatctagatatatgtttacatatataaagtttatatatatatagtatacaacataatgtttaatatatgcgtacctttgtagactagctaaatcaagctaattaacaacataccagtactgtacctcaaatttttggtgtgtagtgaaaacatttaaaatctacttactcttctagcaattttcaagtatacaatacattgttattaactatagtcaccatgttctacaacagacctcctgaatttattcctcctacctatctgcaattttgtatcctttgaccagcacctccccaatcccaccacccaccagtccctggtaaccatcattctagtttctgcttccaagagctcaacattttagattctacatattagtaagatcactacctgcataaaattgtaatggcatcttacgaagaaccccaatacacgaagtaaacagtattagtatatattcactatattgaaccaaatttataatattttcttgttaaaatgatagccagtgagaactgaaaatggggacattctgacaaaccaaaactttcaattgggggtttacagatagcagctgtagtcctatcagccctagtatccagtcttcttctgaacttagttttggttactttgtatcatgaaaaccctcatctatgctggaaatacagtgtactcacttttactttatgaaagaggacattagttgttaccatttttattttattttattttattttatttatttattgagatggagtctcactctgtttccaggctggagtgtagtggtacgatctcggttcactgcaacctctacctcccgggttcaagtgattcttctgccccagtctccagagtagctgggactacaggtgcgtgccaccatgcccagctaatttttgttttttgttttaagtagagacggggtttcatcatgttggccaggatggtctcgatgtcttgacctcgtgatccacctgcctcggcctcccaaaatgctgggattacagtcatgagccatcgcacctggccattgttaccatttttaaactactgcagagctacaaccttcctatttagtgaaatattttataaatgtctgtgtatatatatacactgaaatggctgaaaagacttgattctgcctgtaatcccagctacttgggaggctgaggcacgagaatcatttgaacctgggaggcagaggttgcagtgagccgagattgcaccattgtagtccagcctgggtgacagagcaagactccatctcaaaaaaaaaaaaaaaaaaaaaaatttgatttccaaggtaacttggaaacatcagttatcctaataactgataattattaattactgatacaattactaataataggtgtattgctattgaacacacggtatcccccagtgtgttaaatagcaatacctctgagagtacatgctgtttcatattccatgttgtaaaataatttgaaatatatacacttttttctcttttttaaagacaggatcttactctatcatccagactggagtgtgggagtgcgaacatagctcaccgcagcctcgaactcctcggctcaagtgatcctctcactccagcctctcgggtagctgggaccacaacaggcatgcaccatcatgtccagctaacgtttttactttttgtagagatggggtctcactgtgttgcccaggctggtttcaaactcctggcctcaaatgatcctctcgccttgaccttgggattacacacatgagccaccatgcctggcctgaaatatattcttaaaattaaatctgaatcaagtgttgatggaatctaacaagcacttctctgggatagtatttataacaccttctacaagacagaactaataaaatgtagcttgcttacatctgaagaggaagtgacttttcaaacaatgaattgaaaaagatgatagctaaaaacaataaagagccttcttcctagggtggaatattgatattttatgtctttcagtaaagaaggcagtaggtcttttcatggttccaccttttaagattcaggcatttttagtatattcacaaaactgtacaactatcaccactatctaattctagaactttttttttttttgagatggagtcttgctccgtcacccaggctggagtgcagtggcgcgatctcggctcactgcaagctccgcctcctggatacacgccattctcctgcctcagcctcccgaggagctgggatacaggtgcccatcaccatgcctggctaattttttgtatttttttagtagagacggggtttcacagtgttagccaggatggtctcgatctcctgaccttgtgatccgcccgcctaggcctcccaaagtgctgggattacaggcgtgagccatggcgcctggccattccagaacatttttatcactcccaaaaagaaaccctgtatccataagcagccaatccccatttcagcttttctcagcccctggtaactaccaatatactttctatctctatgaaatggtctatcctggacacttcatataaatgcaatcatacaatatatggcatttggggtctgacttctttcacctggcacaaggttgtcaggtgtactcatgtcatatcatctatcaaaacttcattccttttattttattattttttacatgtaaagagagacagggtctctctatggttcccaggctggtctcaaactcctgatctcaagcaaacctcccagttcagcctcccaagtagctggactacaggtatgcgccactgagcctggctgagaacttcattctttattattgccaaataatgtttcatcatacgggagcagtcttttctttggccattcatcagttgatgagatattggagttgtttcaacttgttggctgctatgaataaaaaatgtgtatataagtttcagggtctaaatacattttttcttttcttcctttttttgagacagggtctcactctgtcacccaggctggagtgcagtgggacgatcatggctcactgcagccctgacctcctgggctcaagccattctcccacctcagcctcctgagtagctgggactataggcacaggcatgcaccaccatgcccagctaatttttctttttttttcttttggcagagatggggttccaccatgttgcccaggctagtcttgaactcctgggctcaaaggatacgcctgcctcggcctcctaaagcgctggcattacagacatgaaccaccgcatctggcctaaatatatttgttattctcttctatatatacctaggagtgaaatttctggatcatatagtaaacctatgtctaatattttaagaaactgctgaacagttttccaaagcaaatgcactatttacattcctacaagcaatgtctaagattctattattgtctgtttattgttacagacatcctagaagtggtatctcactgtgattctcatttgcatttccctaatgactaattatgttgagcaccttgtcatgtgttttttggccatttgtgcatcttttttagagacatgcccatttgatggctgaattatttgtctttttattactgagttctaagagttctttatatattctggacataagttctttattagatgtacactttgcaaatgttttctaccattctgtgagtggtcatttttcacttaattgacagtgtcttctgaagcacaaacgtttttacttttgctgaaatccaaattatccgtttttcctttggtctcttgtgctttttgtatcatatgtagcaaatcattgtctaaaccaacgtcacaaagattacttttacgttgtcttctaagagttttgcagtatttgctattacatttagctctctcatccactttcaattcattttcgtacatgatgtgaagtagaaatccaacttcattattttgtatgtggatatccagttgtcccagagctatctgttgaaaagactattctttacccatcaaaaagccttggtgcccatgtcaaaaatcaaacatatacatatattaatatatatgcaaaggtttatttctggactctcaagtccattgagctagatgcctatcttttttttttttttttctttttgacaggatctcactctgtcgccctggctggagtacggtggtgcaatcacagttcactgcagtgttgacctcctggactcaagcgatcctcccacctcagacttccgagtagctggggctatacgcatgcaccaccatgcctggacaatttttcattttttttaagagacagggtctcactacattgcccaggctggtcttgaactcctaggctcaagtgatccctcccgcctcagccttccagtgtcaggattacaggcatgtagcaccacacctggctagatgcctatctttatgccagaataacactgtcttcactattgtagctttgcagtaagtgaaatctggaagtgtgagtctcctccaaccttgttcttcctttttcaggttgttttggtcactcttggccccttgaatttcccattacttttagaatcaactcgtcagaaagctgtgattttgataggggctgcaatgaatctatacagtactggcttcttaacagtattactattacatctttcgttccatgaccatgggctgtcttttcacttacttaatcttctttaatttcttttagccatttttttttataattttaaatgtacagattttcaatttattcccctaagattctatttcttttgatattgcttttcaaatttctttagatcattcagtagccatgcatagaaattcaatttgttgctgtatgtgaatcttatatcctacaaccttgcttaacttggagcatataataacatatttgtagattcctcaggattctacataccagatcatgtcatctgtggataaaagctttacttcttcctttacaatcccaatccatctttctaatcaagtctctgtcaaccccctttcacatgttataccattgcctctacactgaagtaggaggcagcccatgaataccctgaaaagatttgttctaatcctaatacacactggaaataagcttaagcatacatacattctgaatgcatagacatacacacgctcctttgcctttgttcaacttcctttctctacctgacatactttttcttctcatttcaacataaatcagattattttcacatttcaacacctaaaccaaatcccctgtccttaattaagccttcccttgctcaccaactcttgaaaaaagtcctctcctctgtataaataaatgtcaaaaagacttttgcggtatggtatatatagtgtaaatatacaaaacaaataagcataatgttactcacgccttaaagcttccaaaggcaataatgtttaacccatcatgaagtgttttaagaaaattgaccatagtgactgctgaagctgtatttataaactgcaccaaaacatataacagtgaaatccattcaacaaagggaagaaaagttaaacttagacacttgggagcccgctttgctttaacagtttcaactgccctctggaaaaaacaaacaaacaaacacacacacacaaacacacacacacacacacacacacacacacacacacgcacacacaactgaacactggccccaagagaagtgaccaaaagatatcaaggggcctcagagaattctgataattccttcaccccatttttaatagttttcattgaaatgtccctcagaaaggggcagcaaattcaacaattgtgggcaagtgcttgtgatgtctgatataacaacttggcaaccggtcaaagaaaacgaggtcagataagagggagacagggcaaggcaaagccctgcgtgacagattgcttgctttactattaaatactggagtagtttctcgtggtctgtgtttactgttctaagaactggaacagacggggggagacaaatgttctgagaggcgaaaggacctgaccaaggtcaataaaatgatgttcaataaagtattgttttagaactctaagtcaggactaaatttctagtcttctgtctctcaggagtaaaagcctgggagaaactcagggacactgaaccgtgagagatcatcattcatcattgctttttttttcttttctgagatagggtctcactctgacacccagctggggtgcagtggcaccatcatagctcactgcagctcagcctcctccggtgcttaagtgatcctccagcctcagcctctggagtagctggaaccacaggcatgtgccatctcacccggctaatttttttatttttatttttttgtagagacggggtttccctatgttgcccagactggtctcgaactcctgggctcaagtgatcctcccacccttggcctcccaaagtgctgggattacggcgtgaactaacgcatttagccaagaccatcattgctaagagcagtaatgttaacaaatataatgaagaataaaaccagaagtgttctagttgtagcttctgggtagaaacagccttaattatcatgtccctaaggattcagcataacagcaagaatttcctttcaaataaggcaccctctgccacaccccatgagcagtttatttttgctgtttgcattggttatcacaacttgactgtgttgttaatcctgaccttttatttagaatttctgatttattccttctgtttaaaaattgggactatatgctaagataattatttttttaaaaaaagaccaaattattgttttaagattttttaagctgctcccttgtaaaatagggccttagatacttcctattaaatgcccattgtttccaaaattcattcacgcattcagcaaatattgattacctgctatgtactaaacacaggggattcaaaactgagtatttccagaacatgaaaagtctgtttggcatgttagaaagctcgccttggtggaatgtgaaggatgtgtagcagagagggcacaagcatagactcaggaataaccacgcaggcttctgacaatagtacaggtgagagacggtgagtgctagagccagaacaaaggcagaatagacaggaacaaagatgcaaggggtgctgcatctcccacgacactctacttggaccggcatccatgcccatcatctcctcatctcctctgccccaggcccctctagtttcaacatggcttcttccaactgctgtgagctcttacaccaaacttgaaacttgttaacactttccctttcagtctacatctattactaatgtaagaatccactgaaaacatttcccctccagcgagccttcctgaattagtcctacctgaatttggtcttgtatgtgtgacaaagggactcagggacttgttaaatataaaaaaagaactttagcacttacctaaatataaaccacacactagtagaatgtgaattaataaagagttcatactttactgcgtgtatttttccccttaaagaaatgaaaatgtagtgtagagtgtggaggagggaagagagaagagttttcacattcatgtgaaatacaggtactttttggaggtatctatttacagtccattagaagtcatacttttctatcagagactttatctgcggctttgtgtatctggttagattcctaacaaatcgtgtttcctgttgtttagcaaagatgcttttcctgcaatgacatataaacccactgattttttaaagaccttttttcttttgatttagtatattgagaaagaaatgagatacatttgaatgttaagatgaattttaggagtgctttgggttatatattaagtagtcatctgtttctggaacacagggacagagctgtaataaaatgaaatgaaatagaaagaaatttcttcaaattgtgagaaaataagcctgttccataagatcggctgcagaaaaaccagggtctttctaagaattatcctgtttgaggagcagtaaatcaaactggttttcttccactctggctagcaaactcctgaaaagacaatagttcaagaaaaacaaaatataagaactatttgccacatctaccgtagactcggtcactgtaagctgaaatttgaaccagataaaaccgttttcatgcgggattctcagcaacaggacatacgtttccccagactatatggcagtcacatctatgcctaggttcctcaggagagccacagttacggattctacacacatatattttctagaacctgggatcagtcatgccattttttagtaaaaggtttttgttttgtcttgtattgttttgttgccacaaaaatataaactctaaaaggcaagaactttatttgctttctttacaattatatctccagagcctataacaattttacctagcaaaatgggtatttttgttgaagcaatcaattatgaatgtcccagaaccaataggataccaattaatagaaggtgaaagccagatgaggtggctcacgcctgtaatcccaaccctttgggagcttgaggcaggaggttcacttgagctcaggagttcaagaccatcctgggcaaacagggagacccctcctctacaaaaaatttaaaaacttagccaggtgtggtggtgtgtgcctgtgctcccagctacttgggaggctgaggtgagaggactgcttgagcctgggaggttgaggctgcagtgaactgtgattgtgccactgccctctagccgggacaacacagcaagattctgtctcaacaaacaaacaaacaaacaaacaaaaaaccttaagacagaagcaaaaaagcagcctccttaaacataagcaaaacactatatgttagtgtcacccaagtcctacccgttgcttctaagtccaggcttgaaaaggattcaggaaacagtagggcgcttcctgatattagagccagttcattctctcatttactcagccaacatttcttgtggaccatgaatgcatcaagcagcagagaaaagggcaacaaacaagagcaacttggcctctgtcatcaaggagcttacaatccagcagctccatctatatatactgtctgctcgcaaacaaagttcaggcagtggtaaatttcagtggagataatctcagcctattctagaattcagcatgatcctacatgagctgataccattaagtataaatttctcaatggatttctctctaacactgtgttgtccaatttggtagccatatccacagaagcctatttacatttacatttaagttacttaaaatttaataaaattgaaattgtagttccttagtgctccataccatatatagctaatacctaccatactccactatacagatatatggatatatatatacatatatatagcttatgtagatatatatacacacacacacacacacgcacgcacacacacacagatatccatatatctgtatagtggagtatgtatgtctgtatagatacctgtatatttctgtatctgtctatacacagagaacatttccgtcatcacagaaagctctatttgaaagtgctgccctagagcctttctactcagtgtggtcttgagaaagcagcatagatatcaccaaggaggcttgttagaaattcagactctcaggcaccacctcagacattcccaatcagaatcctgttggtttctaacgagaatcccagaggatttgtatacacgttacaggatgagaaacacacctccagaaaactacaacaatatctacaagtcattctgattacatttaatgcctacttttttattttaaaagagatcataactgcctgcctcctaactcagaggtccaactgttcaatcaaatagacatcaactaaagtaagttccaagaaaacaatctcattactgcaaagagaaacacttgatcattctggtctgggtttaccctcaaattaccaagtaaccccggtccctttccaagagaggaagagaattgcctctgctgtaatatgaccccttcttgattttacagctcatagtaaatttctctcacaatgaatggccaatgactctctacttacacaaaaagatcctaaaataactgcaaatgtaaacttgaccattagtcaaaacctgtatattattatttgtacacagccttaaaaaaattactttggagcttaaagaaatgggctcagggaagggtaaggactttccaatttttaaaaaccagaatattttcccaaggtttttaatgttcatatctttggatgcgttgcttttaaaatagaaatgtacggggaaattcagtctgataagatactatggagaatgcactaagggtcttataatctatttcctatgactatagttcatcggattttcaatcctttataaattatggctaacccagccactaataatctgttttccctcctttctacatgtgatattcataaatgcaataacatctttggtgttctctgttccctaatgaataccagttagtaaacaccttaaaacatattaatattatgttagtacaagaaaactataaattagtaagctattttaacacttgaaaatttatagaagcaagcttaaaatcacattcccctcacttgtcagaaaggaattcagttccaaagacgagggcaggaaaaagagtgaccactctgatcccttagtgtgaaatttcataaatctgtaagattggaagataaatgcttaatttacaaaacaaatataaagagcaagccttgcagagttaaaaaaaaaatctcaaatgcatttcatttataagtaactataatccttaactgtaataattatcaacatttttacgtttaataatcaataaacttcaccagcaacacagtgatacatgactcaaatttgcaatgcaatagtaaaatttgtattaaaataaaacaagaggataatctaacccattttgcccagcaatagaaaataaatttggtatgataaaaataacggaaaaatgaatatgagtaatgagaattactaaatgagtaatctaaatacattatattttaagacactctcttcaccctaagaaaagtcacattttgaagaaaactacggtatgtaatccaggatgctggctattgcctggacactgataatgctaaaggcacagatatttaagttgtttatgtgttaggaaaaaaataaaaaaaaacaggaaaagacctgccaaccactacacaagcttctaacgtgtgcacacgaacagaaaatattccattaattggacactctttccccaagtgattaatagttacagctgtgcttacggcaaactaaatttcacatactaatgattcagaacccaatttttcttattcagctctaatccctagagaaatgatactagtttaccattcagtcaatttcagaggcagctctgtgagctaaggagtggcaccgcatacagcataccaaagggaagcttgagtgagacagggaacagcccattaattttaaaccgtagtctctgcaactgtgcagagcactgttacctgttacagagaagaaacactaagctgtaagagctgaatttgagctcatctttaaaattgccgtttttcaaagctggtttcctttttcaaccagtggggttctccactcttgtctgcctctctttgtcataacttctggttttttatatccacatcttgtgcttctcctttcagccttttaccttctgatcagggatgcccctctgatttcatccattctgtccactttctacgatcctttctgttggggaatccatacttttaaaaatccaattgtaaaatttctctctttactgactctttagttttaattttatttttaaaagacaaaaaaaagtttaaactaaacttttaaataaccccacagtctcgctcacagcaagctttcttctgctaaaattaacacatatatggtaagattaatataaactgtttcgtatatatgtaggaaatattgggacatttaagaatttgatgtttcaaaaaaccatacaattcttttaaaaaataatcatgaatgccaagcagctggagttcttcacagtgatgatcaactacagctgtggacttctttaaacttctgtctatgaagacagatgttaggtgcagtggtaaacacgccacctcactcagcctccagtgtgtagcagactcaggactcagctgatccacatttgcagccagtagttttcatgctcaataagagacccacagtttcactaaggattcaggctacaatctgacataaacaattgtcccaagtatatctagaaatgcaaattttgcagagagttgaaagtcagtttccatggtgagagagaaataaatcttgaattactataaaagcgacacttttaacaaacaggaaaaacacatccttgtgtgtaaactgagatacctgttacaaacttccagtaaagattctatctcagcctcaactagcgtgtttccagaacatttttggtgctacctttgagctaaccttgttcccttcaaggctattcagatactaagctgtacttcaggcacacagatggaaagcagtttgagctctttaagagaaactcctcccctattcccatccagcactacaacattatgtctttctaaaactggaggggtagcctgttttctctctttctgtctatataatatatcacaaacagggagcagacatagggtgacagaattgtgtgttcccaggaaagcttgtggggaaaaaaaaaagaaaagaagtaagattacaggtaagaataatattttgctttctatataaaaataaaaattttgaaaaactcaatgtcacatgctgaaatcaacattccaggtaaagccaggtgaggtgctgggcataggcattcagagggcagccggcatctctctgatgactgggaattaaagaatggttggcgcgggcatccccgaataaatgcaaaatgctctcctctatgtctggattcagcagaacctggtctagccccaggggtctcctactgggacgctcgaaagacaagactagtaagcaaaagcagtcaataatacagacggatactttcacagcagcatttaaaagaaatagatatataaaaatatatttgcctgcatagacctacaaatagaggttactcacagagattactgtagctccagcagttacccattgatcatagaaaatgcccagttcatcagtttaacgcttgagaaaagttagcttaaaaagaagcaagctaattcaaaatatgctgttctagtcaactggaagcaaattagtttcagatttcctggcagccccttttgccctgcactgcacacggtgatggaaatggaagcactttgagcacttggaacccgagccgagaggagctgctgcctcagtccctctcacaaaggcggaagcagcctgttctcccgtttgctctccctgtctgcctctgccgctctctaccttggtagcttaccgaaaacagccaccgtagggcgtttttatatttgtgaaaactacttccaaggagataattgagatgacgggagttagctttaatgtaaccatgtcccccagtgcagcagcaggaagcccagcaaaggcttggagaggattgtaccatcctgggtgacatcagaggtggggctgtcatcttagtattatgcagcattttctctgatgcaagaatgacacatgggaaagagatgggtaggttctctttaaaagggtttaattcttgtattattttaacggacaagggaaatgcaaacacattgtttaaaagctgccacagaatgacacaaatcctgctttgccagtccttatctcactgcttagtgatgctaccatttaaagtcattttagtgacgattgtatcttgttcctgtgattaaattaatatttaatgggtgattgctgttacttggaaatgtgacatgagaagactcaaaaccagtaacatccatttttaaatatgaagccataaacttttatatcacttacagtaccttgtatgtatacaatgtctttcaacacagtctcagtataaaagcaccaaatgtaaaaactaataggtttatacatgagaaaagtgaagtgaggtggaaagtagcagaagatgagtaagatattgtaatattattgatacttaatagtgataatggctattaatacaaatattaaaaataacatgaagattccaatcttctgtaaccctaatatttccaaccagtatgaggatgcatgggctgacaatacaaaccacttcacagttgcttttattcattccatatacatttactgagtgccaaacagggtgctgaaaaatgtgttcagtttaatttggagaacgtttctgataagtaataatataagcaggatagaaagtatttacttatgtgccaggcactatactaagcagttttattgtattaattcatctatttctaccagcagccctgtgggatggctactatgattaacccattttatagatgaaactactaaaactcaagagaggtgtgtgacttgtccaagatcacacggctaacgctggcacaaccacgattcaaacacaggcaatgtgcctctaaagtccaccctccctacccctaagctaaagtgcctccagggggattccttgccaagtaaaagaagtctaaagaaagaatataattttcaggattcagaaccatcgcaagccaaaaatatccacctctcaagaagcctggcccaaatataagaggatatagatgagagtgtgcacctagagacagcaccagggtagtggaaatacacccagaaacagaagctcagtgccgactaccggcatgaccttgggccaatgccttaaaactttccagctttagcttccttatctctgagctagagatgtttaaattacagatcagtataaccacgtggttaaagcaaacaatctcggctattaatctggattccgtcactttccaattatgttaccttgagcaagttatttaacctctgtgagcctcaatttccatctgaaaaaaaaaaacgggaataataatggggttttctgaggactaaatgaactgtacatagaaatacataaagcactcagagtagcaaccagtatagaataaaagctcaaggttttattactgatactataatcactatgacttttagtagaattacattttttataaaactacccacttcttcccttttcaaaatcctctcaaagaagagctattttttgagttggtttcaacagcagaaaggacaacctttgctggcttcatacaagcactaaccagtccgtgaatcaccaattccctatgagatgtaagctggatttgttgggcaagccttctaagaccgctccttccaaggggaggaaagagtggtaagcgcccttttgttctccctcttccttatgcctggaattcagaagatggagctggaagtgaagcagccctgaggaattgtgagcatcccataagctagcggggcaaagctgaaagcaccccttacccaccacagacctcccacccccacccaccatcttcacatgggggagaaatttacacgggtcaggttactgaattcaagttttccaaatgtctatagcatatcgcattaggctttagttaacacttactttgactaaccccctaaaacaccatttcaaaacgtaaagctcagaaataaattacttacatgttctctagtcttttacagcaccatctcttaaaaacatgcacaaaaacagcacctgcttagcagtgccatcttcaactcctcaattgttttgttttgtttgtattgattatattctcttattatctgtgttcttgatactcccgtatttggggccttgactgtggagagactgttcctccctgggctggctaattcctagagacagaaaacacccctgtgcgagcgtgcctgtgatatacaaaccaaccaatccagagccacagcaggtaatattcccccatcctaaatcacccaggcccaggtcctggacaactgggggccatccctatagcccaaagcctgccaaaattattcaaactagccaatcttaaacttacccagcttggctaccctgtcttgcccgttcccttctgaaaaaacaaacaaacaaacaaacaataaaggctctgggccatgctcccccatctcccatctccggctcccatcccaacctggtgtttccctgtgatcccgtgcaatgtactgagcctcctgtgtctaaggatctgtaagcataaacctctttcataacagtcatttccatgtctggatgtctccccatacctgaatttttaaaaaccccatgtacaaattttagaacaaaattttgggaggaacaaatgattactcactaattatcaggaacaaaatttcaaatgcacaatgtatttccagactcgaaagtcactagtgctttccaaagtttagtttggaaatgacaaactataggtaataaatttttatttgatataatgtgttatttctaaaaaatttcaaataaagtaatataaacaggcaagcaagctattattgcccaacctgatataagatttttagaaatacaactttttcacaaatcaagactgactgcatgatatcgagttttattatcataacatcctctgttttattgttacctttttttaaagcacgggatccacgtaggagacaataagattactggaggaactggtaacaataattccttatgtaaagtaacttttccttcattgaacaagttccagtaaacaagaaatcagttttcctagctcaatttaatactttttcagtctggttcttagatcttgaaaaaaaaattcaatgccaatttaaggcttataaaaattgagtttttgtattttagtctgttgtctccattaccaggtacatctaaatgttcaagcttaatctagagagaaaatcagaattccaagaagatattatgtgaaataaatccaagtgagccgagaggagagaggtgaaaagccaaaacctgtcaataatgatagtcacgccagagctctgtactctaatacgctgttttgaaaagaaaacaaaacctcaaaagtgaaatttaacttataaagggtatacatacgaccctcccggtaagctcgttgggaaacatacagtataaaaggtttgtatgctggaaacattacatgtaataaagaggtaattacaagtcacctgcaaacctctataattgtcctagagctacttcacagatgaacaaagtagctaagctcattgtcttgagttactgagtgtgatccctctcagcacagaagtgatgtgtgttccctgtgctgcaaactgcactgggggtaagggtgggggagggggaacaaagagaaaaggggtcgagtggcagaaagtcacaatgaacattttgagattcctgtcttccagggaccaagcaagatgcttttcacctctcaggcctcccctgtcactttctaagaaactctctaccagtttctgtgtcctaacccagcctgtgatagaaaggaaagatcaaaaaagagcaggaagcagatctcacagcaggtctctgtcagtccctgttaacccagagcttactatggataatgcttgctacatcacacacacccaattaattgtttcatttaatccttaaaaacctccctaccaggtagatatcaggtatacctaaatataaggcaactctaagtaactgttaggtactctataaattccaatggggcaaaaagttattggccatattgaatatttaaatttttaggatggatgaaataatcaaatggctccttataatattttattatgttaatttgcatatataaaatcacataatacattaaaacaataaataaatgcgttttcgttcgcttccacttcaggaaatgattttgttcaagattttcatgtgtaatttgtcataaggatctttgctacgactacagtctccttatcttgcatcttcagttctaagttatttgagatacagcaattttttaaatgtgtgatggaagttctatcctaacctacagtatccattcactagcagtgatctgaacatcacttactgcatgtatgacctagaaaagtcatctttaagaagctggtttatccaacatccaacacctgcacctccgagagcacttccccagaaagaattactaaatgtgtgttcaacttgttttctccctctttttaccctgttttagtgatctccataagcattccaaactgacattatctatagttatttcaagctcatatgttttctccaaagaattctttgttaatcaaaataatcaaaagaggatccctaatacagaacactttaagaacttaatgtaagaccactccctctcttctggtatctttttgagaaaaacatcctcaccctaactttgggatatattgagtattcattcctttttacaaaagaagaatatagagaaagtttaggcaacctgaagcatatagaggaagttaacccaacacacagttaaaagaataagaagcaaccctcagaccaaagtttacaaaaggggcatttagttggcagcccacatgtgaacataaagaagagccgaagagaacaaagtcactcttttacattatttgcactttttttctagcacagttggagaattttaatctttctttccctattgtttgctgtcacttacttacaatcacacacacacacacacaaactttattttctattaatataaaccatataaacttttttttttttttgagacagagtctcgctctgttgcccaggctggagtgcagtggtgctatcttggctcaatgcaagctctgcctcctgggttcatgccattctcctgcctcagcctcccgagtagctgggactacaggcgcccgccaccacacccagctaattttttgtatttttagtaaagacggagtttcaccatgttagccaggatggtctcgatctcctgacctcatgatctgcctgcctcagcctcccaaagtgctgggattacaggcgtgagccaccgcacctggccataaacatttttaatgaacacacgatgtatcatcagtaatacaatttagtcattgttgagtagtctgggtatttccagttatttccaatattatcctaattttcttttttttttttttttgagacagggcctcactctgtcatccaggctggagtgccgtggcgtcatcttggctcactgcaatctctgcctctcaggttcaagcgattctcacacctcagcctcccaagtagctgggattacaggcatataccaccacgtatggctaacttttgtatttttagtagagacgagttttcaccatgttggccaggctggtctcaaacttccggcctcaaataatccatccacttcagcctcccacagtgctgggattacagatgtgagcaaccgtgcccagcccctaagtaaattcttatactgacaactggataatatgattcagaatgtaatcaaaatattagtgcaactgatgcaaatgaaataaatgtccaagaagtcagtgatatgtatctgttttgtgcactattgtatccccatgtcactgagaaccccagaaagtaccagcatcaaattgcaaggtcaagatggcataaaacacggttgcatgtactgggcaagaagcactttgatggtgagctgagaaactgctttcgccatgtactgagcctgggatggaatcagaatcacagggtgcggggtcagcatgggagcaggaagcaaacagagggatgggcttaaggggctgacctgagggggtttatataatatacctccaaagaaaaagcaagagcaagttctgggagtaactgaatctccctaaaagtagaaaagtcactaagcatccaaatggcatctaagtgggcaacaggaaccagccagaagggctcgataaactgtacttatcgagttgatttccagctagcctttggttaaattaggtttgtaactctaagccgtttctttttatttattttttctttctttcagtataagattttcttcaaacagtctagtttcgtctcaagtatcaagtaaagtgaaatgtatcattccacctctctgtagggatgaatgagggtatcggtgggctagagggcagggaagcaggatcggaactccaggcccaggcccaggagcagagcacatccatgtgctagagggcagggaagcaggatcagaactccaggcccaggcccaggagcagagcacagtctggccaactaaaggaaaggcagggtaaaggatttcttttagaatccctctctctcactggctcacaggcaacatgctctcccagctgcggttctgccacggctgccattctgctccatttccttggcctgttgtacttctcccactcccctttagtgataggtgaaggcccagggattagtttttcacccgctgttcttcttatttcacattctctgcctttcaaaatgcaagagcttggaagcaatatctatcatccaatcaacacaccggtgcggtggcaaatgtaccctaagtcagtcaatatatataaattgcttaaaacagtgcccagcacataggaaatattcagtaagaattagctgttattactaccagtgctgggaaccagcctttgctacattaccatgtgatttgggccagtaattctgcctttcttttccagccttttgtactcactacaaagtacatttgtactcccaggcttttgtacaattaattttgaacctaattcaaacaatcactgtaggcaaacaagatgcttacttcacgggtttttgtaagattaaaatgacagaagtcacatgaagcggcacatgaaaacctcaaaatgactaaatataaggctctacatcaataattccatagctctatgatgataatttcaggtgtccagacctgacatctcccctaggcttcaggctacctcacagttccgttgtgtgagaaggaatcaccaaatagaaactattacacaggaaaagcaaaagatgtcagtaatttagtccattcagaagcaactatgtcaatcagccagaacagacatctgaggcaggagtctaaacttgaactgggtaacagaacaaggagagatgaaagcaagataactgtagatgagattgtattcttttaaccccaagaataaagaaaggcaaatacaaaagaaatcttaccaagcagaattaaccatctcaaagctacattcgcatctgtcttgacaatcggaactcccaccctatgataataacgtaatgagaaaaaaatacaaagtaaaccataaccaggagaagctcacacatggtctagttagctcactttgcgggaaggtctgaggagacatccggaagggacaagtatctcatgttttgaatgaaagggaaggatctgagttttgtatgaagtgttaaagctctcaagagagattttgggtactctgtcctgtgcatctctcacagacagtggtcaagtcattgccagtgacaggccatgctgttacatatctacattatctcagaaggccaccccaccctttgaaagacaccaacggaaaacaggaatcctgcactgaggacagagtctcactttcctgagatcctgtatgtgctcttggcaatcaaggaagcctgctctctgaactgtgtgccccctgcacctatcatcccctggaaagttgggcatatccagagaagcagaatacagcaaagagtcaacaattcccaactgtctggcagatgccccatgtcacacatttaacatgtcaaaaccaaagtgattgccttccctgaaaaactagctcatggtggagaattcctatttcagatgcatcattaacatctcctgtcactttactgccaaacttcagagtcatcatatctccccctatctacagtcaccaagactatcatgactttctgaaagtctcatgcatttacgcatttatattcctatcagcatctcttgtctacagtgcatacaattcgttttggaattaaatgccaaccctaacaagtctccctcctcaacactggttcatatcttccaatccactctaagcaagtttgctagattaattttcctatagcacttttccttttttaatttctgacaaaagcacaaaagaaacctgtgtgttgggggtttttattattactctcagtttacagatagtaactgcacatatttataagatacagtgtatttccacacacatatatgatgtgatatgatcaaagaacagtaattagcatatctaacaccttaaacatttatcatttctttgtgttgaaaacattaaaagtccactctttcggctatttgaaaatatacaataaatgtttgtaaattatactcacccagtcctgctatagaatactagaacttattcatcctagctagctgtacctttgtatcctgtatccgttaactaacctttggctatacctactccccttcccctccacacttccctgcctctagtaaccactattctactctacttctatgagatcaacttttttagcttccacatatgggtgagaacatgcggtatttatctttttatgcctggcttattttacttaacataatgtccccaagctaactcatccatgttgccatgaataacagaatttcattctttgttactgcaaaagagtattctattgtgtgtatataccacattttctttatgctttcatctgctgatggacacataggtagattccccttcttggttattgtgaatagtattgcaataaacatgggagtgcagatagatcttcaacatactgatttccttttttctggatatataccaagtggtaggattgctgcataatatgagagctctatttttagtttttgagcaacttccatactgtttttccttagtggctatacttttattttatttttgagacagggtctcgctctgtcgttcaggctgcagtgcactggtgcaatcttggcttgctgcagccttgaccccctgggatcaagtgattctcccacctcagcctcccaagtagcagggactacaggcacacaccaccacctcagctaatttttgtattttttgtagagatgaggtttcaccagattgcccaggctggtcttgaactcctgagctcaagccatctgcccacctcggcctcccaaagtgttggaattacaggcgtgcaccaccatgcctggcctccttaatgggtttactaatttacattcccacctacaatgtgtaagagtttcccttttctcttaatcccactagcatttttttatgttttgtctttttttgttttgttttgttttgagacagagttttgctcttgttgcccaggctggagtgcaatggcatgatctcggctcaccacaacctccgcctcccaggttcaagcaattctcctacctcagcctcccgagtagctgggattacaggcatgcaccaccatgctcggctaattttgtatttttagtagagacagggtttctccatgttgaggctggtctcgaactcctgacctcaggtgatccgcccacctgagcctcccaaagtgctgggattacaggcgtgagccaccgtgcccggcctatgttttgtctttttgataacagccattctagctaggttgatataatatctcattatggttttgatttgcatttccctgatgttcagtattttttcatatacctgttggccatctatatgtcttcttttgagacgtgatgtgtctgcttattgaagagactgtccttttcccagtgaatgttcttggtgcctttgttgaaaatgagtcggctataaagatgagatttatttttctgggttctatattctgttccattggtctgtgtatctgtttttatgacagtactatgctatttggttactatggttttgcagtatattttggagtccggtagtgtgatgtctcaagctttgttcttcttgctttggctatccagggtattgtgtggttctaggcaaattttaggactgttttttctatttctgtgatgaatgacactggtactttgatagggaatgcactgaatgagtatactgctttttgtagtatggccatttttaccatattaattctcccaattcatgaaaatgcaatgtgtttttatttttgcatatgcctgctgcaatttcttacatcagtgttttatagttttccttgcagagacatttcatttccttggttaaatttttccctaggtattttactttttgtagctactgtacctgcaattgctttcttactttctttttctgctatttgaatgttggtatatagaaacaccactgatttttctaagttgattttgtatcctgcaactttactgaattagacggtcagttcagaggtttttattttttgaagctttcatagttttatttatataagatcatttatctggctaaaacttctagtactcctgaaaaaaaatggagaaagtggtcattcttgtcttgttccagagctagaggaaaagtttgcagctttccccagttcagtataatgttggctatggttttctcatatacggctttgactgtgtcgaggtatgttccttcttacctaacttgctgagagtttgattaaagtgcagtttaaatccaatgttgctttgtttgttttctgtatagatgatctatctgatgcttagaggggtgtttaagtgcccaactattactgtcctgtttaagtgcaatttaaatctaataatatttgctttgattacctgggtgctccagtattaggtacatatacgtttataagtgttatatctgcttgctgaattgatcctgttatcactgtataatgaccttctttgtctctttttacatgagtttacttaaagtctgttttatctgatataggaatgactacatttgcttgcttttgggttctgtttgcatggaatgtctttttccatactttcacattcagtctacagttgacctttgaataagatgggatttaggggcactgagcaccaccaccatgcagttgaaaatccacataacttttgactctccaaaaacttagctactaacatattagcctactattgactagaagtcttactgataatataaatagggaatggacacatattttgcatgttgtatgtattatatactttatttttataataaactagagaaaagaaaatgttactaagaaaatgatgaagaagagaaaatatatttactattcattaagtggaaatgaatcatcataaaggtcttcatcctcaatttctcattgaataagctgaagaggaggagaaaggagttgtcctcatctcaaggatgggagaggcagaaaaggtagaggaagaagaacaggaagcaagagaggcaggcacattcagtgtaaatgtacagacataatcatagtttctgtctttttaactttttcatttctccaaaaatgtttcttctatacagtaccaatccttcttccactgtttgctttagtttcagtgcccatatgatagaagggtcaacatcataaaagaagtcaaaaacagtctggaatcatgggaaccattctgccagattatctcatgtcaatttgttttctagaactgcttcttccacgtctttttcctcatcatctggcactaattttgaagcactcatctccagcaattcatcttctgttaacttctctggtgtgatacctatttgctcttgaatttctctgatatctacatcttgaaatccttcctcaccacccctcataccttttttcccatatctacaatatcttgtcatgattttcttgattggctcaaatgtaaatcctgtgaagtcctgcacaacatctggataaagttttctccagcaagaacttattgtttcagatttcaaggctttcacagcttttcctttaacaatggaatcttcaacgatgcaatcttccagactttcatgatgttctgtcagggttctcttccatagcactaacaattctttccataaaacactgtgtgtagtgagccttaatggtccttatgaccccctgatgtagaagctgaattagagatactgtgtttgggggcaagcagatgacttcgatgtcttcactgttgaactcatagagttctgggtggctaagggtattgtcctatatcaaaagaactttaaaaggcagtcccttactggcaaggtacttcctgaacttagggacaaagcactgatggaaccaatccagcagaagagttcttgttgttcaggtcttcttgttatataacccaaagattggtatctgtgtttatcttttctattcaaggctcaggggttagaaatttatagacaagggcattcctcatcataaatccaactgtatttgcataaaacaatacagttggcctatcccttcctgccttaaatcctcgtactcacttcccttccttactaataaatgtcctttgtggaactgttttccagaaagggggcactttttttctacaagaaaaaaaagaaagaaacctgccaggcagatatccattcttctcaatgattttcttaatggtgtctgggaacttgtctactgcttcttggctgtctgctgcttctcctgttatcttgacattttttaaggcaaatctctttctaaaattatcgaaccatcttttgctggcattacattctccaagtttagatctaacaccttccttttgctttaagttgtcatacactaacctcattttttcttaaatcattgtagagtctataggcatgattttcttataggtatcctgcatccacataacagctacattttcaatataaaaaagttcaaggttttgtgcctactgagggagctgcagtgacaacaaatttccttttcttttcttacaacggtacttacactgctggattcttttatcttgaaatggcaggtgaccacagctgcagacctcaatccatttggtacatatcaagcaattcacccttcttataacatcatgaattttccctgcttcttgggagcacttccagcatcactagtggtactttgtatgggttccacggtgttattaaggtttatagtagtgaactaaacatgatgaaaaatacacaaaaaccatgagagacaactctttttttttttttttttttttttgggagacagggtcttgctctgtcactcaagctggaatgcagtgacacaatcatagctcaaactcctgggctcaagacatcctgacacctcagcctcccaagtagctgagactacaggtgtgcaccaacatggagatcactttttaatacaacacataatttactggacagatgaatggttcacatggagctgttagcatcacacagtgttttaagcagatacaacactcaagctcattgcaatagcaacaacaggtggcttcaacattattatatagtacagtatgtactacagttaattgtatgcagttatgatttaatactgcatctttatgtttctttacatttctcgggactgcaaatggcaccatgtacagtctggtgtatataagttttgataaactttaactttttaaagtagatgtgtttctatttcatggtaataaatgattaaactagtatctacatatattttatgaattcatgtcacaactcttgttcatttttccagtatttctagtctacatggtttgtctgcaagttttctcaaattgttgcaaatctcccaaaaaattaaacaacatatttattgtttaaaatatttgaatataagtggacctgtgcaggtcaaaacctgtgttgttaatagtcaacaggtaaagtgagtttcttgtaggcagcatagagctgggtcatgttttttcatccatttagccagtctatatcttttaagtggagaatttaatccattgacattcaagggtattattgataggcgagaacacactcttgttattttgttaatttgtttttgaagttgtttgtatatcctttgttcctttcttcctcctttcgttcctttcttcctctttttctatcattgcagtttggtggttttctgtagcctaagtcttgattctttcctctttctcctttgtgtatctgctccaccagtgagttttataattttgcctgttttcatgatagtgattttcatcttttcacttccagatgcaggactcccttgagcactttttgtaaggttggcctagtggtaatgaattctctcagtttttgtttgtctgggaaatactttatttctccctcatctctaaaggatagctttgctgggcatagtattcctggctggcagtatttctctttcagctctttgactatgtatcagcccattctctcctagcctgtaaggtttctgcagagaaatgtgctattagtctaatggagagtcccttagatgtgatttgactctcctctttttctgtttttagaatttcctctttgtccttgacttgtgtcaatttgacataaatgtgcctcaggcaaaaaagaaaaaagaaaaaaaaagacctttttgggtggaatttatttggagacttttgagattcctggctctagatgtccatatctctccccaaacttgggaagttttcagttattatttcattaaatatgctttctatgcttttttctttctgttttccttctgcaaatcccataacacaaatatttatttacttaatggtgtcccacaagtcttataggctttcttcacttcagagattcttacgcttgatcaagtcttctattgaaggtctctgctgtatttttttatttcactgattgaattcttcaaatacaggatttttatttaattcttttttataatttctctctctttgctgaatttctcattcacatggtgaattgttttcctgacttcattaaattgtctctcttttctgtttttcactgagttaccataaaattattactttgaattcatattccaccaagtcattgaattctttttcactgaggtctgttattacagagttattatgtttctttagtggtgtcatatttccttgccttttcatgtcttgtctccctgtgttgatgtctgtgtggcagatatctgtgtgttgatgtctggtggaacggtagcctcttccaaacttactagactggcttttgtacagaaagactttgaccttcagtagggttttactgtgctggttggaaagaatgtggtaactgtttccagacaggtgcagtagtagagtctctgtgcagactcttcatctgcattcaatgtcagcaataactgtgggtgcctcagtggcgtatgttgtagatgttcgtggcagtggtgacagtggcataggctgctaatgtcttcagtcctcctattctcattttccacacaatggggagacttagatgaggggatttctctaggtgtcaggtctgacatggcctacaagtggctgtaacagcactgagttgcttggagtggctgtggggccagggtcctaggctcagaatcttgtgaacctcctgtggcacctgcatcttggagtgcgaacttgctgtctgtgaaaggattggatgtaagttgcccccggaaccaggatctgtgactcagagctactccctagcagctcaggctcagggggccaggttgtagctgtgattttacttttagggtatacagtgaagcactcacccaactccaggaaagtgatactctgaaggtttaggctcaaggtgcaaggtatgactgcgatttgggaacttgacccgaacggcaactcgggtcccagggaatgagtcaccttgtggtagtgactctagaccctgggttggcagtgatcgtcagcatctgagcctctgtgaggccaggtgcagtggcagcaagtacctgggaatggcaaagaatagctgttttttgcagcatggtggggtgaagagtgtggggtcaggaaatagcacattgatgattccattcctcaagaacagatgtgtcccaacagctcagactctagggcctagaccagctccacggaagcaggatacaagagctgtttggtctataggccagtgtgtctcagctaagccactgttctacttccctgttatatggggtgctatgtcagttcagcccagggatgtgtagctacttagctcagccagggcactgataccccagggaccaatgtgctccttcagctcaggcctgggggccttgactgttctggatggcccaggcacagtttccctaggatgcaggctgctgcttcagcttaggtactaggatataggacctttctggggggccaaggcaccgttttggggacatgtggcaccctccaacttaggctgagggaaggtgtgacttctccgagtagccaaagtactgtttccccaggagaaagggcaccacttcagctcagcccaagaaggcggggagaggggtaggtgatgtggctctacttctgcctggggaagtgtatgattctgttttgcagtgctataaaggaacacccgaaactgagtaatttataaagaaaagaggtttagttggctcacagttctgcaggctgtacaggaagcatagtgccagcatttgcttctggtcaggacctcaggaagcttttactcatggtacatggcaaagggatagcaggcatgtcacaaggtgagagagggaacaagagagagagaaggaggtgctaggctcttttaaacaactaggtcttatataaactaacagagtgagaactactcattacctcagggaggcaccaagccactcatgagggatcaaccttatagaccccaggattgtacagccactgccagtgtgcactctgaacttcagaaaagctgcaggcattgcactccaacccaggctgtgcccaagaaagccatgaagatggggctgcccaaggcttcagcggatcaccctttgtaccagtgtacccaggatacaagacatggcgtcaaggactatgttggaacttcaaggtttaatgtcttccctgctgggtttcagacttgtgtggggcctactacccctttcttttggctgatctctcccttttgaaatggtaatgtgtacccaatacctgtactaccattgtatcttggaagtaaataacaaaacaaaataaaaattttaagtacatcttctgtaattatgttacagctgtaattgtttactcaaggtcagcaaatttttttctgtaaaggaccagacagtaaataccttaacctttctgggccataaggtctctacataaacacgcaactttgccattgcaaccaaaacaaccacagacaatagtaaattaacataagactgttttccaataaaatgtgatctagaaagacaagagaggaataggatttagcccaagggccatagtttgccaatctttcctttaacttgttattcaagaacttttgcaatctggctactaactccccaccttatttccctactgctatcttgctggcactgtgtattaggtttttcttttaaaatatagcaaatacataccatattaaattataagaaaggtactagctttgcaaattaaaaaactgaggcgagagtgttttaagtagcttatagccaggactagaagctggatgaagaatccaagctgttaaccattacaaaaagctgcctctccattggtcaactcagcatcccccctaagttacatgatcacctctgcacttttgcttattaaattatttccccctctctaattttgtcctactcatctttcataacctgagctctcaatgaagctctccatgcctcaccaactctcagtgacttctcctctccttttcttcttttgtttgagacggagtcttgctctgttgcccaggctggagtgcagtggcgcgatctcagctcactgtaacctccacctcccaggttcaagcaattctcctgtctcagccacctgagtagctgggactacaggtgcacaccaccattcccggataatttttgtatttttaatagacggggtttcaccatattggtcaggctggtctcgaactcctgacctcaggtgatccacccacctcggcctcccaaagtgctgggattataggcgtgagccaccacacccggcctcttcttttattctgaaaacatatattgcctatacttttctatgcgtccttatattttcataatttcatactgtcttccctacttactttttatcttacattttctagatcctaaatacctatcatagtattctgaagtcaaaaggtattcattattttttactggatgatattaacatacaaataattcacgaatataggcctaaaataatttttaccactccctatacttactaagattaaagcaagtggtctctttacagtaaatatatcatttttcaagatgaaaaaagaaacaaagtataaattggttctttgatctttctagaatgagatacgctttgcaaaaacaattataacaatatatattcagtaactgaactacttagaagagattattttatagtaaacatcatattagtgtgattgaactaggataacagttgtatctgaaagaccggcaaaaatataatacactgatttttctgttctttaagtctcagaaaagtggttttctttgagaaagacatccttgagaaagctacagaccctctcctgacaaaaaatatcagataaacatttatacgaatttttcatcaaatatctgggtgctccagatcccctaaagttaagaaaccctgcctgaaagggtctcatattagctactcacagctgtaactcacctaataaattttccttttaacacaagacattcaaagaaatttcaatgcactaataagatgtggccgtgtttttaaaattcatacccaaattagaaggtgtcgaagatcataaacattggaaatggggaaattcatagttaggagcaaacgggtgaggggagagcaggaatattaccaaagacttaaagatttcaatttcatgttactacttgctaggaaggctctgatggcctggtgatcctgccatgtatatgaggggcacaaacacaggttttgtagggacaatatatatgatcttattgctaaacttcataccttcaaatcagaagtggtagtatcatatcctaaaacaataaattgaactaagaaaaattagcataagaaagtaattgtagtgtctatttaaaactcagatttagaaataaaaacaagtaagttccaaataaaaacaaatacagtcatgcaccatataagaacatttcagtcaatgactaactgcatatacaaaagattatatacctaattatatacatacacgtaagattacaatggaggcaaaacactcccattgcctagtgacatcgtgaaaatcctgaccctgggtaggtccaggctaatgtgtgtttctgtgtcttcattttcaacagaaagcttaaaaagaaaatataaaaactaaaacattattaaaagcttatagaataagaaaataaggaaaatattttagcatagttgtacaatgtatatgtattttaagtatcattacaaaatagtccaaaggttttaaaaagttaaaagtttacaaagtaaaatagttacagtaatctaaggttgttactgaaagataaatattttttataaatttagcgtagcctaagtgttgattgttcataaagtctacaacagtggacagtgatgtcctaggccttcatattcactcaccgattcactcagagcaacttccagtcccgtaagctccaagcatggtaaatgccctatatgatggtacaattttttgtcttttcattgtttcattttatttattttattttgtagagatgggggtctcgctgtgttgcccaggctggtctttgaaatcctggcctccagtgatcctcccaccttagcctcccaaagttctcagattacaggcatgaaccactgcacctggccttttatcttttctattgcatttttattgtaccttttaaatgtttagatatgttttgacatacaaatacttaccattgtgttacaactgtctactgcattaaggcagcaacatgttgcacaggattagagcctaggagcaataagctataccatatagcctaggtgtgtctcatataccatataatctaggtttctgcaagtacactctggtgttcaaacaagggcgaaatcgcctgatgacctatttctcagaacatatacccatcattaagcagcacatgactgtaccaacagagtaacaaccccgtgaatacaacaacagacaaataacaaacagtaacattaatgatacatagttgccgcatttcaatttcctttcatttaaacttttttcaataagttgaatttattaaatgtattgctaagctggatttaatttttataatcttttgcactcggcacacaagaatgacagcaatatatcacaaaattctaaattttaagtatgcaacgtgaaatggttaaaatcaaactatctgtagaatatacatatattgatggatgtagataaactgatgaatgcagaattgataacaggtaaattaatatagaatttcaaaaatagccaaatgccaataagataaccagatgtagtttcatctctgttggcaaaagaaatatctataaatttgtgcctttcagaatgaatgattggttcaacaatagaggcaaattctaaggtggagtggaggccccccagaaagagggcagtcacccaaattaagcaattaagtaagacttttggaaatatacactttaaatcaccattttttggattaatatttaaggtcttccatgatcatatcttaatttacttctccatcttagtcaataatctactatcctccacaacatcctgtactcagtctcaggtctttttagaaccaaattctccccatgctttccatgtattcaaataatacttacctttcaaggcaaagaacaaatgagcatacctggaaaaagcctctgattacccctttcaccctgcactgcttctcccctcctgtccatatgataaccacatatccctgacttcccgttctgatcctgatcatctcaaacagtctgtctccttatgaaagcacgtctgtctctgtgcaggatcttcagcatgaaacaagtcatctgttcatgagattcgtaccaatcatttggcacttaattacgtatcatcttctatttaatggttcctcgtatgaatgttgtcttgcttgtaagttcattatctccttataagcaatgactagcaatattgggtacacagcaaatactccataattatgtgcagaaattagttaaacgtcattatttcctgccctcccctttttaaaactatctaaatatgagaatcaaaactatacaaatctcagttcccgacaaattctaggaaacctgcagccacacacaaaacaagagtctctagtcattttcactttaaatagaaaactaaaacagggtctcagtctactttaattctactcattttaaccaactcaaagtttactatgacaaagttcactatgacaattgttccaagggtaactaaaggaattacatttcagatatttagcaatcatcatcaaaagggcaaatactctaagttgctttttcctagtgtagttgggtattgcattgagccatccctattaatttgcttgggtttccctaaaaccaacaaacatatttctgtaaaatagcttgcaaagctcctgatgtacagaaatgaacgttatctctcccttaaggtttgaccgtggccccattaacaccactgtcttaccaaatgaacaaactgtgactggatgcttcaatatatgaacggtataggcactcacacacaaaatattgttgcataaaggcacagataacttagctatggataaaagggtatttggtcttgcttctcggctattttgtatttttcttcttcttattattattatttttaattttattttttaagaggaagccttgccctgtcacccaggctggagtgcagtggcatgatctcggctcactgcaacctccacctcctgggctcaagcaattctcctgcctcagcttcccaagtgagcagctcggactacaggctcacgttaccatgcccggctaatttttgtatttttagtagagatggagtttcaccatgttggccagcctagtctcaaactcctgacctcaagtgatctgcccaccttggcctcccaaagtgctgggattacaggtgtgagccaccatgccagtcctgtagttgtttttaaacttctttaattctacaatgttttaagtaaacagaaattgtaatttatgtttctttgtttttatatgtttttacttctatcgtattcctgacattgtaatttccctccgctgggaggcaggggctttaactttggttgctggaagttacagcgaaaggaaaaagtggcaggctggtgcccaattataacagagaaggaatttagatgtttcagcagcctgagacacagaggactgccccacgaagagttcgctcccctccctgaatgccctgtcattggcacccaaatgctcccaatggaaaggaacttgtattgaaaagtctccatcccattactgggtatatacccaaatgagtataaatcatgctgctataaagacacatgcacacgtatgtttattgcggcactattcacaatagcaaagacttggaaccaactcaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaaaaaagaaaagtctgatgccccaggccatatcctctttctcttccaaaggaaaaatacaaaaagctgttgtggtatgccaagatccataaagaaatggtcagctagatgggaaaaatcatatagtttagtggtttaagttttgttttgttttattttaacaaagaaattgtgccttcaaatggtatctgacacagaagtcgaaaaaataaaacaaacagaagttcaaggccaggccaggctgggtaacatagcaagactctgtctctacataaaattcaaaaaaataaaaaaaaaaaaaataagttagccaggcatggtggtgtactcctgtagtcccagctactcaggaggctggggtggaaggactgcattagcccaggagttcctggctgcagtaaactatgatcatgccactgcactccatcctgggcaatagaatgaggccatgtcaatcaatcagtcaaccaataaaacagataaaagagggagtgttttcggtagagtgggggtgggagcacagtttcatagcattatcccctctttcctcaaaccacagggagacacagacacagactttggtttaaagactgaaataacaaaaataaagccagagaagttaaataatgtattcaatactaacaattaagaacaaagccagaagtatagcctactttcaaggaaagttagcacactgtcacttgggagccagtggcacttcactccaatttcctgtaaggctgcaggatatggtggagagacagccttgatgtcatgcttgactgggcatggcagacccgtgacttccttgctgtgtaacctgagcttagttaagttactgggcctcagtgagtctcaggaacctcatctataaaatgggggtgaggggagaaactgtatcagaagatctgtctgaggttccaagaataatacaaaaagttcctagcagagtgtctgttgcataataatgatgtaagagcgttcacttctgcaatttggtgtgataaaacagaaaatgaaatctttatgtttgctttccaaacagcattttcattttttataattcataactcagggatatatatatagacatagatatataaatgtacacatacacctacagatacacacacacactctaccccccaccacacacatcactagtcatcatgaacacaatgaagcagagaactcaggtttgaacaccccaaattaagaaaaatatcttacacattttgtcagcctacaccgtaacttaatacacaccaaaacaaatgcaacaactcaaaaactatccgtccacaaacagccaagttaagtgggacctttcacattagtctttcaattattatgactccaacaagaatgatttcttcagaaggttttgaaaaatttatacatgaggaaaaaaatcaacccactagaccaggtttcatatattcttgttaacacatcttgtcttctggggcctaccaaaatgtccatctgagaagtttttgccatgaaaatcccagatccttatttcataatgtcataatgagattaagatataacagggaatatttgtacaccactgggattttgacaaacctccagattaaattaagcagaaagaacaaaagagtattaactccgaaacaaatctgaaggaaatctgctagcaggaatatccttcaggaacagcgcttcacaatgttaaccgctactgaaaagtgttgcaggttcagtccaccagggggcagtgttgtctaactattaacagaactgagttcttaaaaggaataaaacttttgtacttaaatttctttctaagctttcagaaggaaaaaaatatatatattctttgaaggaaaacctaaaaatctttaatttagatatctttaattaggtgaaaatctaaaagatggtccacttctcaaaatcattttgtgcctgttaatgtttatcatctctgtggctaggattctcctaaaagaaatgaagacactcactcaccacacctagttccacaacctgaccagggctgcttcagtcccgaccagaaccctcctcctctttggcaacctgatgttgaagttcagagaaagcagtgaacagtgacaggtgggaccctattgcttcatcacaaatttcaagctagttcatgatggccactgtattaaatatctacccactattcccaaaaaacattttcatgcaacaggaaatacaccctaaattttagcttgagagaaacagttaccatgctgtcacaatgacaaaagccccaagtgggctgctgagtggcaaggcacccaggggatgtagagtacactcctagagctacttaagaaacggccaccatctaccctgagtaatttcaataattgtgtgatcattaaaaaaaaaatctggtttaatctaaacaactttataaacacacacacacacacaaacacacacacacacacacacacacacacacacacacactctccttctcctatttcaatgcattcaattacctcctaattgctagatgcttcagtctttattggactggactcatccatggcatgtctctgcaactactgccaccttttgaaaatcctctctctcgttttccaaatatttttctgttaaagtttcccttctctatctcgggttgattcttctaaatttattttaaatactactttgtcaacctgttcattttttttttctttagagtgcaaacttcagatttcctgtcattttccacatgattcctgggcaatcatacccacttccaaaatgtcttctaagccccaatggccaaaggcttcagacctgcacccacagacccagaaaccagtctggcccttgcagatagagactccaggcctcccaggagccaggccagcctcaggggcctcatgctctacagaaccaaggatccaggcctgcttcagcagaccctggggccacacaagctgccacgaacccaggacccaggcccatccctagggacccagtctccaggcaggaccagtgccagcggactaaggatctaggcctgcccccagtgaacccagggtctaagcaccaggctggccttcatggactcaggatccaggactgcccgtacaggcccaggtaccaggatggtccccacaaactaaagatcctacctctaccactacagactcaggctttaagcacaccccaatgccaggccagccactgcgaactcaggctcctaccccaaccctattgatccaggtaccaagcccatctcagcaccaggctggcccctgcagatccatgctctgggcctgtcctcacaaactcaggctctaggcccaactcaacagacacaagctccgggcccatcagagtaaacccaggctccagacttgaacctgaaaatccaggctctaagcaaaccccaggggagccaggaaccagcctgcccaaaggctccaatagcaagcctacacacattcccttccagatgggggattataagatcatctccatagactcataaacagcatttgagaaaattcaacaccctttcatgataaagaaaaaaaaaaaaaacacctttcaacaaatcaggtaaagaaggaatgtacctcaacataataaagaccctatgtgacaagcccacagctaacatcacactcttgagaaacaaggcaaggatgcccactctcaccacttctgtcagcacagtactagaactcctagccacagtaattaagcaagaaaaagaaataaaaggcagccaaattgaaaaggaataagtaaaatggtctctttttgcaactgacatgattttatatacagaaatcctaaagagtccaccaaaaaaaatgttaaaactaataaattcagtaaggttgcaggatacaaaatcagcatacaaaaaccagtagcaattctatacactaataacaaactatccaaaaaaagatatcaaaaaataatctcatttgtaacacctacaaaaagtaaaatacttcagaataaatctgaccaagagagtgaatgacctatacaatgaaaactataaaacactaatgaaaaaagttgaagtgacaaaaataaatggaaagatatcccatgttcaaggattgaaagaattgttaaaatgtccctattacctaaagcaatctacagatccaatgtaacacttataaatattctaatggcatttttcagggagatggaagaacaattctaaaattcatacagaaccaaaacagaccccaaataaccaaaccaatctggtgcaaaacaaagctggaggcatcacgttacttgactgcaaaatgtactacgaaactatggtaaccaaaacagcatggtactagcataaaaacagacctaaaccaatggaacagaataggaagcccataaataaagccttacttttatagtcaattgatctttgacaaaggtatcaaggacacacaatggggaaagaacatcaatgaacagtgctgggaaaacggaatatccacatgcagaagaatgaaattaaacccttatttcacaacatatacaaaaatcacctcaaatggattaaagacttaaatgtatgacccaaaactacaaaactactagaataaaacataggaaaaaaggcttcttgacactcgtctaggccatgattttttggtatataacaccaaaaacacaggcaatgaaaggcaaaacagacaaattggattgcatcaaactaaaaagctaacacacaacaaaggaaacaattgtcagggtgaaaagacaccaacagaagtgagtaaatacgtggcaaatcatgtatcttataagcagttaatatccaaaatatccaagatataaatacatatatacattttatttgtcaaacaactcaatagcaagaaaacaaataacccaatttaaaaacctcctatgggcaaaggactgaaacagacatgtctcaaaagaagacatacaaatggccaacagatatattttaaaatgctgaatgtcactaatcatcatccagaaaaagcaaatgaaaaccacgataaggtatcacctcgaatctgttagaatggctaatatcaaaaagataaagtaccagatgctggagccatgtgggaagaaggggaactgtgtacactgttggtggaaaagtatggaagttcctttaaaaaaataaaaatagggcaggcatggtggatcacgcctctaatcccagcactttgggaggccaaggcaggaggaatcacctgaggttgggagttagagaccagcctgaccaacatggagaaaccctgtctctactaaaagtacaaaattagccaggcatgggtggcacatgcctgtaatcccagctactcgggaggctaaggcaggagaatcgcttgaacccaggaggcggaggttgcagtgagcggagatcgtgccattgcactccagcctgggcaaaaagagcgaaactccgactcaaaaaaaataaaaataaaagtaaaaatagaactaccatatgatccagcaatcccatttctgtgtatttagccaaaggaaatgaagttagcatgtcaaagagatatctgcattcccatattctttgcagctttattcacaagagccaagatatgaaattgacctcagtgtctatggattgctgaatggatttaaaaaaagtgatatatatatatatatatatatatatatatatatatatatatatatatatatacacacacacacacacacacacacacacaaacagaatactatacagccttaaaaataaagaagaaaatcccatcatttgtgacaaaacggataaacctagaggacattatgctaagtgaaataagtcaggcacagaatgacaaatactgcacgatcttatttacgtgcacaatcttaaaatgttgagcacacagtagcaaagagtacgatggtggttaccaggggctacagcagggaggaggatgaggaggtgttggtcaaatggaacaaaatttcagttagatggaatgaatacattctagagatctgtcagacagcatggtgcctataatcaataatgtatcacacacttgaaaattgctaaaggagtagatcttaaatgttcccaccacaaaaaaataagtatgtaaggtaaagaatatgttaattaatttaatttaatcatatcacaacgaatatatgtatgaagatataatactgtatgccataaatctatataatttttgtcaattatatcttaataaagctgaaggaaatgaaaaaaaaggaaataagggagagaagtctttaacatttctttttaaataatataaaatctcttccctctagcccagacctgatacccaccagcccactgaatatctgcatctgaatgtgccatgggcatctcctacgcaacatgtcccaaagtgtcagcattcttccaccttacccccaaatcctccctcccatccacccagctgcccaaagcagaaactaccctcaatgccttcaccttcttttcttcccgtatcatatcagtaaccaatatcagcaatccctgcagtatgtctcgtcttctgtatctccactgcctcagttcaggtcttcattatgtgtccctcgcattcctgcactactttcaggcagagatggagatggtttaccccactatccatttctcctcttcccttactgatagaacccctccatttttagctaggcacacggccgctgaataaatactgtattttcagcctttctcttacagctaaaagtgatcatggcacgacacaggggcaatgagctctaactagaagtcttccgtggcaatttctccaaaataaaagcaagtcctcactcaacattgcagattagttcttggaaaccaagactttaagcaaaacgacctacagcaagtcctcaaataacactgttttgttatattgataacataattagttttgttacacatcctatatgtttcgcttgaagtcgcagtttccaagaacctatcaaggatgttaaagacttaccatatccttttattacagctagtgcatgcccctttgctcttgcgatttcccacccccaaccctgccccttgcattcctgctctcaggaacgtggagctcaagcaaacacatcagaagatgagaaaatctccaaggatggcagaccaactagcccaaagtagccaggacctgcaacaccgtggaaccaacatacaagctgtgaatcatctatctggattcctttcatggaagagaacttttattttgtctaagccaccggtgtgtgggtgtgggcaggtgggcgtgtgtgtttatgtatttatgtatcctaacaaggttcactgcctccaatctcacctctccaaaaccacaatctatctctagatttcctacttccagaatgatttccagactgatttcctaaaccctaaatgtggagaatcaatccattatttttttaaaaaattaataaaatacacacttacagcatgctttagcatggcacgtaagaccattcataacctagtccctgcccacctgaagtcttctagttcattgctccctcttgacaccagctgctctgaccaagccatggtctgcacaacaccacagctttatatgtgcttctgccactgtcaaaacatctttcttcccagcacccgttctaaattatcttcaaaaactctgctcagatctcagatgtcacctcttccaagaagccttctctccatcctgactgaggtacaaattcacagcctcccaaagcctctgttcttacctctactgtagcaggtatcatcctgtgtcagaatcatgttattacttgcctgtttctccaaccagacttcacagtcaggctgtaggcttcatatttctacctctagcccagcaactacaggtattcactgaatgcgtgttgaaaaagtaaatacttccaggaatgtactgaaggaagtttttagcatctggtacttgacatactaataaacaaaaaactaggcctcttgattctttgcccaggcctgttcccagtacatcagcatttctccaactgtgttccaataacatccattcagaaaatgtgaataatgtgtgggtttccagctatgcaacacagcttccagttccaccaacctgtcaaacttccaccaccctcaaagcctctcaccccacctttttggtcttctacgtggagggagggcactgtacctgtaccgtgcccctttccctggttcccaccattcagtcgtcattcataagtgccagttcagacccggggaagactatctggtcttgcaatatttttaataatcctctaaagcttggctaaagaccgccctgaaactcaccaggctctacaatttccttaattctcctttctacagattaaggttttgcctcttggattcttttttttaagcactagtccctatcttcatgattttcaaagaatatctagagtggatatataatttacctgcaaatatgctcagtttcttaggatattatgcctcagagtttaaattcatacaaaaggagccaggtgatctcttccggggcttcagcttcttctagcagtgtttgttctaccctttcaaacaagctgactgtactccttgatagagaaacgccagccaggaaggagtttcgtatctctgctttatctcagaaatctcttagcattacctcacacacccttagaaaggagccccacctttcctttttctctttctttttcacacaccacacagttattgcccctgacccgtgagaacaggattgctcaagcagccatccaaggactacctgaatcgggatcatccgagagctcattcaatactagatttctgagtcaaacagaatcagaattactggagtgaggttcaagaatctgaatttttaacaagcatggaaagcatccaaggtggaaacagatcgttggcttgcaaggtggggcggggcaggactggggcggccaggatccccagaaactgtcacctgcagcccaagaccactgctttccttcacttccctgcgcaatacaaagagtgtaattttctatgtgcgccatttgtagggacatggatgaaattggaaatcatcattctcagtaaactatcgcaataataaaaaaccaaacaccgcatattctcactcatagatgggaattgaacaatgagatcacatggacacaggaaggggaacatcacactctggggactgtggtggggtggggggaggggggagggatagcattgggagatatacctaatgctagatgacgagttagtgggtgcagcgcaccagcacggcacatgtatacatgtgtaactaacctgcacaatgtgcacatgtaccctaaaacttaaagtataataaaaaaataaataaattaaaaaaaaaaaaaacaatcacaaaaaaaaaaaagtttcatggagtttctagaatttcctagagaactactaaattagtatttctagggcaggttcacaatgatcatttccaaaacttctacaggacaatctaatgtgccctgatgcttaggaaccatcgctttaaaacagcaattctcaactctttaagggcaaaaataccttttcgtaacattttgcaatgccttctttattatcctacagtgaaatccatcaacaatataactgcctaaatataaaattcaaaataatccatataatgccctaaatatcacaaaggggaaataaaattaaaatgattttcattacataaatgctcaggttagtcagacacttgcttgtacctaaaggagaatcatgctgaaagcaaggttcgagtgtggacagatacagcggtattgaaatggtgatgcgggagcatgagcgctgctttcttggatgtgatactttgaaatagtaaacaacttttagtaaatttgcaaacaaaacaaagtataatcttctctcgatttacatggtagttacagtcctagaaaactcactgatacttaaaaccatttaagtaaaaaaccttttattgacatatcctaaggccggatcattagaaacatatttttctcctacatgaatgtccaacaggacattcgaggccatacagaatgtagaatagttcttcctggtgtggtactatcccagggactaaaacttgtctagcatgcctcatcaccacctattaaaggctagtagccacctagccctccatccccaatcactgtgataactaaaaatatacccaaccattcaacctccccaaacaatatgaatagaggtacctgtgtcaggctatagtattattttcccttgtgacactatcatacatgatagtgactccagaatctctgcgtgattctacctatacttataatattttcaaaagcaaatatttacataaattctaccataacagaaattgctggtgaaattctacatgaatggaatgacagtttcacagatatgagaaaccttcttcagaaatccttgaaaaaacaaatgtaaactactttttttaacaatcaaattgcattttcctgttgacatatttcaatttcagaattatcttctcactattagtattcaattggcagtggttcctaagcagttcagctctgcatgtcagtaaaatatatcaaactacagtttaaatgtattaaatgattccaaaatgcatccttttagtgttaaaatggtttataaacatctcaagtaaattatcttttaaaacacaatggttctcgagcctgtatgtgcatgacaacaaacactaggggagatgcttaaaatgtagagatgcttgggtcatcccttgcccacagattctaactgcataggcatgggttaagtagagcctaggaagctttattatttcttaaaaggtctacaggagatcctcatgctggcagaggcagatctagttttgtgggtcctgaaacctacacacaactgggcaggtggtcacggggagtctctttaagaaaaagaacaaaaaaatggcaggtttctgggagccttgggaatgcttcctgcattggcttcatagaaaatccatctctggatgctacttggggttgcaaagtgtgacataatgaaactcacaactggaacacatgggcaaaagtataaagtcatacactatgtatgcagaggccataagcccagtgttcacgggcttcaggagataatataaatgagtaaggcaggcaaggtatgagaacacaggagggagtggtgaccaagtacctgtgctctgaaggcaccagcactatttcatgtcaatgccaaggcacactcagtgttggcattcctcaaattcagcaacagaagcttcaagtctggatttttacatgaaatctcccagtttttaaaagttagctcaatattttaataaaacattggttagaccaaataaatcataagttaaaaatgccagtatgtcacttctgctttatagaagggaaaagatatttcctacctaaaaataaaactgaagagtagatagtttattcaaggatccatgaagggagactgctaaaaacatactttgtgagtcagttcatacacctgacaatgaaaaaacggtttgttcagggattctgcaacatctcaaggacctaaagtttactctaacacgtcctaacggaacccaaagagttctgtaagtcaataaaaggcaagctctccaatataaaactcgtgaacaggaaaatctttcaaaatgaatcataaatggctaataagcacatgaaaaaagtttgacctcaattacatctggtgcagcaagtctgtggagattaaagttctcagttctaattatgacattctgagaacacaggaataaactaaacggaagtgcttttcctattctctcactcaacctacacagaagacttctgtgaccaaatgttttccccacaaaccgagcaagcaatcaattctgcaggatacaccacctgggtgtcctgtaattcaattcaactgcaatactatctaactcgagacagtattagatcccacgggttggggactcagtctccaagactgccccttcccttcagatgcccatctaaagccgtaggttgtttcacctgcgcttctgactggctataaatcaggattctcacagccccctccttgggttcgattaatctgctaaatcagctcacagaacacagggaaccacttatgtttaccaacttctgataaaggctgttacaaaggatacagataaagggatgcatggggcaaggcatgtgggagggggcagagagttccatgccctctctggacacaccgccgtcctggaacctccatgtgttcgtctttcagggagctctgcaaaccctgtccttttgggtttttatggaggcctcattagtaagcatgattcactcaatcattggctattggtgatttccttaaacttcacccctctcccctccccagaggttaggggatgggactgaaagtctcaaccctctaatccaggggtgtccaatctcttggcttccctgggccacactggaagaactgtcttgggccacagataaaatacactaacactaccaacagctgatgagctttgaaaaaaaaacctcataatgttttaagaaagtttaaaaatttgtgttgtgccacattcaaagctgtcctgggctgcatgtggcccatgggctgtgggttgcataagcttgctctaagcttggacaaggtagccccattctaaagccacataagggttgccaggcatcagttaattcattagcatacaaaaagacataccactttgaaaatcctagaaattttaagaggaaactcagagggaagaccaaatatagtcatgtgccacataatgacatctggctcaccaatgaccacatataggacgctgatccataagattataatgccatattttcactgtaccttttctatgtttagacatacaaagaccactgtgttacaattgcccacagtattcaatacagtaatatgctgtgtaggttcgtggcctagaaaaaacaggctaagccatagagcctaggtgtgcagtaggtatactatctaggtttgcgtaagtacattttatgatgtttgcacaaagatgaaatcgctttatgacacatttctcagaatgtgtccctttctttagatgacacatggctgtatatacttcacagtgttagatgtgatgtccactgctgttccaaagctgatttgatcctactctcaaaaaagtcaaatcctgctcctcagcttttcaacagctactttaaatatatatatatacatatatgtgtgtgttttatatatatatacatatattaaacaccaatctaaaaaaatagatcttgtagacaaaaacactgaacagacagtagaaatatgcttttcagtatgctctcctggttgatttctgcaacacttcttagttatcttagtatataaaacaccaagtaattccaaagaagtagttaaggctaccagcatacagcccattctacagatacgtgggccagtgtggaataaggtggaacctctaacttactataccaaaaaccctagccaaagagaaagttatagtcacttcctggcccactttgtcaagccaaaacagaccattggaaactactgcgtatcaagcagaggctgtggtacagctaaaataatggagaacatatggtcagtttaataacggccaaggaatagtgagcaagtctaacacatacttgttattatactgtaaaatcatttttctgctttccataatgggtgggaaggaggctggagagtggaaagaaaggagcaaaataaataaaaatggccaaacatagaagattttctaaaggactagccacaaaattataaaccaacttctatccgtggtgaaaacaagaaaataaatcaacagaaaacctgagaattagcagatttgtcatttcttcctttgtttatttgtggtattctatcccagcccacatttttcctaaagcaataactcgtaggtttcctgggtcctgcagccagatgcaaagatctgaataggcatgagtaggggctgagctgccatgctacttttttcttgtcttgctctccaggaattccgtgtgtatggtgaggcgtctacctaaagcagacgctcaacattcacccaacacattctatctgttattcagaattattcagcttcttctttgcactaaaaagaaaaaataactaactcaaaatgggccacagacataaaggtaagagttacaactataaaacatggaaggaaatacaggactaagttttcttcacttaggcaatggtttctaagacatgacatgggaagtacaagcaacaaaataagagatatagataactggacttcaccaaaattaaaaccttttgtactataaatgatgactatgaagaaagtgaaaacataacgaatacaatagaagacagtatccagagtcatacaattaagaaggggcttgtatacagattatagaaagagtgctttcaactcaatcataaacagacaaataagccaattaaaaaacacagctgggccctgtggccaggagtttgagacctgccggggcagcacagccaaaccccatctctacaaaacatttaaaaatacaaaagtcagccgggcatggtggcgtacacctgtggtttcagctactcaagaggctgaggtgggaggctcacttgagcccaggagttcaaggctgcagtgagctatgctatgattgtgctaccacacttccaggcaactatctctaaaagtatatatatatatatatacacacacacacatatacatataataaaaattctctaattttttggaaaaatgttaaaaaatgggcaaagaatctgaatagacatttctctaaagatatacaggttgagcatccctaaccaaaaatctaaaattcaaaatgctccaaaatctgaaacgttggagtgccaacgtaacacaagcggatgatgacattaattaacactgcaaaaaagtgcccatagacaacatgatgaaaatgtgtgatgggtttattcaaggactacagcagggtacattcataatagaacaagaaatcatgccagtttataaaattcgagagagaagtcgaagtcaaaaactactgttaacgaggaagatgactggaggacgcatttaaaaagccatccagcagaaagcctcctcatccttagaggactcacttccaggtccctcaactgctactggtgtttctgctcaactcaaaaaacaaaaccacgtacagtgaattcttatctttttaaaaaaattttctttcttttctataacctcattttagaaatgatagagtttttaatcaaaacacagcatggcagaggaagacggaaagcctaccgttgtttgttcctgccactgtccaggaactaacataggtattctggtgatgctactgtactgcttagctatcctgaacacatttattttttcaccatattaatggtatgttgttttttttttttactgttaaatatgtatgtgtgaatcagtgttagaaaatgatcgcttcttagaagaatatacattcagaggcaggaatgagggtgatgccacacaaccacagactgtccacatgggtggctgagatagtgacctctgcattctgatgattcagcatacatgaactttctttcatgcacaaaattatttataatttataattatataattataatcataattataaaacaaatgaatttcatgtttagacttgggtgtcatcctcaagatatctcattatgtatatgaaaatattccaaaattcaacaaaacccaaaaaatccaaaatctgaactccttctggtcctaagcatgatgggatatttaagctgtacaataaaccataagcacaggaaaagatgctcaatgtcattagtcattacaaaaatgcaacacaaaaccacaatgagatactacttcatatctcctaggataattataatttaaaaagaaagacagagaataacaagtgttggcaagagtgtggagaaactggaaccctgtaagtaagaaaaaacacacagataagcaatttttcctctgatctcacaccacaaggtgtggagattttctccacacatgaagcaagcaatcagtcctacagaggataccagctagttgtcctctaatgcaattcatttccaacactatctacccggatatggcatcagatcctacaggttgagggcttggtccctctaccccacccctaaccccatgccctaaccccacctcacccctgccactttagatgccagtttcaagccccaggttgttttatttgtgcttctgaaagggtctagatcaaggatcccacaaccctttccctgggctcagttaattagctagagtgcctcacagaactcagggaaacatttacttacatttactggcttattataaagggtattacaaaggacgctgaagagatgcatatggtatgtatgggaaaaggggcacggaacttccaagccctccccaggcacgccaccttccagaacctccatgtgttcagctacccaaaacctctcaaacgctgtcctttcgggtttttttgttttgttttttctgagacagagtgtcactctgttgcccaggctggggtgcaagggcgcaaccttggctcattgcaacctctgcctccagggttcaagcaattctcctgcctcagcctcccgagtagctgggattacaggttcacgccaccatgcctggctaatttttgcattcttaggagagacagggtttcatcacgttggtcaagttggtctcgagctcctgacctcgtgatccaccctcctcagcctcccaaagtactgggaagacagggatgaaccaccacgcccacccctttggtgtttttatggaggcttcatcacacaggaaggaatgactaaatcattggccaacttaaccttcagcccttcgctcctcccaggaggctgctcactgctgctgtgtagccactgacccgggggctctgggctgctgccatgctacttagtttccctgaacacacgtaggagaaagtccgaaccctccaatcccgctgtgtccttctggtgcccagccccgtcctgaagctacctaggggctgacagccatcagtcaacatatgagcacacaagaagacatcattgcggacattctaaggattttaggaggtgtatgccaggaaatggggacaaaaaccaaatacatatttcacaatatcacaccctcatacactactggtgggaatataaaattgtacaactgttgtggaaaacaatttagaagttcctcaaaaggtttaatgtagaattgccattcaactcggcaattctacttctagctgtatacccaaaagaaatgaaaacctacatccactcaaaaacttgtacaacagttctcctaacagcattactcacacaagccaaaaaggaaaagcaacccaaatgtatggtttggctgtgtctccacccaaatctcacctggaattgtaataatccccacgtgtcaagggcggcgccaggtggagataatggaatcatgcgggcagtttcccccatactgttctcatgatagcaaataagtctcatgagatctgatggttttataaatgggaatttctctgcacaagctccctcttgccagctgccatgtaagacatccctttgctcttccttcgtcttccaccatgattgtgaggcctctccagccatgtggaactgtgagtccattaaacctctttcctttataaattacccagtctcaggtgtgtctttattagcagcgtgagaacagactaatgtattaaatttccctcaaatggtgaacagataaaatgtgtaccatccatataatcgactattattccacacaaaaaagtagtggtaaattttacagcaaaactagtcataacaatgattccatttatatgaagtgtccagaataagaaaatctctagagataaaaagcaaattagtggttgcctagaatgacagtcagtgggtgttctctctctctttcttccttccttcctttttttctttttatctttctctttttctttccttccttccttgtttctttctttctttccttccttccttgtttctttctttgtttccttccttccttctttctctttctctctctctctcccttcctctcctctcttctgccttttatcctttcctctcctttcctcttcctcttgctcaagacaaggtctcactatgttgcccagactggacttgaactcctgggctcaaacagtcctcccacctccagcctcccaagcagctggaactacaggaaggagccaccaacaagtcttttgtttttaagatgatgaaaatgttctaaagtggcctgtggtgatggatgatgcacaattctatgaacgtactaaaaatccactgaattttacacattaaatggatgaattgtatggtttacaaattgtatctcaataaagttattttttaaagtattcagccttctgggtcactatggcagacaaggatacagatttgtttaatcttctctaagtcatatgaaaatggcaacaaccaatttcaaaagaaaataaattcacaacagtgctaaaaaaaaaaagagtataaccatagacaaaataaccatagacagaagtcacaaccccaaacaagcccagagggccacagttatcctaacagtagagccacagagaagctagaaacccagagttggcaggtctccagatctggaatgggaagcagaacatatgtcaccatgattaactgaaaaatcatctgcagaacagcttcccatcctagccccctcccaccctgttccccaacccagaggcttgcctgcagcaaggcagttagcatgggtctaatcccacctgcacttgtgccagtccatacaccccacctcgtagaaacccattccagccctcttctatatgaagggaagaggcctgctaaggacacacactccacacagccagagcaactccacctgtctatatctgggaacccaaactttcattcatgcatatgaatgaaaaaaacaaactccaacagacatttgaggactaacggtggctttcaaaagaagttctaagatttaatgaaacaactgaccctcgatgaagcaaaaatccaggaaacagaagataatctcagggggaaaaaaaatctaattgtttatttagagagattcaaaataatgcatccataaaaaagcagactgcaatgaaaattgagtgaccagagaatgggaaagaactcttgaaactataaataaaactataaaaatgttgttagaaagagtggaagatcgtactttaaaataggaaagaaaaattaaaagacatagaagattgatctaatccaggagaaccaacacctatctaataggaactgcagaagtaaaaaccatttttaaaaagtagagaggacaaatattttcagagctaaggaaagacatgactgaaagggctccacaggcaccatacagcaagaacacaagactcacacttccagaaacgtgagtgggtaggggtcaagagagccctgaaagctgtccatagagatagagccaattacccacaggtgagatctcaaaggtcttttcatttaagagactccagtgcatactgcatactaaatcaaagccaattaaggcaaaagaagggattaaatattttgaaacgcacactgcaaagtctaccacttgtgttattcattcctcattcagttacctaattcctaatctgcttaatttcccaaacagtgaaaccggaggacaggccatgaactttcacgtacaagtctttacattggcatacgcttgggtatcctgggtaagtatcaagaaatggaatggcctagtggtacagaacgtatatctttaacttcttaactaactttttcaatttttttttttttttttttgagatggagtctcgctctgttgccaggctagagtacagtggtgcgatctcagctcactgcaacccccacctcccggcttcaaccgattctcctgcctcagcttcctgagtagctgcgatgacaggcatgtgcaaccacacctagctattttttttatttttagtagagacggggtttcaccatgttggccaggatggtctccatctcttgatctcgtgatctgcccgacttggcctcccaaagtgctgggattacaggcatgagccactgcgcctggccttcaactgtttttaaataattggaccttttacattcctgccaccagtgtgtacgagctcagtagctccactttcttaccaatcacaatatggccagtctttttaattttagcctttctagtagattttattagtatctcattgtggttttcatttccatttccctaataactaataatgttgagcatcttttcatgtgcttacctgccatccatatatcttctttggtgaagtatctgttacaatcttttgcccatttttttttcccttaggggattttccttcttgtcattgagatgtaagagctctctatgtattctacatacaagtcttttgttggatgtccaacacacaatgtcaatagtcaaactgttgcgaaaccctgatctagttaattttgctgaaaagaaccacattatactgcaaggagtcatgtatctacatatgattcactttacctttaaaaaaaaaacaggtaatttttaaaaaactgacatgagacacttcttaaaatcatatgctacagcatccattcacatctaagtccagcaagcaccttagttattcatacttatgaccataaatcatcataaagagaaaatttgcttagacaatacaagttagaatgagctccaactaaaagaaaattaacattttaacaaaattttggtatgtctttcagaggcttccaagcaactaagctctcactacacaatcactctagaaccttaaaattataacacatttcctatggcttccccactagtgccacccgactcttttcttttaatgatgggctctgaacagttcaggtgacggcagcagggaggcaatgtgaaaacagttctcctccttcctccgttagtcatcaggtaccttctccaacagaagagtccccgaaggcctccctcagagcctgtttactctgatagtggttgcctttctaacacagcacatttatagcatatttcaagggagtggggtgatgtgacttttacgtctttccaatctgagagttggttttcctacaggaacagatgatgtcacatttcacacatgattcagagcagaggagcctggatcatggtctcaaacctaccaatgagtttgggcaaattaattcattctcttgagtcctcagtttccacatctataaaaggcaaaggtgacttctactatttcttccaacataaagattctgctactttaatacataagcggtttcctaacagctaaacactgattgggtaccacgtgccaaaccctgagctgtgtatttacaatctcattcgatttccagtacaactctatgaagaagttactaccattttccctattttacagatgaagaaactgaggaggctcagtgttgtccacaggcacctgtcgtaggctgggacccaggctctgctgcagctgccatcagcactttgcattcagtaaagtgggaggaacaagatacagctttatgccagcccacagacagctgtgagaagtaattacagtcagagagtttcaaaaacacacacaaactctaaaaagcaagtttaggacaatttatgaagttctacaattctccacgcaactgaataacccatgaagatacctatcttacctcattacatcaaataacttccaattactggcatgctgtgcctactaagaggactgcactaaagctgagacttctcatgggctatgagagagactggatttttaatcggattctaaatcatctcagctatgtgcctttagtcatgttctttaatacctctgaagctcattttcctcacctacttatttttaaaagtctgtaaactcttcaacttgccttaggaggccctacatgatatggcccttttctaaatggtaatctttctgaacttatctctcagtgatgatgtctgcagactaaccaggctagtcttccccagttcgtcaaacaatttctatttcctgctcataccatttctgcaatttgaaatgctctccccacaaaactctaatattcagaattctagtcatccttcaagaccaagttcaacttccacctcctccatgaagttatcaccagacaaactaaatgtgatcattcttccttgctagtcacttggagacatattgtttcttcttagctaaagaataagaaacttatgagtaagaaccatgtcttccacgtctttgcaccttcaatgtgcccaacgcaagtaacctgcacaaaggtgctcattaaatgtatttgttcaacaacgcatgcatcctgtcacacctacagcataacatcacaccaggagcaactactaccaaccatttttaccaaggcaaataagaaacaaaaggtttaaggtgtcattttggtttgcctcggctatgatatatctgagctgctgatacagggaaaactactcaaaacccacgagtaaggaagaaccaaactcactcaccaaataaggcagagaactatgtagacatttggtattatctctatatagttaaggaaaaatcagttttattatagccaaaaaaaaaaagcttaattagcaaaaaaatcacagtgtcacattcaaagttatgtctatgccaaggagttttattttttaaattttttgtttattttttgagacagagtctcactcagtcatccaggctgaagtgcagtggcatgatctcggctcactgcaacttctgcctcctgggctcaaacgattctcgtgcctcagcctcccgagtagctagaattacaggcacatgtcaccatggccagctaatttttatatttttagtagagacaggctttcaccatgttggccaggctggtctcaaactcctgacctctggtgatccatccgcctctgcctcccaaagtgttgggattagaggtgtgagcaactacgccaggccaatgccaaagagttttcaaaagtctggggataactataatcagtaccctgtcagggaaagagtaaacagatgattaggtacctcaaacttcaagcccagaatagttaggtacttatgatgcatgacaaacagcataaatggctacaatacatgttaagtataagagatatactacgaaacacattctcctctaaattaggacactgtgataaaagccaaatgatttttaaaaataatttagctgttttttttactgtatctaagagtccccaactattaagatatctaataaatattcactttttaagctaaaagaagttattatatggctgtgtatacactgccttcttggtatcctcaaatattctggagttattaaataatcccatctaacatgtgagtcaaaaatgtgtagttcatacctgggtttcttcagctgagcaacagctgtatgtattaagtcagattcttggtcttcccaaaacaaaaataagtatcagataataataaagctgaaaaattaaggattgcacttataatatcggcctcaaaggtcagggatatgatgatgatggtgatggttatcacaataattaacagcagccaacacttttatagcacttattacataccaagcatgactctaagatcctttttttttgagacggagtctcgctctatcgcccaggctggagtgcagtggcgtgatctcggctcactgcaagctctgcctctcgggttcatgccattctcctgcctcagcctcccgagtagctgtgactacaggcacctgccaccgcgcccggctaattttttttttagtagagatgggacatgactctaagatctttataaatgtcaacttatttcattctcaaaataattctaagacataagtcactataatcccattttacagatgagaaaactgagccgcaaataagttggatagctttgcaaggtcacacagtttataagttcaaggccaggttcaaactcaagaagtctagatccagaactcagagaatattaaccacatgcaatagccttttccaatctaattctcaagatatgctaatatcccctttatcatcggttttccataaaattacacgttttgaaattcaatacaaagctatttgcatttttatcttgtacctccttctaggaaaatgccttcaaaaaagtattgcattaacaggatgagctctgcggtcaggcaaacttgccttatactcctggctctgctgtgtgagtgattgtgactgggagaagattacttcagatccctcatctggaaaatggggataacggtaccaacttataaggtgattgtgatgattagcatagtgcctcaccacacagtaagtaatctagtaggttaattattactgtaattagcactagtaatagttctatttgttctaaatttacctgtttcaaagtgaaaaatgttgcttctagttccagaagactaaatttgataactagattaggccaatactaaaaagtattaaaaataaacaagagctacaataacctccaaagtaaagactgcagtggctgaaaatcattgtggaaatgtttcctaataatatattttgttagtgaaaaacaagcaccaagggctgggcacagtggctcacatctgtaaactcagtgttttgtggggccgaggcaggaggatggcttgaggccaggagtttgagaccagcctaggtagcatagccagaccctgtctcttaaaaaaaaaaaaaaaagaaaaaaagtatttttttaattagtcaggtgtggtggcatatgcctgtagtcccagctagttgggaggctgaggcagaaggatcatttgagcctggaggtcaaggctgcagtaagctaggatgatgccactgcatgccagcttggatgacagagcaagactttgtctcaaaaaaaaaaaaaccaccaaaaatacattagtcaatatatataacaatggtaactatggaaaactcttatgaaaactggttaattcttggaatttcaaatatcagaagctgagaattcttcaaaccaagaacatgacttgaaattaccaagaataggccacaagaattacatgaaatatttgcggattctacatcttgggaagattgttttgatgaataattagggaaagcaggtttcacagagggaagaagaaagtaatgcaggtggagaaaaatcactttgaaatcacagctcttcatatagtttacctgggagagggatatgaggaaatacttactagtatctggagctttcccttcagatctgccaaataaaaattcatatttggccttggcaacactctgggaatgtgcagatgcattgttcacccaaacaaatgtctctgcctgcaaaataagaacaaaacaaagacacatttaaaatacatcattaaaaaacacatcataaaacaaattatccaacatgagattggtaaaataattatgacatatgtactcaaagctatctaaccattcaaaatgaaacatgaaaagtgtaacatgaaaagaatcagaatacaaactatcactgcatgattatagctatataaaaaatgtatacatataaacatctatagggaagtcagaggaaaataaaaaggatggcttgattgggaggctgaattatggtcggtttttaaaaaattaacttaatgtaacttttctgcaattagaaaactatattttggctggacgcggtagctcacacctgtaatctcagcactttgggaggccaaagcaggtggatcacgatgtcaggagttcgagaccagcctgacctacatggtgaaaccccatctctactacaaatacaaaaattagccaggtgtggtggttcctgtaatctcagctactctggaggctgaggcaagagaatcacttgaaccagggaggcagaggctgcagtgagccaagatcgtgccactgcactccagcctgggtgacagagctagactccatctcaaaaaaaaaaaaaagaaaactgtattttgtttttaaacacatcattttccaactgattatcatcacccacagtccataacaagaatatttctttgtgtggcttctgttaaagtacaccaacaaaaaaaccagtctttccccaaaatagatcacatttttatataatcaggaacaccattcagccgaacagggcatggaacagaactgccaggcatcccatttatactgattgtcctacatttcaacatctgtcccagggtcctgtgtaactcctaaattcccttatttgaaacaagaactacaaaggtgatggtgaaagtggtacatcctaactctgaactcctaagacctccttcctcgctgttttaggcaactgtcaaaaatcaggagtgtctctgttctccggctgaggactaattaaaaacaagtagcaaggaaaaaaatttcaagacacaaagaaatttgacctagcacagtcagggacgccttcttttgcctctttactatgaacctaaacattaaccaggatacagatatcaccggtactggtttctacccactggttatgagacatcatcttttctcatgtctgaacagtgactgaccattcactttgggggagagaagcgtgaagggttttaacagcaacgaagtaactatttcaaagagggaaatgttagtatttctattctatgctttggagtagaaatgactgacaatactaggaagacccaatcacacctccatcaccccactggagacaggttcagggggcagaccccactttgttctttaataccaagagctagcgtgcacaacattcagacagcaatttcttaaaagagctccacaatcacttaatgttcataacgcgtcaaatgtatcggtctgaaaaaaggtgcatactcctcttggtgttacgtgtttgataatcacaggttgttaattatccttttccccaatagagaggaaatattaattttttgaagtgtttggggagcttcaggctagtaaaagaggaactcggccaaggggctgccacgtaaggtgccctaatttgggcaggtggttagggaaagctctctgagaaactaacgcctgcagagatgagaaatatgacaggctggggaaggtcagcgacatattggcgggaaggccatacgcatggccttaaggaatggaaggatggatgaggctactcagataactaagagaaagccaaagtggccacagaagagcaagtgagtgggcaagtttagagatttgcaggatgaagagtgtagctcaaggaaaggacggagcattttgatgggtttgatgggaagccactgaagcgttttatgggatacagtgattcatttgcattttaaaagattattcatttacacttttaaaagatcatatgggtgttatatggaaaatgaattggagtgagacaagaagcagcagagatatcagctagaaatccaaacgagaacagggaagtttggaggaataggcaaaagtggatgaattaaaatatattttgtaggaagaattacacagttttctgataaactggatttaaagaatgagggaaaggggccaggcacagtggctcatgcctttaatcttagcactctgggaggctggggtgggcgcaccacttgaggtcaggagttcgagaccagcctggccaacatggcaaaaccccgtctctactaaaaaatacaaaaattggccaggcgtggagccatgcacctgtgatcccagctactcaggaagctaaggcaggagaatcgcttgaacctgggacgtggaggttgcagtgaaccgcgatggcgctattgcactccagcctaggcgacaaaagcgaaaatccgtctcaaacaaaaaaaaaaaaaaaaaagagggaaaggggagattaaggttaattagaatagatactaaccacttactctgtgccaggcactgttctaatgtaatacatggaatatctcatttaatgctcagaacaatcctatgaggtgggggctactgtcatccccatcttataggtggaaaaaagaaggcaatgagaggctaaataacttttccaaagatatatagatcctagattcacacccgagcagtccaaatctagaactcgtggcattgcggatgactcccaggaatctggcttgaacaaccaggtgcatgtattgagaatggggagactagagaagaaacagtatcaagagcctacactggggcttccaagtgatgccccaaggactcactaaaacatcagaaagaacatttttaaaaaggaatccattacaggggtgctagaaaataagaaaagatgccatctatacagcaaaagtttcaagaaattccaagaagataaatttttgcttagaatctcaactttaaggccgagaactgttctctaaagcaaggttccccttgagcaaggattcttaacctcaggtccgtggggaagcaattgccaatcaagagaattctggaagttcatgaagctggggagggggtgatttacatatttatttgcatttacctttagatgaaatttagcatgttttcaaatacaaatgtaagcaacaaaccagagtattggtagcaataaccataacttgtcatcaatagaaattcatcattttcatatcatctaacagttactacagatatttggaaatatgtatactcgtccctagtttgaaatgataatagttactagactcaccattaaatcttgttatcaataaagaaacatagctttttttttttttttagagatgggatctagatatgttgctctgactggactcaaactcttgacctcaagcaatcctcttgcctaagcctcctgagaagttgggatacatatattatcataccacaaatgtaatattttggtagccaatcaaattggtttcttttgcaactctatctacattattgtatgcatttaaaatgcactattctgacaaaagatctagaattttatcagactatcaagaggagcctgctcaagactattgtttctcaaattgcaacttatgacccattagtggcttgtaaaatcactttagtggatcatgaccacatttttatatcaataagtttatacacacatatctatttaatagaatataagtaaaaataccagagcagaaaacacactgtaagataagcattgtttcatggaacgtctaagtcacacgtgcatgtgagtgtgtgtgctgagtcatgattaaaagtgtatttctcaaggttgctcatgacctaaactgttggaaacatactaccctagagtggttctcaaaatttatcatgaattagcattacctacagcaccaagtaaaacacgtactgctggggtccatcccagagtttctgatgccgtaggtctgtggggcctgcgaatctgcattttctaacaatttttcaggtgatgctgatgttgctggtacaggagccatcttctttgtgaaccactgctctcgaccaatggtcttcgtactctgttgtatatacgaatcacctggaatcttcttaaaacagaaactgagcaggttaaggtggggcctgggactccgcattcctaaaagttccctggtgaccatgatccacagaccagctttgaggagcaaggcttgaaggcgctaaagcttccgaatgaagccgtgttcaaagtacgctcagactatcacaaaagtgaaacattttttaaaagggactgctcgacctagaagtaaaattcactaaagggctctgcttaataaagtgctccattaacatactccaccttgctaaataatataaaattcattctgcttgcatttgtgtggaggctaaagtaactctatcttggaaactaacatgccatgttgacttctgattaaccccagttctgggaatgcctctgagatttccaatttatctactgtttcttgagtaatggcacatacttacagtaaatcctgcccttacatcaaattcctacctattccctccgaagcatgtgtgccccttccctagatataatccctgggtctggggtataatggcatggagatctatccgtcttgcagttgccaaaaaccacgcttctgtctgtcagttccccaataaaacaccctataacaacagtctggacctgtctgccttctcctttggtttctcagctccacctgcactggggggttattcttaccaaacaattagttattcttgaagctgtgagcccctattgatacatcctcttcccatagcaaggcttataaatttttactgatctctccaataattaatgcaggtctttgaaaactgtattgttaaaacaatcagattaatgacagacccacagaattcagactactatttcctttggcattactaactgaataaaatatattcttttgcttcatcacagttgtttttacgaacataaatctccttaagaagtatggaacatgaaacattagcagctggactgatggtcaggtgatcagacttaaatctcggctcgatagtaccacgcagtctcacacaaatgcttcaagtttgggcttcagcttccctattgataaaaagtgttactcaaatttatctctcagctctccttgaattctgaagcacaatgattcttcacacttctgaaccagcttcacagacacttcactacgggagcagtaacatcttttccttgtgataaaattacaatggcatgatccccaaaacacaccctgtatttaaagatgcaagcccaccattaaatggatgggacaaacaaaatctcaaccttacatttgatatgacttttcacatttacaaagaattacattcacgttatccaactcgcaacattaccgattataattaccaattttagacacaagataagcactactgatgtagaatgacttttttttttttttttttttttgagatgacagattctcactctgtcacccaggctggagtgcaatggtacaatcttggctcactgcaacctccgcctcccgggttcaagtgattctcctgcctcagcctccagagtagctgggattacaagcacgcatcaccatgcctggctaatttttgtatttttagtagagacagggtttcaccatgctggccaggctagtctcaaactcctgacctcaggtgatccgcccgcctcggcctcccaaagtgctgggattacaacaggtgtgagctgccacacccagcctagaatgattcttttaattaattgtttagctgtaaaaaaatcaaaaagacgaagcagaaagctacaggcaaattttagaagtaaaagtggttttcagttgatttgggaagggaatgatggggctagaggagtgaggagggagaaaaaggttaagagtagagtttgagaaaggtggcatgctccttcatttccttaattatttcaacttcagtatgattttcagagaatctgaaagcctccaagtcagccagtgagtattataaagaaaaaattaaacactaaattaaagactataaaataatatttcatgactcactcaaaactaacacttggttccaacagtcacactctgcacttgatcctgctcaatcctatctgctcccattgcccagcagaagccaggcccatggaagcagggagccacgcacaacttaagtgcagacagggacaagaagctcaaggctaatgctgcaaaaggcaacagttaggcgttatgggctgaattgtgtccccccaagatttatatgttgaagtcctaacccccagtacctcaaatgtaactgtatttggagataaggtctttaaagagataattaggttaaaatgaaatcagtagagtgtgtcctaacttaacatgactaatgtcttcatatgaaaagatgacgacaggcacacactgagaaaagaccatgtgaagacacagggagaaggtggccatctgcaagacaaagagagaggcctcagaagaaagcaacccttccaactttgatctcgaatttctactctctagaactgtaagaaaattaatttctgttgtttcagtgccctgtttatggtactttattacagcagcctagttaactattactttaggaaaggctacagattagagggcaaaaggaaaattctccaggatgacaggtaacaagcccctgctattcccttttaataagcaaaagggtctggatgagaaggtatatccttgcaccagcccacacaggaggaatgtgggtttgaagacatgcaaagttgtaaaaggaggtgaatctttcactctagccaaaaacagcgatgtataatactctaatccagtggttttcccagctgtgtacatgagaatcctaagattcaaagaagctgcctgggtatagagacagggtggctgcaaagatcaacaaaggaggcatggtgaaaaagactcttgttcactcaaccccacaccacttttgcaaccacagtagttccatttctgttttaaagattcaagttctataacaggtttatggggaagggagacgtccagtgtaaaaaggaaaaagaaaaagttttaaaaaatcactgttgtttatttctgggtaagatggcaaaataaatatacacatttgcatttgccctcatccaaagctactaaaagcacagtaaagagattcttcttataaaagcacaaacccacaggaaatagaataagaaaaatgacatttttgaagcaaatgatctagtgataactgacacaggagaccacaggaaaacctggagaaggaaaagaacaattcaatgcaccccacaagacatccaaaggacaagggaatgagggagcctggtaaactcttgaagtgaaggaaaagggagtggcttagataacagaggactattcacaaggaatggttatcaagcacttaagtcctcagatccctgcctccactacactgggagacagcccctcccctactcaggtaaaacaatagttttattaactagagagatttttcaaagagcactctggcctaggggacaccacacactactgaagttaaagataccatagcggaaactgggatttgtatgctggatgttaagatgcttagatttcttcactcaccaagctaatgaaattatggcaccctatacttcaccatgcaagcaggagaccggaagagttttcactgaggaatgcagctagaccaagaaggaaaacctacaaaattaagtcacgactctattagtaaataacttaaccagatcctcctacagtgaagcttagagcttccacgtggctattaccaccccactactatatcacattatactccttaactttcatgactatgatggttttgaaagtttcaggccagttattttacagaatgttcttcaacttgggcttatcttcatgtttcatgaggctgttcttctctttgcaccctatcagtggcacatgctttcactttgtccaattacagatcacattcactttgatctgccaggtttcaccactgagaaacctttttaagttgacttaaaaagtttaagccagccaggcatggtggctcacgcctgcaatcccagcactttgggaggccaaggcgggcagatgaccggaggtcaggagtttgagaccagcctggccaacatggtgaaacccccatctctaataaaaatacaaaaattagccaggtgttgtggtgcatgcctgtaatcccagctacttgggaggctgagcgaggagaatcacttgaacccaggaggtggaggctgcagtgagccaagattgagccactgcactccagcctgggcgacagagtgagactccatctcaaaataaataaataaataaataaataaataaataaataaataaataaataaagtttaagtcagcttaaactttttctcttagtaacgaattattacgctgtggaaaggcacttaggaactatgtaaatatcttgtttcacaccaaactttcaatttataattttatttatttttatcagaacaggctgaatttattgcttttttatttcagtgctcaaattgcccagttgggactgacagaagcctcttcaagttggcttctgtgtcttttgacctgtccccattattctctgagcatttatttactttctcacgccacagaatgttccatgcttctcttatattttccatctgccctagaatgagccattttattttaaaacaaaactggttcctttcgatgaaaaatattctttagatctaagacctcaacactagctgtgcttactgttattggagagtagctgcttataggtcagctagggaatttcagacagacacacacacacacacatacgtacacacacacattcacactcactgtggtagactaaataaaggtcctcccccacaaaatgtctacattctaatctctggaacctgtgaatgtcaccttacatggcatagcctttgaaaatgtgattaaattaaatttctgggcatgggagggctatcttggattagccaagtgaaccctaaatgacatcacatgtatccttataagagggaagaaaagaaagattatgaggcagaagagaagaaagtcatgagacagaagcatagaaaagtagagccagagataagatactacaacactggctttgaagatggaggaaggggctgtgagccaaggaatgcaagaaatgtagctctagagtctagaaatggcaaagaaacagattatcctctggcaccttgattttagcccctaagactcctttccgacttctagtctccaaaacttgaagagaataaatctctgttgctttaagccaccaagtttgtgatactttcttccagcagctataggaaaccaatacagataaacagaaatatacacaaatacacactttatatctacattatctctacatctaccttatctaataaaaaaccataagtcagctgggcgtggtggctcacacctgtaatcccagcactttgggaggcccaggtgggcggattacttgaggtcaggagtttgagaccagcctggtcaacatggtgaaaccccatctctacaaaaatacaaaaattagccaggtgcagtggtgcacacttgtaatcccagctctcaggaggctgagacaggagaatcgcttgaacccgggaagtggaggctgccgtgagccgagatcgcgccatgcactccagcctgggcgaaagagtgagactccatctccaaaaaaaattaataaataagttcacattcatatttttccataaatgtatttatgctgctttcaagtacaaatgagtcattaatgagataatcacaagactaacatgtaacttgttactccacctgtactgttcctttttagcacagatcatccaaatacactttgctctccctctataattaagactttccactataattaaaaattttttattgctgaaaaacaaagaaaactatccattccctcagtttatctggcaataaagaggaagattcaagtcctagcatgtgtagcatttttttcctttaaaaatatatttgaggccaggtgcggtggctcatgctgtaatctcaatggtttgggaggtcaaactgagaggattgcctgaggccaggagttggagactagcctgtgcaatacagccagacccctgtccaaaaaaataaaaaataaaaaaatcagccaggcagagtgtcatgcacccatagtccctactactcaggagcgtgagggaggagaatcacttgagtccagaaggttgaggctgtagtgagctatgattgtgccactgcactccagcctgggcatggaacaacaccttgtttcaacaaataataacattaaataataaaataaataaaattttccaggcacggtggctcacgcctgtaatcctagcattttgggaggccgaggtgggtggatcacctgaggtcaggagttcaagacaagcctgaccaatatggtgaaaccccatctctactaaaaaaaaaatacaaaagttagctaggtgctggggggagtgccggtaatcccagatacttgggaggttgggacaggagaattgcttgaacctgggagacgaaggttgcagtgagctgagattgtgccactgcactccagcctgcgcaacagagcaagactccatctcaaaaaataaaaataaataaaataaaataaataaaatatattataaaataaaattaaataataaaatataaatatatatttgacatacacctgcacataaacaaatggggaagatgctcgtgcttgggccaaaggggatggctcacgtatgccctacaaccagtccctcgtcccctcacagactaactggatagatattccaaaagtcagtaacaacatcaagtaaaaaagtaaaactgggacagaatgcctctcaagagtagagagcttcacggacaaaacagccaggaaacaaaccaggtagctgaaaggccccatctttaatttgtgaaggttagaaacagcatggaaaccaaagggcaaagcaggaaatggaccaccagcttagggagaagacgtcggcaaaaagcaagcctcggtcctcacccagtcatcatgcagccccgctgccagcttgtttttaattgtgtgagcacaagaccaataactgaattcatggccttgttaaaagcccctggaggtccattctcattttcccaccagctgctctcttcactctgtccatttccagtgtgaaagacgctcccctgggacaaggggaagccggggttctgctgctcctccaggcaaggggtcagggagcggcggccatatggggtggcggggggcccagagcagagccgcagtggcacgagctggcttccatcgacacacatgtgaaggcagaggaaaggacaagaaagcatgcctttaacaggttcaaatgaatcttcctttggtaaccttcatgttggacccattttcgttgtcttttaaccagatgggaagattctatcccccttctaggaaccgtgcctggcctgggcaaggttctgaattcataatacccgagggcttcttaccaatggtggtagctgctttattttttttgaagtgtgacatagaaagctgggagctagaaagctaggacggtacacattcatttgtaataaagcctcccataaaactaaagtaggatagagggatcaagtcttcttcacaactccttcactaacacagcagtaactaaagagctggagaccttcaatgaaagaatttgaagaaaattaacaaccgactattatgagttcacagcatatcctccgcctttgccaccatctcataatcagtaatgacagactgagaagacgggcggacttggacagcaaacaataaacctagtgattcaagacttcatctcgccttttcccctacctattcctgaccttttttgccttcctcaggttctggacctgtgtgcttctgataatgtttaaaattcacaaatgaagcagatagtataaatatttgcatttaaaaaataaaaacattgttaaacctttgaacacatcttactggctacagactctggattcttaacaggaggatggagctctccacgttgggagagcacttggggatttaagtcgggtcacatgaggaaaagctgaaaactacacagaactttaaaagtcagcccagcataatcaggatccctatgaggaaatcaaccagactgaataaataacattcataaatgctcctctacttctttctcaaaaaaatggaggtgggtcaggtactgagaacaatcaaaacaagtactatgcaaagcagagactacaggctcacacgaagtgttcaataaatatttttcctgaatccttataaactaggaaacctcaaaaaagccttgaaaccttggaaaaggttaggaagaagtcctacaaagaaattgcataagcatcagccttagtcacctaaatctgctttgcaaatatcatggtatctttggtcatttcagaagttccaataacttctgaaacaaagtgaaatccactctatatttttaaaaaacataatttgtcactttgacaaagagaaaaacaggtgctaaatgtgattttaaggtgggaatcatgagaagtaagtgtcttctcaccttagtttgctatatctctagttcccttaacttaaaagtgacctcttggtggcaactgtgtatttaagtgaaacatgtaatacctagaactgcaccttacaaataagacaggcaaaagattgctcttgattaagataagaatatagttatacacggtgaaaccccgtctctactaaaaatacaaaaaattagccgggcgtggtggcgggcccctgtagtcccagctactcgggaggctgaggcaggagaatggcgtgaacccaggagacagagcttgcagtgagccgagattgtgccactgcactccagcctgggctacagatcgagactctgtctcaaaaaaaaaaaaaaaaaaaaaaaatatatatatatatatatatatatatatatatatttatagttttcttctcttccaaggagttaaaccagtgatcaaacaaattaaatcaatgttattttctacttacacagtattaatcatttacccaacctacatgcatgcagaaaaaaaataatctcctaggcaaatataaacattctgaaactcatgaaatccatgttgtgatttacactaaaataacacacgaaatatttaaaataatataatcattgcattaatttctgtaagaaatacatgtcccacttaaatttcattaaaggtaaatatctccaagcaaatgatcatgagcttcatatcacaaagaaaatctgaagtcaggtcactcagtggaaagcttttggttctgtgtataggacataaatcgtgaccagatcataccaagcatttcatccctggctgttaataaatgaatattatgaagaactgtccataaactgagctcagagcatctacaaaacacatgtctgtaaggacaaggtaaagaggggcaccaaagagagcataaggtcctgaaaatataaatttagcaaaaaatttcacatcagttctcagacgaataacactatctctcgtcttgataaattttttcatcatattttaaattttaatttaaaatgatatagaaaagtaaaatacattatatgggtgcttaatactcctgtcaattaccagtaaagtcattcttcaaaatgtcatgacaagacaagatgcatcaactgcctgactttccactgcgaaattcttacatcccagcttcagggaggttctgagggcagtcaataggtgcccaatagcacctatttaaactatagctttgtcacgatactcatactacctgcaatatgaaaaagttcccattatacctttttaacttttataaagaaacaaactatttatttgtaatgaatattcaaagacacaaactattcgttgaaagccaaaaggaataaacttctcagaaaggaattgtttacagaagcatattaaaagtggttattttattagtttttttgaggaactctgttacttttcccttaacacatccatcacctcaaatactttttgtattttgtggtagcaacatttgaaatttactctcagtgattttgaaatgtataatacaccattattaaaattatattcaaggtgctctgcaatagagctcaaaaaagaaacaaacaagcaaaaagaaacaacgtattcctcttgtccaactgaggctttgcaccctctggccatcatctcccgatttcccctaccccagcctctggtaaccactattccgctttctgtttctatcagttcaactgttttagagcccacatacaagtgagaacatgcagtatttgcccttttatgcccagcttatttccttttcacttcataacatcactttgtaccccataaatatatacaactataacttatcaatttataattcatatatttatatatacataatataaaattccacgacccatttggtcactgacctctcggggaacatcaggttgttccctggtgccttgacaagagtttatcggcctcacccacacacgcaagtgatccaagaactgtcctgtgtcatgcacttgagaaagccaacacaggagacacagtatttctgttgctctagggccgagctgcaatgggttacctggggtgcttgtggataaactgctgattgctagattgaatcagattcttaggaatggagctgcagaacctgcattttgacttgactcctccatgtgattcttaggcatgctgatgtttgaggaatattcattctggaactatatgagtatacaacagagccctcaaaaagaaaagggcatggtggctcatacctacgatcccagcactttgggaggccgtggtgggaaggttgcttgagcccaggagttcaagaccagcctgggcaacatagtgagacaccatctccacaaaaaatttaaaaaatagccaggtgtggtggcacatgcctgtaacctgtagtccctgctactcagggggctgagcagggagaatcgcttgagtccatgaattaaaggctacagtgaggtatgatcacaccaccgcacttcagcctgggtgacagagcaagaccctgtctcaagaaaacaaaaaacaaaccaaaaaggaccacggaacagcagggcagtggaaagcaaggaacaaaacccaatcctctagggccacagccaccattcctacaacacaaaccacaaccacaaagtacctggaaaaatgcactgacaagttaggatttctggcttcttgagggtattttacaactgatgttaacattgttagttgcttttatcaatggcttcaaatttgtgcaattagtgaaaataattagccatgaagttgcttttggacccaaacaatcaaggaatataatactgggaaatgggccaggcacagtggctcacacctgtaatcccagcactttgggaggccgaggcaggtggatcacctgaggtcaggagttcgagaccaacctgccaaacatggtgaaacccctcctccactaaaaatacaaaaaattagctggtgtggtggtgggtgcctgtaatcctgaggcagaagaatcatttgaacctgggaagcggaggttgcagtgagcccagatcacaccagtgcaccccagcctgggcaacaagagcaaaactctgtctcaaaaaagaaaaacaaacaaacaaacaaacaaaaaactgggaaatgttccttgctacataagactgattcagtctcacaaatactgcattttcaacagacaatgcatgaactaaagaataatgggtggatgccagtcacctttgttcttaaatacagaacactggagaataaatgattcaccaagaggtgtcctcaatttcatagttttaaagacgtctacatcctactcctcccctacccacatgcctactccacggtcaatgatctccagaacttctgaagattataggcttattctttctatctttacatccataattggaacataaaaataatgtgataaactgttaactttaagaatgcttgtttgagcttgccagagacctaaaaacggacttgtttctggggaaaaataacagagctccaaataattaaattttaagtaaacttttgggattcacatgtgaaagtcagagatcacctatacattttattgatacacatgatagtaaaatctggttcaacgcggttaacagcttacatcaatttacaaagactactgatgtgactctgattacaaatccctaattgtgctgtgagagactgataacaaatcatcttgtgaacaagaacaaatgaattaaatatacaaattataggactgttagaataacagttccattatttagagcacaataatccagcaaacatatttggaatatagaaagcagattttcagagtggccaaagcatacatgtttacaagtccatgcaattaaatacactttattcaggagagcccttcgaagctcttacatatggacaatttggagacatttagttatttttctaattcttgtaagaatccaaacaacttattgaggagacgaggtgatggccagcaggtactacataaaatcgagaatgaccaccacaggtctgacagtaaaaacaaatgataaaagacaacataagcaaagataaaagacatgtatcaactgtgagtaaacatctgcaacatatatttaaatatctaatatataacaaactccaacacatcaataacccagcagaaaaacaggcagaagataaaaacagaccatttaagaaacagaaatacaaatggcgaatacacattaaatgatcttcaaccttcctaatgatcagtgaaacacaggttaaaacaaagtcaccagtttttacccacaatagtggcaatgatcaaaaagactgacaatcaattttgaaaggctatgaggaaactgataaactcctggttggggtataaattaatggtgacgcggcatgttcatatatatctgtctctctccatatgtgtgtgtatgttgtgtgtgtgtgtgtgtatgtacatacatatggtttacaaacatttgaacagatactcaaggcaacacatataaatatatcaatggcagcactgtttgtaatagcaaaagctagaaacaatctgtccatcaatatacaaatggctaaataggccgggtgtggtggctcacgcctgtaatcccagcactttgggaggccaaggtgggtggattaccagaggtcaggagttcaagaccagcctggccaacatgttaaaaccccatctctactaaaattacaaaaattagctgggcgtggtggcaggcatctgtaatcccagctactcgggaggctgaggcaggagaattgcttgaacccacgaggcagaggctgcagagagttgagatggcaccactgcactccagcctgggtgacagcaagactccatctcaaaaaagaaaagaaaagaaaagaaatggctaaataaacgataggatggaatacagtggagcaattttttaacatgaggtaaactcgcatatactgacatggatgtatgccaacatatataaaaaacaaactgaaaaaaatatgtgtagtatgacacttaagacacacatatatacatatatatgtatacactcctcacacacatacatagtacaagtacaaactgcagggttgatactcaagatatcaaacagtgacacagggctctgagcaatttcagcagatgcttgctcagtgagaatggataccagctgtattggtacaggccatttaatgtatacacttgctcctcaacttatgatgtggctacatccccatcataagttgaaaaatatcttaagtcgaaccatcttaaggaccatctgtattagccataaatattaacacggcacataaacatgcatagaaaaaaatctggaaaaaataaaaaaccaagatacctgtggcacagtggatatgaggggcccaagatttggggaggggttcaatgctgaatttgacctcatcagtaatgctttaaatttctatgagaatgtactcatgaattaattatgtaactaaaatttaatttttataagaaaaaaaaagagtagtatggaaaaagtatatcagttgaggtactcattcattttacttgtcaagtgttatgtagttcttgaatcaaatctggctaaaattttctcataaagatgaccaatgtttagttccctaatctagaagcaatcaaccatccatccatccatccatccatccatcacaaaaaagagttctggtcggagaagaataccaagggacactgtctatcatattccaatttcagtggtggaggggatgcacaaagtaacatcctgatgtagtatttgtctagcttcaagtccagtgtttcctaaacttgggtatatctgagaattccttgaaacctcaccccaaatattctgttttcgcaggcctgcagtgggggctcaagattctgtatccctgccaaaccccacaggattctgatacagacggttcaaggaccacacactgagaaacactgctctaatccaagggaattacaacattaatctttccaccctcatcccaagttcaatgaactgcatcaactttgtaagtgacgtcacgttaggatggacagacgccaaaaaaagagataacatcaaggtgcaggcagacaacgagggagtcaaataagcagagtacacaatgtgctagtcagctttcactagattagttgtggcagtagcaaatcaccttcaaatgttagtggcttaaagtgaaggtttatttcttgctcagatgttgtggctgcttgagggccaactgtggctctgctccaggtgtgggtaggctgaagaagattcccccggcatctccttcattctggaatctatctgaaggggcagcaccacactagacacctgatatacatgacgtctcttttgtgtttttagagacagggtctcactctgtcacccaggctggaatgcagtggcacgatcatagttcactgcagccttgaactccaggactcaagggatcctccctcctcagcctcctgagtagctgggactataggcacaccacagggcctgtctttgtctattttaataatataattgttaatgttgatatattttcattttggttacatatatattactttcttggctatataaaagtttatgcataacaattattcatttatcaattttttactattatagtgttgcaacaatcaaccttctacacatttctttacattcttttctgattattcgtttatgaaaatctcctagaggagacaacattgagatcaaaggaaatgcatattcaatactcttgatacacgttgctgagctgtcctccagagaggctgtcccaggagtggacagggactgtgttttcagtcatgtctgaatctcaagccaaatcatcgttcttagcatattttatttatttatttatttattttatttttaagacggagtctcattctgttgcccaggctggagtgtagtggtgcgaacttggctcacttcaacctccgcctcccgggttcaagtgattctccagcctcagcatcccaagttgctaggactacaggcacatgacactgcctcggctaatttttgtattttcagtagacaatgagtttcaccatgttggccaggctagtctcgaacccctgacctcaggtgatccacctgcctcagcctcccaaagtgctgggattacagaagtgagccaccatgcccggcctatattttagacccctaatcaactgaatgaatggaaggaagaaggaagctgaaagaaaaagacttttctgaggaagctgtatgatttaaggaaaggcagatcactggagaagtgtaaaacacgcttagaaaatgagagctaggcccgttcagcagattgtatcacatgaaggaaggctgaggagaatgaagtataagagatcagggcttctcaaactggggtgggcatgcacaacactggtatcccgctaaaactctggttctgatccagcaggtctggggtggggcctgacagtctgcatttctaacaagatcccaggtgatggtgatgctgctggtccatgaacttcactgcaaatcataagaaagtagatgattacactggagaggcagattctctctaaaaagtttccaatgtcaggctcaagagtttagagtatatttagttggtagtcaatttaaggaaaggggtgtgatgaaggtttctgagcaagggagacctaatcaccttaaaagaatcagattaataaaaatctttatatacattaccaaccgagtcttgcttagaggaccacttattttgttttgtttttgtcactttaatattttctcagttttggtaaatatagcacacaaccttgaggctattttagcaaagtttcagtgctttacatatatccctctctagcttaaaaatgattgttaataacagaagggacaattaacaaaggatccatggtttggcttttcctggcctccctacccctaatctcctctgacctcatcagctgaggccacaccccaaggctcctgggtgttgctttctcactgtttctggtggcaaccaggactccagttggggatcctgtttataaaaataacatagggataaccaagagttacatgcccccatcacttctcctctcccaagatgaaatcttaactacttattcagtaagcagtgactgccaattcttggggcatctatcacctcaacacacctggatttaagagtaaacaatcggctgggcatggtggctttcacctctaattccaacactctgggaggccaaggtgggcggatcacaaggtcaaagagattgagaccatcctggccaacacagtgaaaccccatctctaccaaaaatacaaaaattagctgggcatggtggcgcgcgcctgtagtcccagctactcgggaggctgaggcaggagaatcacttgaaccagggaggcggaggttatggtgagcggagatcacgtcactgcactctagcctggtaacagaacaagactccgtctcaaaaaaaaaaaaaaagaataaacaaccacacaggaaacaacagtgactgtacaatgtgagcaatgacttcaactcaggcaaacagtgaaaggtaagaacaccctagacagaatccacgggcccaacagctaattccacatctcatccatctctgttccctccagtcactagcattggaatgctgacagaagatggccagcatttgctacaattctttcacctattccattacagcctagacagggagggctgtaaaaaaagactcaggaataaggtaggcagaacggcctcagtaccttatgtctgggcattttgccaacatcctctcagatcctgctcatctagaacacagcagtttccgaggttcttatgaggctctctagcaggaagccactgcttgccaaagctcatgagatcaccaagttaataatgaatgcacttgtgggtggggtgaagtgtggtgcagctagcatgactgagacttcaaatgacctgggctgtgggaaatgagtcttggccagaacacttcagatatttgccacagcacgctcatacactgttagagtgtaaggaggtataacctttttcgaagataattaagctattgctaccacaatttgaaacacatatgcccttttatccagcaactcaactcttaataatttattccacagacacataccaaagaggaaggtacaatgatgttcatttcagcaaaatatgagaacttaaatgtcatcaagggcctggctaatatacaaaaatataataaaatataaggtagatattaaaaaagaatgagaaaaaccttgtgtgctacactgaaactaccgccaagatatactgttacatatataataatgtatgcatataatgtatcatctacataattatgtatgcacacaaacacacaggctaccctctgttaacagagattgtcttaggggaactgggtttctgaggttagagaaaggcctttgttttatagctcctgcccttttgttttatttatttatcatacacatgtattactatttcccttttttgtttactttcttttgggggaatatctatttatttacttttgggttcccaggacatagattctttctgagcactcaaggaattacagaaaacatttacaatgaaaaatgcaggtcaagctagcaagattaaatgcaaaaatcttaagatattagcaaagttaattcaacatcaaaaagataatctatcatgaccaacttggctttatcctaagaatgccaagctgttttaattttagaactcaatcaatataatttaccacactgatagatgaaaaagaaaaacccatatggttagcagaatacatgcataaaattatatgcaataaatgtgaatgtcaatttattattttaaaaataaccttagcaaactaggtatacaaagaacttctacaaatctgcttaaagcactattttaaaaaatccagaataaacatcatacttaatggtgaaattttgttccaataagtcctatatacaaacaggatacagaggagttaagtggtgttttttttttttttcttttgagacggagtcttgttctgttgcccagggtggagtgcaacggtgtgatcttggctcactgcaacctgcacctcttgggttcaagtgattcttctgcctcagcctcccaagtatctgggactacaggcacacatcatcacgctcagctaatttttgtatttttagtagagacggcatttcaccacgttggccaggctggtctcaaactcctgacctcaagtgacccgcccgactcggcctcccaaagtgctgggattacgggcgtgagccaccacgtccagcttaagtggaggttcttaatccctttctgaaagacgatccctttaatatatcttacatatcatttcagggtgtttcatatccatctcccttccgaacatccaaagccagaagatgcatgaattccaactgaaaaagccctggggaatccattctccagcactactggattcatactaccaaaataacccgctgtacactttacagcattttaaaaccttcagcgggtcctcagcctacaaaataaagctcacactctagctctgcacatctgactccagtctcctattccaactttctctctcattgctcacgacactaagcaacggtgctcatctccttggtgttcatgtcctcggtatttaatgcctatgactccacccaccttgcctttctgcccacactcacattccactaagagaactgggaatcaagacattacttttattactgataaaagctgactagggaaaatggctaaagatcagtgacaagaattagccagacctccccagccagtcactggcacagctagacaaactcaagccacgccagcaaggccaggtctgttaacacaaggcagaaaaggctgtagtacagaaccagctctgaacagagaggccctgcagtgccgagctgaggatctccttcttacaaattcaccaatcagataagccactctttttcccattgtggtccctcaggctggaaacatgaggccagggaaatgtcacctccttcactaatattcaatccttgttttcaaagcacagtacaagtcccactccaacctgaaaaatcattccatccccagaaaaattacccattatcgattccttggaattcctagggaacctaatgcctgggcactgttttgattcaacatctacaataatgtctcgtatactgatagcagtttctctatcaagaaaaaccgagtccctgtctagctctctgaattctcatcatttagatgcatgctcagaacaaagacgatgctcaactatatgaattttgaaaaattatgaatgtcagaatgcagagtgtggtctttaataggtaagaaggaatcttaagaaagagaacgcatgaccaaagaagtgtcttctgaagatgagtaatcgatggcatgtctgattagaatacaagacacagacacaagacaagagaaatggcaataaagaaaactattatttagatgtgatttagaaaagggtcctcaatatcagagtaataaagcagaaaccataaaataatagaaagctgtccaacaaaaaactgaataaaaacaaatcaagaaaagaaattaggaaatgcgtaaatgtactaagggtcacaatagatcaccagctgacagtaaactgctgcttagtgacattgttcacacaacagggctgttacagatgggaagtagtaagtcatttttacactttctatgtataaccaacagatcccaattagatcctaactgaaaagaataacgaagacaatttaaagagctgaaaatgaggcttctagaaggaggaaaacagcaatttatttatttatttatttaattctgagggggtaatcatactcttaaagacaggctgggcacagtggctaatatcggtaatcccaggactttaagaggccaagggggcagatcacttgagcacaggagtttgagatcagcctgggcaacgtggtaaaactccatctctacaaaaaaatacaaaaactaggctgttgtggcactgagcacctgtattcccagctactcaggaggctgaggtgggaggatctacatgaacccagggaggtcgatgctgcagtgagccgtgagtaacagagtcactgccctccagcctgggtgacagagtgagaccctgtctccaaaaaaacaaacaaacaaaaagactactggtgaaagaaaaagtgcaactagacagtttactactctactgaaaaacagagacattcagtaacagagaaattttacctaaatctgaagaactcttaatagaatcattgttaataaagtgatggtggaaacaacactcttttttactttgacaactcaatacttacgagtccacagttactaacacaatgacacagcaatatagtacacaaagaaggttactagtcaagctacttaagacaaggaggacaaaaataacagaagagccataaaaataaatatatgcaggctgggcgcggtggctcacgcctataatcccagcactttgggaggccaaggcgggcggatcatctaaggtcaggagttcaagaccagcctggccaacatgatgaaaccccatctctactaaaaaatagaaaaattagctgggcatggtggcacatgcttgtaatcccagctactcgcgaggctgaggcaggcagaattgcttcaacccaggaggcggaggttgcagcgagccgagatcacgctactgcactccagcctgggtgacagagcgagactctgcctcaaataaataaatgcagaaggtatttgtagatataaatattcctctaaagaggtatttaagattaccataaagatattttatttgtcctgagtcaagaacatgataaatcagatataccgcctaacaaaactattcctaaatcctggccaaaagtatgtgtgcttcctccactacatagcactcactccctccagcccataaaggacatcattaattgatggcttgctttcctgcgaaaaccatgtaaaatctatgacatcggctttcactttgcaaaaattttatatttaaaaataatgaatcccagcactttgggagaccgaggcatgcggatcacttgaggtcaggtgtttgtgaccagcctggccaacatggtaaaatcccatctcaactaaaaatacaaaaattagccgggcctggtggcgggcacctgtaatcccagctacttgggaggctgaggcaggagaatctctcgaatctgggaggcggaggttgcagtgagccaagatggtgccactgcactacagcatgggtgacaagagcgagactccatctccaaaaaaaaaagaaagataggtccattgcaattcttaaaatcttgttgtagactaaagttatcaacagagaagaaaaggaaaataattgatgaaataaatttaatagcttgttgtaaataccacgaattgcctttaaaaatttcctcaacattaaaaaacttagaaatctttggctttcattaaagttgggaatatatgacaacacacacacacagcaaaaggtatttttggtgggaggaggagataatattttggaaaaaaaatggcaaactatattgctaatgcagctccagtgaaatgcctttttttacaaagtaaaaagatcagtgttaggttgagaatgggttagagttattccaattcactatcaagctctaattccctccacagcatcctgcccagaagtttaaatacctcctcccactgtgaagaattaactctgcctagagagcttttgttgttttaaatcttttttcttaaaaaaagaaagtcatgcatgactatatactatgagccaggcaatgggctaacaactttatcttgccacactaatctttacaaccacctgaagatctaggttctcttgtcactcctatcttgcagataaggagacacagaaaggttaaaggtcacgtcaggccattggtggaaccaagatatgccatggtccttggaagagttctttcagcctacacaacatatgtattagtccgttttcacgctgctgataaagacatacctgagactggggataaaaagaggtttaattggacttaaagttccacatggctggggaggtctcagaatcatggtgggaggcgaaaggcacttcttacatggcagcggcaagagaaaatgaggaagatgcaaaagtggaaacccctgataaaaccatcaggtcttgtgagacttattcactactatgacaacagtatgggggaaccgcccccatgattcaatgatctcccaccaggtccctcctacaacacatgggaattatgggcatacaattcaagatgagatttgggtggggacacagagccaaaccatatcaccatatatatttccatttactaaaaaccacagaatttgacttcctgaatttgtgtttctaaactaaaaatttccttcaaaacttttctcatgcaaataccagagcctctgacgtttctgtggactatggattcccactcaagaatcttagcattttctctttttttcttattttatacatactcgactcgccaactaaattgcaaagcatcaacaagacaaatccaattttcttctctcaaaccgattcagaggggtaagcagagaccaccacagtgtttaaaaattagaatcactgattagttccttacatttgtcttgcacaagaatttctgctatacaacgctagctgggagaaaataagaaatggggggagagaatgaatggccaacagcaatgtttcaggtataaataatttattaacagtactccaaatttaatgaaatagcaatattttaagactttgttcatagttaaaatatagacaccacattatcgaaacatgaagcaaatatgtcattgaaaagagtgagaggtataatgcttgcccaaacagatcagatgggtcatttaccctacatattctatgcttatcttgcttacttactgtctctctgtgaatgatggtgtttgtttcaggtaatttagccccagtaggcaggctttcttcacgaagagaagaaataatgtcttagtaagaagacagcgcacacatgcatagtttctacatatacttgcctatatttataggcaaaatacctcaattaaagtaagagttacaagaaacaccattctctaaatctaatgaataactcgggttttttttgtttgtttgtttctgtttttgagagtgttgctctgtaaccaagtctagagcacaatggtgtgatcatggctcaatgcagcctggagttcccagactcatgtgacctcccacctcagccatcccagtagctgggactacatgtgccaccatgcctggctaattgttttaacttttttttgtagaggtggagtctcactatgttgcccaaactggtctcaaactcatgggctcgagtgatcctcccacctaggcctcccaaagtgctgggattacaggtgtgagctacattgcctggccattaataactcttgttacacaaaactaataaccttaatgacttttttttgcacaaaactaatgctttactccttaaaacctggagcattttttttttttacttcaaagattgtgttgcctcagaaccaattcacaagagaggcaatgattatctccttaaagtgtggtctcatgaacaaccagctactcttgacttctttatggagaggccttccttgatctccaaagctgctggaatgtcctgagtggttccgaactgcctaattttccccagagaggcacaaaagatcctgcgtctaccactgctctcaactcgctcaaagccagtggcctcctttttacatccaagccacccttttacttattttgaaactcaaaggaagtagattataaacaaggtggcatagatttgttcacagggctatatttcaggaactataattatttgtgtggccttcaggtcagactttttgcttttacagctctaaaatgttatttgtttaaatcccagccctaaaatatttaatataaactattaaaacaccatttgcatgaccaacttattcttcactgaatctcggctcataaaaaggttcattcatgttaaaaagctatttttaaatgcggctaactcattgcttagaatatgctaacaattaagcattatacttcactggaatttttatagtttaaaattatatttctcccatctcatttcctcccccaccaattctgccatcccaaatagcaacattattttaaactttgctgttttctatgacaataacctcattcactggtcattcagaaataatgtccttctgaagatgctggcaactgactttcacactcagttatatgtcaggttttggctacctaaagatgtatgagcacatcatgccaaggcccaagagaagttcctccagctgaaatcaagggaataggttgcgcccttgaggaaccagcgtcccctctatggagccattcacaggctgtgctggtaaggccttgttctctcatcccattaccccgttcggcgggggtgacagtgacagcaagcatcacacacgctagtgagaaaggacccatgcccggttgccactgtgaccatttactactcaagtagagcacaaggtttaaacaatgctctcaaaaattacagcctagagttattgaaaaagctgagtccccacagatagactcgaagctgcaaaatgcagtaagtggtgtacataaaaagtgtccaatccaacaagctgtaggtcaagcttgcaagattctggagatggatggcaagtgaaaacatgtgaagccaacaggcccactcttgattttgacacgtggatattttcacacccatgagatggatctgaagcttaatacagaattgtaatgcgaaaagcaacacgtgaacaaaataaatggacacataacagcagcgtaaatgccaggcctgagttaagctcctggtaatataacacccggggtttgggcttttccgtgcccatttcctcttgtgagtttaaggcacattactaaaatgatctcattaatcctcacaacacctgatgaggggagtaggcaacaaatattttaatctcccatataagatggaaaaaacaaatcaccaatgtgctgtataacttttcccaggattacagctagcactcagtcagagaaaacagtcgacttgaatctcagtaaagagttgactataccaggctatttgaaagaaaatgctgctcactaagatggatttcttaattaagcagctgtataccacatacattccaggtggactgccattccacttctcacagagtttccacacctatactaggctgtcaaacagagtcatttttcaggccaggtgcggtggctcaggcctgtaattccagcactttgggaggccgaggcaggtgaatcacttgaggtcagcagttcaagaacagcctggccaacactgcgaaatccccatctctactaaaaatacaaaaattagctgggtgtggtggtgcacgcctgtaatcccaactactcgcaaggctgaggtaggagaattacttgaacctgggaggtggaggttgcagtgagctgagattgcaccactgaactccggcctgggcaacagagagagactgtcttaaaaaaaaaaaaaaaaaccaaaaaacacaaatagagtcatttttaaaaatacttccctagacctcctggcttccagttatgccctacaactgttcttctcaaacaggggactcctcagatccccagggtcacaaaccagtgtgccccaggaggacgcaacgtttccggaccaacgggcacatcttcttggggctcaatttgaatagatggtcatttaaaatctgattttgatatttaaatatatttttaaatgaaatgcaaaattggcataaaattttcaaattagtcttaaaataaatgatacctaaaagcatgctgctttaggagatactcacaagcaaggcttgggtagggggagaagggatggtaggtgcactttgctattaagtgtagttcagggaaaacatgtccaaaaacagaacaaagcaacttaagaggaaaaacaattccaatctgcttgcctggtccaaaccattccaggcagacaggaacatttcctgccataaaagcttttacttggctttcttttcacgtgggctgtaagacctatcagcatggaatcccacttaggattttcttttttctttatttattttttttttttgagacggagtttcactctcgttgcccaggctggagtgcaatggcatgatcttggctcacggcaacccctgcctcccaggttcaagtgattctcccgcttctgcctcccgaatagctgggattacaggtgtgcaccaccatgcccggctaattttgtatttttagtagagacggggcttctccatgctggtcaggctggtctcaaactcccgatctaaggtgatccactcccaaagtgctgggattacaggcgtgagccaccgcgcctggccaggattttctattaaaaaatcttaagattactagtagtaaaatgctatttccatattaaacctgacaacatcaaagctacctattgactcacttaactatttccagaaagcccagcagataccagacttgccctgctgaaggcctttatgagctggtccacaaaacatcttagaacctttgaccatcagggtagggttctctttactatttcaaccagaaaattagaaaatcaaggaaaggcaaatgacctcagatgttggtaggaggaattcctttatatttactaaaaatatctactagctgccaaaagagtcacatgataaagttggtaaccagaaatggaggcatgtgaaagatacacacaggttatcaggaaaatcaggtgacggaagatacaggcttctcccaacacagactttttccaagtgctcagaattagaattgggtatcgagggcccattcacatattcctgggagctgcgaggagaattgcttccaatatccaagttctacaaaaggctagcaaaagatccaaacctaaaccaccaaaaccagactggtaactgctttgaggaactcactgagcactctgaccacagcagacattcatctcaagctcctcacggtggctccagatttataaacagaaatttatgtccacatttctatagttcctgaaattgccagagaaggaaattctgcacacgcacacaaaactgtgcaccacttcagggcagccactggcttcaattaagaaaaccttatgtttctacccaacatctgagattctccaactcagaaaacctccctgcaagtccaattctgactcatcaggattctctgacactgaggcaaagtttacaggagaccataaacttttcaagaagactttaaactttattttaaaagcagaatgtgtatatctaaatcaattgtcctcgttcaaatggtcaccttagaaaaccacacacgttatttcaaggaatcctgagcaaatcatttggaattcctattctgaaagaaccttcgacgccagttttcacatcacacgatgcacgcttctttatagacatctcaagactaaagaaaaactatttcccagcttgctgtcacctagcttgcagagcatactttaaaatgttgtggcctgggccaggtgtggtggctcacgcctgtaatcccagcactttgggagaccgaggcaggcagatcacgaggtcaggagtttgagaccagcctgaccaacatggtgaaaccccgtctctaataaaaatacaaaaaattagctgggtgtggtggcatgtgcctgtaatcccagctactcaggaggctgaggcagaagaatcgcttgaacccaggaggtggaggttgcagtgagccgagatcgcgccactgcactgcagcctgcgtgacagagcaaaaaaaaaatgtctccaaaaaaaaaaaaaaaaaaaaaaactccacccacaaaaatataaaggcccaacaccactggggatacgtttttaaaatgcagtgggggatatgaagacaattccaaagaaaaaagatttagtagcatgtattgagttattataacatcacagaaataagtatatagccttccaaagtgtctactatgaaaaggaaaatattcttttaaatctttaaattacaacataaaacatattaacttaataaacatttcttgaggggaaggaggtaatattcagaaatgccttccagaatgacttaccttactggaatctactttaataacagctgtaaagtgcgaagcagtcacatcataaccatacattctcttaaaaatccctctcccacaaatattcgttgacaaagtgtcctacaaagcacatattgtcttaattcaaacctgaaaataagacatctaaatttcgatgcaacagcagccagcaataaaatgactataacattagcttcacgttcaattgcatagaaatcaacggtacaccataaatttgtgttaataaccagaaaagttctgggtgacaggggactctgtaatgacagacaatgtatgcatgttttaggccttgttaaaaaaattatgttataccaacaactttttattagtggccatttctaaagagaggtcatataccttctttgtttagcaaaataatttaagactacattaatgaaatgcccttgatcttttgaatgttcatctttaggtaaattcagtattcaaattactatatgggatgtttcataactattagccttggctatcttactccacagacctgaattcctgtaaacatacctgtaagttaaagtaaacccaaggatctttcaaagtccaaaaattctagtcacgaggagcaaatatttaggaggaaataatagttccatcattatgggtctgtagacacaacagatacatgttctccatataaatatttaaaaaaaaatctccccacaagggattttttaaaacagtgcgcaaaatacctatagctttaagaattttaaaagtttatgtatattcctgcttgcacagtaaaattaataaacactatctagttttttgaagaaagaaagaaacgctaggtaaaaggaaaaacaagaaacaacctcggccaggtgcgggctcacacctgtaatcccagcactttgggaggccaagttgggcggatcacgaggtcaggagatcgagaccatcctggctaacacggtgaaaccccatctctactaaaaatacaaaaaattagccgggcgtggtggcgggcacctgtagtcccagctactcaggaggctgaggcaggagaatggcatgaacccgggaggcggagcttgcagtgagccgagatcgcaccactgcactccagcctgggcgacagagcaagactctgcctcaaaaaaaaaaaaaaaaaaaaaaaacaaagaaaagaaaagaaacaacctcatttcccccaatatatctaattaccggcaaaccaacattccttattttcttttatttgcaattcgatgaattccctaaaggtctggaaaaacttcagcatttctaattagactgtaatttttctaccagacaatcagacatagtttcacctttatacaacttcccatgtcctaaatgccaacatcctggcatgctccccgtccatcttccttctcttaacagcacctgttttgaaaaggtgaaaacatttagtctttcctagaattgtcctctgaaaatcaatcagttaaagatgagaggtctggatgcggtggttcgtgcctataatcccagcactttgggaggtgaaggtgggaggaacatatgaggttaggacttcgagaccagcctgaccaacatggtgaaaccctgtctctactaaaaatacagaaattagctgggcgtggcggtgtgcacctgtagtaccaactacttgggaggctgtagtcccaactacttgggaggctgagacaggagaatcactagaacccaggaggcggaggttacagtgagccgagatcacaccactgcactccaccctaagtaaaagagcgagactctgtctcaagaaaaaaaaaaaaagacaaaaaattcctaactgccacataaatagcaattatccaccccagggaatgcattccttaatgagaccatgcagacctcacatgtgcttaggcaggaatgaaaaaaccccagaatcctaggccacaagtttaaaacagtcaaataaggaccttcctatgtagattacaaattaaaaacaaaatggactcaagttagtttaggtagaaaaggtgtgtgtttactggcaaggtttggggaagctccctgtctctgggagggccggacacccaggctcaggcgggaacaagcagggcaaagctcagccaaggtcctgccacaccacaggctgaccgagtcactgcagccaccacggcctcccctcagtggacagtcccctcccatgcgcctgggctctggaccctgaatactgtcatgaggacaataccccatcaactggcctagctggccccaagagtcttcacaaacagaaccactctcctgagaaaataccagaatgggtggggctgattgtgctcagatcacaggcccaatctgatggccagaggtaggggaatgaggctgcagcccccgggcttcagcacaaggagtttgagtcccgcctcacatctgcctttgagtccctcaaaaaggaaggggacctggcacataaaaagataattctgccatggagggatgtggaaaataggattcggagggtcccttcctgttctaaaatactataaacaggccaggtgcagtggctcacacctgtaatctcagcactttgggaggccaaggcaggtggatcacttgaggtcaggagttcaagatcggcctggccaacacagtgaaaccccgcctctactaaaaatataaaaattagctgggcatggtggcgggtgcctataatcccagctcctcaggaggctgaggtaggagaatcgcttgagcctgggaggcagaggttgcagtgagccgagatcacgccacagcacaccagcctggacaacacagcaagactgtcaaaaaaaataaaaataaacaaaatactataaagagtcagatgaagatttaatgcctatcatcctaaacagaaaagaaaggtatgactcttactaattcaaataataaggaatgaatagcctatttcctcaatctattttcatagagtatgatctgatgaaagctattcattaaaacaaaccaaatagagtgtccttctgtcaactaggctcctactttatttatgtacttccagatccatttgtctaatttccacttgtgaaaagcaaatggaattgattttctgcaatgatactaaatacaacgctgttataatgttcagaacaggtaacaggaggggagcagggagtctgtaagagactgccaggtgcaggaataacaaacagacagatgtgatcaaagagcagcagttatcacagggtcagattttgactcaacatagctaattcctgggaacatttgaaggaatccaaccccggaacaagtttcacaacaaaacagtacctccaccaatggaggcagccactgctaggaagagagcaatgtgctgaatgtgttccccccaaattcatacattaaaaccctaatcccagtatgatggtatctggaggtagggtcttcataaggtaattaggtcataagggtggagccctcatcaatgggatcagtgccttcataaaaataggccagaaaactaggtaactctgtttacaccatgtaaggacacatgtaaaccagaaagaggacactcaccaaggattctaatctcaaacttccagcctccaggactgtgagacacaaatgtttgttgtttaagctacgctgtgtatgataatttgctacagcagctcaaactaagacacacagcatggaaagcatcactgggcaagtaggtaggctggctgggccacccttcaaaggtcctgtccaacgaggttttaaaaaaatgattttctagattctgaaacaaataaaagctgaaattaacaagacaaaacttcgaatttggacaaaaataacagacccaatataggataatgtagacctgagtcttgggggtttattcgatggactacctcacacaatctgcgattccactgtaagggcagtgtccggcacccaaaatgcttggaccatctgggggttctgagttcatctccaggtttcccattttgaaaagaacactgacacgtgaaagtattgagacaagggtgacaatgatgaagaggcaactgaaaaccccctcaagatggggatgatgacataagaaaagaaaagggatctagatttgtctgcttaggctgctataacaagacagaagactgagtggcttaagcaacagacatttttctcaaagttctgaaggctggaagtccaagagcatggtgccatctgggttggattctggtggcggccctcttactggcttggagacagccaccttcttgctcttgtcctcagatggtctttcctgtgtgtatacactctggtgtctcttcctcttcttggaagaacaccagtcctactggattaggggcccatccttatgaccccatttaaccttaactacctcctcaaatgccctacctccaaatacagtcagcacactatgggttagaacttgaacatgtgaattttagggagatacaagtcagttcataacaggactcaatcctaagtatatgaaaggccatatctgaaaaggataccaattggatctctattgctctagatggcagaattagacatgaagtgggagtattagagttggactagatgaagtttaagcttctttcattctgctgttattattaaactatagaatatgagttactaaggacttactatgaaccaaactttgtgctgatcaaatctttctgtccattctgaggtcgatactgctattatgaccatttactgttctttacaaatggaggcctgctcttgcacagtgtcacattgctgttaagtagcaggacaggatcccagaccatcacactccaaagccacccaatctagcttttaaccattgagtagcctacaatacaaatgataaaataactccatttaccaatagaaaatcacacagaagaaaacgaaaatactaataaccatattaccaccatcatttatttttctatgtaccagttctctccatagattgtcagagttaatcttcacttcaagccaaggtaggcattattatgcccatgttacagataaagaaaaaggctcaaaaagccttcctcaaactcagacagtgactaaaaacatgtggggaacaggattcaaaccaacctctgagttatttcaaatgcaaatcttttatgtcaattacaatgcactccaactaggctctgacttggctcaggccctgggatctgatagacttcaaaatcctctgaaactgacatttcccagggagggccacatagaatgcagacactgcctttaagagagaaaaagacgcaaggagagcaaattctatgaaatgaaatcaggctttccactaccaaatcctgtgccattcggcaagaactcagggagccccactacgcgctagtcccagggaacacacagagcaacaagcaaaaggaaaccccactcccctggaccctacattctagtgcagggagactgaaggaaccaacctccaatataacacatcaagtcaaaaaaaaaaaacaaaaaacagtgaaggggcaggggaacaggggtggagggttgagtgctgtttcagaatcaatgatcaggctgggcttgggtttaaactgctgcaaaggagcacagaagacctgctagctatacatccagcaggtcctgcagtcttgactacagcctggtatttccttgcttttcactggaggaaagggtggaccgcagtgctaattacaaacaggtcaaagggaaaaaaaaatacaaaatctttttccttgaccagaagggaagcagttaccatgcactgttgccatggcattggagaaagagaaaaagcgacattctaagtaccagagtatgaaaagaaacacaacagtgaggaaaggacaagaggctggcagaggtttcactccctgcagtgctgaggcctgctgggtggcaggtgggaagcaaagctttcaaaagggacaagggttggaagggtggggaagaggaaaagctcagagctattaaggaaaaggtctctgcctagtccccccgttttctacatccctaatatatcagggtacttaataaaatagttgcagaaaaataaaaataaaagaacaccaagtttctgaaatgcacagaataattctagataaacattttctgaaattttttttttttttttttttgccaatatgtaccataggcttcagccagctaacttactactgatgtgattctgtatggctcaggagtagaaggctataattggtgggatggaaggcatatgctaaaagtcacgcagaagagcgtttgtagccgatttctgccatttacaactatggaactagagataagtcacttggcttacccaagtccctcattctttatccataagattaaaatagaaagagtaaaagagataacaagtataaaggttgacttatgatagtaaattaataaacattcattcctttcctgcaacagttccagtatcttttgctctaataccatcagtgttgggaaggttcattccactgttagataactgattttacaaaattttaaaaattgcacatatagtcaaaatccttcttaaggcatgaacaggcaattcacaaaggaagaaatactaactgcaaataaacatatggaaaatgtctcaatgctaactcataaaaaaaaatacacattggccaagagttttaaaaataatattatgtaatatcattggttattgagaaataggcaccctgacataccctgatggtcaacctacttttatcattcttctagagagacagaaaatacgaatcaatgccttaaaaatgtatattcccttccatccaccatttacacttctaagaaatttccagagaaaataataaatggatgctcttgacagcattgtaatgaaaaactgtaagcaacaaaagtcccaccattcacataaactataatatcaccataaaatgtaaaatacagtcattaaaatgcttatactagaaagacatttgcaatgcataggagaattcaaaatctaatttctttattttacagagagcttataaaaattattaaaaataaaactatccaataaaaccacgaagacagttcacaaaaaaagaaatacaaatgcccaataaagatacattgtataaccttattattaaataaattacaaattacattgaaatactatttttcaccaattaaaaattgtagcatctgtgatacccaggactagaaaggtacagtgacacaggcaatttcatacccttgtggtaggagtatatgtggacattactaatgtttaccaataccaaggctttctccatctctgacccccttgaagctgggaatatgtagttagcagtagccaagttccaaaagggtccaaatcacagatttcacttactacatgacacaagaactatttaacctcattatgtcttaatgtcttcaaaggtaaaacagggataataacaataatctacctcatagggatattttgagaattcaagcatagtgcatggcacgcagtattactaataataatataaatcacagatcgtactatgtagcaggcactgttctatgcatttatccatagtagctgattttatcactcaataaacagtaccattagtatgacaatattgccgcattgcttgtaattgcaaatatctgaaaacaatcaaattgtccatcaatagttaaggggacagttaaaccaaagtatacaaaggacgtatatgtggctgttatagagaatgaggtagttctgtacatgctgatagagaaagattttttaaaaaatagagaaagactattgtttgactttgtttttaaagtctaacggtatgagtgtggttaagaaatggtgggtggatcatctgaggtcaggagttggagaccaggctggccaacatggtgaaaccccatttctactaaaaatacaaaaattagccaggtgtgctggtacatgcctgtaatcccagctacttgggaggctgaggcaggagaatcgcttgaacacagaaggcggaggttgcagtgagctgagactgcaccactgcactctagcctgggcaacagaacaacaccctatctcaaaaaaaaaaaaaaaaaaaaattgggttcttgagccagactatctgagctcatttcctactagctgtatggctttgggaattaaacacttagcctcagtatcctcatctgtaaaacaggattaataatagcaactacttctgatggcttttgtggggattaaaggagctaacagataaaacagtccccctggcatatagtcagcagccaactaatgttatttgctttattactaatcattttaacatgtcacatggactgagagataatgggcctttttattttctttatgcttatctgtatttaaaaagatagagagatttgtcttttgaaaatacaaaattgtattctgatatgagagatgtatagaacatgtcatatgagaaatgttagtaaaaaacagtatatacagcccaaagtcatttttattaaaatatatttaatgttatgtaaataagtgtacattaaaaatttagacatgcactaaaatattaccagtggtctctctgggagatggattataaattatttatattttcttctttttacttatccctattttctgattttcctaaaatcaacacacattacttatgcaataagattttaactgtcgtaatttatttccaagcatagaagtcacaaaggaagaggttaaactgagaggcttccaatgatgtaaccagagatggacttttgagcaaaaacaagtgaacaatacatgatttactgagaacccatacgttcgatatcatgacgctagcaaggaaaacagcaattgatcatcagtacctaagactgccattctccattgggccaggctcccacctgactttagggaggaatttgaaagccagaatctcgccccaggtaaatgcaataggagccaaagcaggtaacacagctcagagctgaagtttgctgaaaaggccagagggcactgcctgcaaggctaaaagcaacactgcacgtccacacgctgggtttcaacacttttttcacagcagcaaatccataacggactctgagtgaactgggaaagaataactaaaacattcaaaatacttccagaaaatcattttgcatgatgacttctcttactatgtccagctctgagtaagcaaggaaggtcacaggattttgttcagatttggaagtagaaagggaaacgtgaggttatactcaggaaatccttttgctaagattcaaaaaatctgaaaattaacaaattctaaaacatgcacctttcaatttgcccctcctctccttaacatctctccataacctgagatggctacatctatggttggactggactagaggcaataaacacagacacagtaacctcaacatggggtttacagcgcaggaatgaggaggagccagtggcaggtatagaatgttcccacacctcaaccactgccaggctccgcagctcactgatgcagcagacactgcttcagagcactgctttattggtaccacttctgagaagcagcaaagcagacatacgtctttctctatcatcttctctgtctctcaatccctctcaatgacaatgactcattctctctttcaacctctctcccttcctctctcctaccctctaccctcattcccacccccttatcactacactaaggccagcaagaagccacaaccacagaagagcttccaggcagcagtgaagcagttcagtctcaaagaaagccagacaggagtccagatgcctgtgttccttctggagttcgctatatgacctcactataatccctttaccactgtgggcttattttctcatctggaggacgaatgggtaagaagagacttctgaggtctttttcctgctttaaaattctgtgatttcacaataactgaatacagtcactaaacgggaaaccaccaagacactggggggcggccagcacatagccatctttgttgtatttttcattgcaggcttccaaaatgtctgttgccaagaagtatatccaactagaccctcggcccatgttttaatttttatacactgtaattaaaagcagaatgacttgctttcactttggattatgtaatttctttctattcataatgagcagctcttacatgatgccaagtgagttttctcttagggagcacattcttactcaaccagagaactgttggcatttggattaatagaatcaatagtatctttcattccaaaaccagaaattgctgttttgatatggtctgcccacagttcttccaaggaaaatatttttattattttactactaatatctccttacagcttatacatgagtgaagcatttatttttatattaaataaatcatgctctttaaaataaaaatgaatatattcttcttgttagagctcggagttgaggccagtgactggccaatgaactcacaagtgtagacagggtgttacgcaagggacaagtttttcactaacaccacaagagtctctggcccaatgagaggagtttaatagaaattcttgctacaactaaaagaaagaaaagaacaaataaaagaatatactctcctactgtaaaatctacttaagaaaaagtaggttatcaggtctttattgcagaaagtggtttttatttcttctctgctgtggaaacaaacctccaaatcattgaaaggtggaacagtatccttctacagaaatcagatttaatcttgacagaattaaataagaatcactcattatacactgatctatgttttggcaattatacactgatctatgttttagcagatattatggaaaactcaaaggtgtaacaggttctctgccctgcaaagagtttacaatctcatatggaaatcaaatgtacacacatgataaatgctacttaaagacctactgtctgccaaacactatggaaggcacgaggtatgtgagtgagactccacctctgccaaaaagttcctcacaagctggtgagaaagccagacctgagtaacccagacagtgctaatctcccaggatcacctccgctgcacttagagtgggaagtccagtggctttcctaagaatgtggtggcttccagggtagacagacagggaaggagatggaggtagcttatcttatggtcacctcttgtcatttctcatctcctggaggtattccctctctgtcaagtgaaagtagcacctagttgggttggttggttggttcgttggttggttggttggttgggttttatcagtctgacaatcttttatcttttaattggtacatttagaacatacacatttaatataattacaaatacattagggtttacatctaccatcttatttgtgctattcatctcatctattttatccttctctcctttcttgcctctttttgacttagttttgtttttatttttccctctctccctccacacacgctcaagtttagatgctatatgctgcttttgggctttcattatcctagaaattacaataaacatatccaactgatcaaagtgtaaagttaatcagttatttgacgcttctgcctgatcttaaaacacctgaatactatttacacccttcaccatccccactcctaattcggaacactgagtgcttccgccacagtgaacctctttcagttccctgaactcttttcacagcttctgatcgctggtcttcgcacttagctactcccccaactggaataccaccctcttctcctcacaccctcttcccaacctggctaaatcttttacacctctcaggtcctagtttcagagttatttgcaccctggctcccctgtccctgctcccctcccccgtgagtttccctttgttatgtctgtcttccctcctagacattaagttaaaacagtcaatgactgctgggcacctaggctgtaacataagggtccaccaggacactgctagccctcagcaccacataatggatactcaataaatatttgttgaatgaacagatgaatgaaatatagtggtttcaagacatgtaaaaatcaggaaagacgcaagaaaagtcacaggtcaccccccaacacacatacaaaaaaagtccactcattattgaagcagaaagactactatggtgatttaaagagtgcaggctccagtgccagactaaatgaattgaagcccagattctatcacttactagtgggtgaccttggataaggtactcaacatccctgtgtctttggaaaatagagataaccataaaacaaactcatcaggttgttataaggaacaagtaagctagcacttgaaaagtatttagaagacttcctgttaagattctgtatatacaggcatactctggagattgtgtgggttcaattccagaccacaacaatacagtgaatatcacaataaagcaaacatcacaataaagtgaatcactccagtgattcactgtgaatataaaagttgttgacactatactgcagtctattaactgtggaagagcattctgtctaaaaagaaaacaatgtcaatgtacacatcttgattaaaaaatactttattgctaaaaaaaatactgacaatcatctgaggcttcagtaagttgtaatctttttgctgatggaaggtctttcctcattactgatggctgctgactgatcagggtggtagctgctgaaggctgaggtggctgtggcaacttaaaaaataagacaaaaatgaagtttgtcacatcaatggtctcttaagacaaaagatttctctgtagcatacaatgttgtttgacagcatcttacccacagtagagcttctttcaaatctgaagtcaatcctctcaaaccctacactactttatcaactaagtttatggaatattctaaatcctttgttatcatctgaacaatgttcacagcatcttcaccaggagtaaatcccatctcaagaaaccactttgtttgttcattcataagaagctactcctcatccactaatggtgcatcctggaattgtagtaattcagtcatatcatcaggctccatttttaattctagttctcttgctatttccatcaaatctgtagctactttctccactgcagtcttgaactcacccctaaagttatccatgagggttggaatcaacttcttctaaactcctgttcatgttagtattttgatgtcctccaatgaatcacaaatgttcttaatggcatctagaatggtgaattcttttcagaaggctttcaattgactttgcccacatccatcagataaattactatctatagcagctacagacttatgaaatatatttcttaaataataagactcaaaagtcaaaattactccttgagtcattggttgcagaatgaatgctgagttaacaggcatgaaaacaacatacatctccttgtagatttacataagcgctcttgggtgactaggtgcatggctgaagagcagtgatattctgaaataaatattcttctaagcagcaggcctcaacagttggcttcaaatattcagtaaaccatgctgctaatagacgtcctgtcatacaggcttggtagttacatttatagagcacaagtagagtagatctagcataattctgaagggccctaggatttttagaatggtaaatgagcaatggcttcaacttcaagtcaccagctgcattagcccctaacaagagtcagcctgtcttttgaagctttgaagccaggcattgacttctctgtagctatgtaagttccagacggcatcttttcccaatagaaggctgttttgtctacattgaaactgtgatgtttagcatagcctcagtcatcaatggtcttagctagatcttctgaataacttgatgcagcttctacatgagcaattgctgcttcacctttatgttataaagatggcctccttccttaaaccttatgaaccaatgtctgctagcttccaatttttcttctgcagcttccttacctctacctctctcagccaagaattggaggcttgctctgaattaggttttgttttacgtgaatgttgtagtgatttgatcttccattcagatgactcagatttgctccatatcagcaataaggcttctgctttcttatctttcacatattcactgaagaagcactttgaatttccttccagaacttttcttttatatccacaacttggctaactgttggtgcaagagacctagcttttggcctggcttcaacacgcccttctcactaagcttaatcatttatttgatttcaagtgaaaaacatgcaactgttccttccacgtgaacacttagaggccattatatagttatgaattggattaatttcatattgttgtgtctcagggaatagcgggacaggggaaggaccagtcgtggagcagccaaaacatacgacaatttttaagttctccatcttacatggacacagttcttggtgtcccaaagcaattacaagagtaacatcaaaaatcactgactggtgcagtggctcatgcctgtaatcctaccattttgggacgctgaggcaagaggattgcttgagtccaggagctggagactagccagggcaacatagccagacgccgtctctacaaaaaaaaaaatgttttaaccggctggatatggtggcatgtgctgtagtcccagctactaaggaggctgagacaggaggatcatctgagcccaaaaaagttcaagattgcagtgaaatatgattgtgctaccatactccagcctgggcaacaaagtgagacactatctcattatttaaaaaaaaaaaaaaaaaatcactgatcgcagatcataacaataggtataataataataatgagaaagtttaaaatatcgcaagaattacaaaaaggtgacagagagacacaaagtgagcacagtgggaaaatgatgctgaaagacttgctccacacaaagttgccacaacccttcaattaaaataataataataataataataataatatctacaaagcacaataaaacaagctatgcctacatgtttacaatagagctgactctctagttgttaaaccacataactgaactacacaattctcaacagatccttacttaaagcccaggtattcatacattaaaatgatcctaacataatgtctttacattatggtacaaatttatagcccatgaagacaacatcactgcattaaaatatttgaaaacaatcaaccagaattattttaaaaagttaaacagtattaagtgcatacattaaaaataccaaaaaaatggggcagtaatacattttttaaagaatgctctcaaaaaatgttatcaaagaaactatttgagcatttgaaggaacaactttcagtttttaaaatgaggccacaatataattttgtgaattttgtagtcttaccaaattgtattataattccttaattgtagctacaaaaatgttgaggtttttaaattttttcacatttgaaattttccaaataataaaagtaaatattcactattatcccataagacagacaaaaaagatcatacttctgccaacctgactgtggggtagtacggccaagctgcagtgcacaaggcaaagaccttggaggctgtgaaggcagccagtttcccctcatagatccaccaacttaaccagctcaatgtcaccaggaaatggtcctaaccctgacccatcacgcttcgcttttttgttttggcggtggggggacagagtctcactctgttgcccaggctggagtacggtagcgtcatcttggatcactacaacctctgccctccaggttcaagcgattctcgtgtctcagtctccggagtagctgggattgcaggtgcccgccaccacacccggctaatttttatatttttagtggagatggggtttcgccatgttggccaggttggtctcgaattcctgagctcaaatgatctgcccgccttgacctcccaaagtgctgggattacaggcgtgagtcaccgcgcccggtcatcctttgcttttatagagtggagggctgccctgtctttacctggttctggaactgaaacactatacctcctgtaaaattatgagcctttggagtctcattaaaatgaacaaacacaagcacagaggtctgcatatagaatatctggggccctaaattccctaatacttaagaatacaatcactgtcctattgtgtttcttgcttatttatcctaataggaaggcaccaggaattccctagttaagagatgatataaaacatattttgaatgaaagctgcaataaagctacaaactatgatttggggtctttgcttaagtctgagatacttggggactttatcatgaaacattagtttacttgtcttttgtcaagagtaattgcctaaacttgaatagaaatatgagctttttcagttaaacatactcctaaaaatagcattttcttctgggatttgactactaaaagcaggcatttcaatgaagtcaatggcacttatcagtaaaaaatcattttttaagttgtaatgagatcttttctttctaaatattaaaatattagaatgatgtatttcattttcctagaagccaaataaatatttcctatttagtttggacattcatggatactttttttaatggatactttctaactctaaattaatagtattatattataattacattttattattatagtttgctgtcaatatcctacctcactttgttactcaaagttctatttaaagaccaagattacagttgtatctaaaattcctaggtcacaaaatgtagggtagcacagcagtagaaccttaaaatacacattggataatgatgtaacaaaacctcattaacttagattaattgtgcaaggtcaaaatgaatttaggagttttatcttaaaaagaaaataattttgatgctttcacatacagagaataactgaaattggattaacagtagaggtccctggagaaactgcattaatgaatagatataaatgactgtcattagaacttcagttatcaagttttcaaaggcacataaattgttttcgccccttggtgttaagtttttcacttgtttttgttagtgcttttattttgcctttactgtcaaatactgggtacctcatatgagttgcactgtgtttctgatttaattcccagaacacgcttgcaaggttggtattattaccccattttgtatccgaaagatacactcaaggatcagggaattcagtaaggtctctctggctttttctgcttcactacacattctcaggaagtccataagctctttcttgagataaaatggtctcagcaaaaaaaaaaaaaaagttcaatgtttgaaaaaaaaaatctcacaagcattttattaatggtgctgtatttccttatccggtcagcagatatattactatggctctttttgaagagttagacacttcacttatcgctgaatgcccctaaagtattctttaaacccaacgggctaacgtagccatttgcaaactgggtacaaaagagagtactccattaagggaagaccaagatgaggcagaacaaagagccagcagtgggcagataaggaacttcttcccacgcctaatccatgaggacttgaggaaaaaaatcaactcacttttctggacctcacacaccgtgggcctactttaacccatttatgcttagtgttccattaatggaacgctaagcttgtgggagttatgtatatcctactgctcaaggtcatcgccaaggtctgatcttttcacaaaaaaaatttgcaacctccggcacaaatgggttaatggtgccgtcacagggaggcgaacaacatactatgcataatagtgctttgcaaactatacctaataatttggtaaaacattttcactccacccttttgtttttaaaagatatacaacactcacggtattatttattatgttttagaagaaaattttttgaggtttagcttaaattttaaaactaccaggaaataaatgagatttattttagagaaatttattttcttttttatttttttttttatatatatttttttaagacggagtctcgcactttcgcccaggctagagtgcagtggcgcaatctcggctcactgcaagctctgccttccaggctcacgccattctcctgcctcagcctcccaagtagctggaactacaggcacccgccaccacgcctggctaattttttgtatttttagtagagatggggtttcactgtgttagccaagatggtcttgatctcctgacctcgtgatccacccgcctcggcctcccaaaaatctctgcctgtaatcccagtactttgaaaggacaaggcagaggatcatttgaagccaggagttcaagaccaccctgggcaacacagtgaaaccccatctctacagataatttttaaaagtcagccaggtgtggtggcacgtgctatagtcctagctacataggaggctgaggtgagagaatcacctgagcccaagaggcagcagtgagccgtgactgcatcactgcactccggcctaggcaacagagcaagaccctgtctcaaaaaaaaagaaaaagaaagaaaataataaatccgttttgcaaaatgagctgcaattacataatctaaatctgagtgtacacaaaaaatacaaaacaagggcctaggctttaagtttttcattctttcaacaaatatttacatagtacctaccataagccaagcaccatgctagcaatggggcaataacaccgaacaaaacaaagcccttaattgctagatatacttgaatcccttgcatttaatagtgcttggcacaaagtaagcaccaatgaatgttagaaaaaataaataaataaatacatatatatatatacacatgaataagttaggtgtataaaggagaccagaaagcagcctgtcactagaaaagctgcttgaattgaattctgaatacataaaacatgtgagtcctttgcaaagatttgactaaaagtgccctgataaatctgctccactagaatcgtgtagtaaagggaatgaaaggaaaagcacgaaagccctattcccaaactgcgaataagacactcctgcctctctgttatcttggaaataaaactgtaacagatgaaaatgagacaaacaaatctctaatttaaaaaataaataagcccgcaagtggaaaacctgcttttcatcaatcaaataaatcagggaaggcggcatttctaggccattgcccttgggtctaccacagcacttaggaaatggttttcctaattagtctaatcatcacttctgttctacatggttgtagctgactaattacccaactcaaaaatgctcacccaacccccaatgccaagctcctccagagctctatttccaatcacactacttaagccattgttcacaagaacattaatgacactatcacatgtttaaaaagtgttgatttgaaggtgtggaagagagtccccaaacttggggacttttttaccttagaaacttttaaggaacagaaatatgcaaataagagcagggaaaataactttggtttctgaaattctcttaaccattgttttacaagtctacagcaatggaaaaatgacatggaataaaaagcgtgtgtttgtccgggaatgtaagcgcttgccattttgccatgggggcttcaaagctgactgcaagccagggccgagcccaccatgtgactgtcactgtgttctaataaacagcagcctgcatggtcgggactccaggtaaagataaattgggttccgtaggtattcttttttcagacggcctctattcaattcctccagttttaaaattctcttatgaagaaataaatagcatgccagagatgacaaaggccatgaatgtaaaaacacaaggtagcggggctgagtctcaataaccagtgagcacctcctgtgcactggagctagacactgcacaatgttctagaagccattttttgttctaggacaatttttgaagtggtttcatttgccttattacctcagataggtgttgctgagtgactggacagatttcttctgctttcagtctcttttcatgggtccttcagaatgagttttggaaaggagaaaaacaaaaagagaccagaaggaactgagaagctcaaagcatcaaaggtgaataaatttggtatttggttttatttttaacatgtagaagagcatcaaagaaaaaagaaacacagattttagtcaggaaacaaaaattactcaaaatagcaagtataggttagatgatttaatgagaatactagggattagagaatgtcccagctctattaataaattatcttgggcaaatctccttagttctgaggtctgattacattttctatgctcatagtaccttcttcttacataacttgcatcatctcaaacaaatctaaaaaccaacaacaataaatatcctaacaaatggcactttttattcctttaagctgcctctcaagagccaccctgcaagtggggtttggatcaacttcccacctgacatatgcccaaccaagtggctattctaatgcctcagcactgtgctagaatcaatggtgaagaaagatgaaatgctgccttatctttgatctaagaagcttatagtctaggtggaaggatgtaacacaaagcaatatccaacaagagtgctacatctcaataaatggcaactccaagaatccccattaattgaggcagaaatctatgtcattcttcctttccttacaccccatcaatcatcaggttctgttgatctacacaaaatgtggctcatttatctttccacttgtctgtatcacagctgccaccatccctgtccaagaaatcttcatctctcacctacaaaagctcactgattaatccctctgcttcctttcttgccctcttcaatccgttcttcacagggcatccagagtgatttttttaaaaggctaaactgcttaaacctcttcagtgaccttccatgttcacaggataaaatccaggtaccctcctttagccgtaaggccctgcatggtctggccctagcttatctttgcaatcccatgccttcattcctaccgctccacccactcttcctcacttggctccgccgcctggccttctctcagttcttcatatgcgacgctcttttctgcccatggccattgtgcttgatattcctctgtacggcatatgcttcctctggccagcgccatttcatctgccagggacatctgctgttcctgcctggccagcaatccttctcctggtaacagaacaccttttttcttcttgaagtcacctttccctcattctcactccatgtggtttggcttaaactggcaacttctcctcatccccacccgggcaatctacaattaccaggatatttctggtaataaggaaacaaattttaattgaaattttttaaaacagaatattttaaagtaattacacaatcagaaaaggttgcctgtgcctatgaataccttctccagaggcctgtcctccacctacctttccatgatctgtaattcccctgatgatcacattcacgaacagatcaaccaagctgcagtgttacactaacagtcatgcagtgatctcagttttgccaaagtgctttcaaataactgaggagtgggggaagcaaaatcctgcctccaaagacagttaaaaggaccagatgatcctcttactctctcctattaacccagataaatttatcagctcagctagctgatacttcagccccaggaaagtgaaatacataactggggtagaagaagctgccggccagagcccaaggaaaatggggcaccagaaacacgggttttacatgggcccaattcagttttacatagggtctctccctcatcccgcgtggagattagcaagtcaaatttaatacttttgaccacacactggtttagatgcagtattgaactaagtcagactgaatttcagtggtaaaaatacacaaacaaaaaattactacagaagtgaacttggctacagagtcataaggtgatgtgtttactctctcggacaataatcttgggcaacagaaaacacacacacacacatacacacacacacacacacatacacacacacacacacacacacacacactcctgaaactccctggggaggtttcacagtacaccacttccctgggtgtcctgtggctagggtcaactgtgacctacaggcagggccttctctgactgcttttattgatagctgaaccaccagaattggtccaaaattggtaatacctgtggaatgagggagggagcatttgtcaatttgggacaccaccaaaacagccagtgacacttaaaaagactaattcatatacatgcaaaacaaacagtgttaattaagttagaggtgtcattttaatgcttgtttcaatgtcaggacctttagacaaaggcattaaagacattttgtctgagctctaaagtaaaaataaattaagggtctgaattagcaccctcaatctagcttcaaaacaacttttatccatgtttaaaatccccttgactaaattatcaaaataatggctgtgcttttattgaatatttacaatgcgccagacatggggctgagcatttcacaatcacgatttcccttaaatcattcaaccctcaaaaacactcctacgtaacaagttttaccctcattgtactaatgaagaaactgaggctcagaaaaactaatacgtttgcccaaaattgaatcatcagtgaaaatgtccatcaaacctaggtcggtcaaattccatcatgaattcataatggtttccaaaccagtctatggtagaacatttttaacaggtttataccctgtttttatgaaaaagtttcaggctttattgtgaattcagttatataactaataaggatcagacctcaaactgcagttaatcccaattgtgtgctgagatcaaaaggtatgtctcattaaatcaaggcaagtgggactatagcttgctgaaactcccagggaatccttttaatttgttagtgatacttaaaaaaaaaaaaaatcttctaatcttctgttcaaaacaatttgatggtttctcatctcacagtaaaagctaatgaccctacagttgtgcttggaagtgtctggcacacacctcaataaatacttgttgaatgaatggataaattcagagagccactatatcctttcttatcctttcaataaaaagatgcacaagtttccagggaaataaaacactaacaataaaagaagttgacgaactgaaagcttttctttaggaaaatcactgaactccaagttcagataagataaccaaaaaggactcaagtgtgccctaattagaacaaatgaacttcaggctacttcattttgttaactctgaagaagattcaacaggacctttaaaaatgtactagaaatgattcagtcttcttcatccatacattagaaaccataattttttttaagtagtggacttgaagtcaacacctgagtacttgtccaactttgtccttaattcattttctttctgtttcctcatttgcaaaatgacatgagactccaagatttctaaggtccgtctgagctctgatattgtattattaatcacaatctccaacttaattgacaaaacaactcaataattatttctatcataaaaataatctgattaaaggacgcaatttattacaaaatcagaaatagacacctcatccaaaggtcaattcctaatttcttgtataatccaaatcttccaaatgcaataatttaatccagaatatctagggagtgacatagcctctgtcccattaaaattggattaaaatccaaaataagaaaatcttgtaaatgtcttttctgtagtcctcagagaaagacagagtgagtgtactccttttgccagagtcagttttctctttagatcatattctttattccaaacacttactggtaactattacgtccactaagtcttctctccttaggttaaagatcacagttctatgacctctcctgacatcacatgattttttcaccactcacatacctgttcactgttaatgtccccctttaaatgtgacacccagaatccaataaaataattctcagagtctcattgtttcagagtatagtggcactgtttctggcacttatttattgatgaagataaaaccaacttgacagcattgctttaacagttaaataagataatgagtgtaaagtcttaacacaaggtttggcagatagtaacctctcaataaatggctactgctgctgtgattgctagtaacaataaattgtaatactatttcatgagtattagagcttatccccccaattcagttgtatgctttagctctcaataacactgaaagtttgccttatacattattagctgtttttccccacatcagggataggtagaaaaaatgctgaggctcaatttaaatcgaagatcaatcagaaaccaagataaagtaactctgaaattaagacttaaattaatggcaaacagggtatgatttatttaaggagttaatttatcctctgttttccagaacaatttgattatatcaaacaatttgattatatcaatataatttgattatatcaatcacttttttcagctaaagagcactatccctcaatcataccatttaaaagatgaagcaaatgtatgtatcactgacatgtgctgagaaggcagtctggcacagagttgaagggagtgagctctggaaccggactgactagagttccgtatcctagatctaccacttacccactgtgtgatctaaggcaaattacttaacctctctggtctcaggcttcacatctataaaatgtgagtcatgacaggacctatctaccttatgaggggcagtaaattatcctaaacaacattgctaaaaatgtattatctggaagtctcagacattttcaatttttataggtcctcatctctgttagccattgctgaagtcaatcaacatgtttgtattctctgcatatttataattatctattttctgaaacatccatttgtttttacggtagattttaagattactgtaaaaaaatccatctttattttaatacttaactaaccatatatgcctcactacagcaaatcatgtgttggtattaacagagaattatgagataaagaaacaaataaaactgtgcttgtcatacctgcagctgctctgcatatacacctgtgctgtctaatacgacagtcacatggggccatttagcacctgaaatatggcagatgtgctgtgagtgtaaaatataggccagatttctaagtacaagcaaagaatataaattatcactaagcttttgtcaaaatgacaatatttcggacacagtaggttaaataaaatatattacctacattacttccattgatttctttttacttttttttaatgtggctactagaaaatttaaacttacttgtgaaattctcatcatatttctattgaatagcacccatacagaagatcctaaaaagtatgcctcattaaaatcaggacaagatctatggtctaaagtatagcagaaactaaatgtagaatttacaggaattttcagagttcagataattaatttcaaactcttctccaacccccaccgagacatatccttttataggtactttttaagtaccgcgtccagtctagagccatctaagaagctttcattagccagtggtgactttcaaaggtttattctattttccacaagctgacaaaatttatttataacaaagccaaaggactgctttccagcaagggagctgtttactgaagagatttggccttagcaagtaggaatccagagaatttaaaagctgacaactgaactggcaaattggccccagtactgggactttgcctatagctccaaagcatgtactcagaggtctaggacaaatatggccttgggatgtgaatgagacccagaagtctggccttccctacataatgcaaatgaaacttggcctagtctcttcagctatctaattactaaacaaaactcccagacgccagtagcttttttgcaaagatcaataaaaatgcagagtggaaagcggagatactgaaatgctatcaacaaatgctacaacaatatattgttgttctgagtctgaaagttccagctggaaaaggcccaatgtggcaataatagagaagtagaggaagagcagaagcaaaatctaaggaggaaaaataaaccaggaagtattaccctaagatctctttctactcaaaatgaggtgcaccagtgtattagtctgttctcaggctgctattaaagacatgcccgggactcagtaatttctaaaggaaagaggtttaattgatgcacagctcagcttgactaggaaggcctcacaaccatggaggaaagcaaacggccaaaggcacatcttacatagtggcaggcaagagagcatgtgcaggggaactgccttttataaaaccatcagatctcgtgagacttattcaccatcaatagaaacagcagggaaaaacccacccccatgattcaattacctcccaccaggtccctcccatgacacgtggggattatgggagctacaactcaagaccagatttgggtggggacacagccaaaccatatcagccagcatccgtagcatcacctagtagcttgttaaacatgcagatctcaggccccactccagaactaaagaatcagaatcttcacttcaacaatgtccccaggtgatttccacagtaatgtctgggaaacaactggtcatccacacaagatccaaggacaccggtttctttaaattcttactcttattacccatctgttgccctgtggttgctacctggaaacatggggccttttgtgtttaatgcatgcaatgaacatttagttgactgaataaattcttggaaaatgtgatcttatacatgcttaatggacggtggggaatctgtgcctcagatgagagctaaagaagtcatcagttactgaaaacatgtggacagagtgtacctcagatccatgcatattgcataactattaacagaactagggactccctgaggttgaacaagatgagcagacacaattcatacccaaaagacatttatttaacggctcagacaaaagaaacagttttgatttttgatggagatgggaagataaggactttatgttgaaaaaaatcaacagcattaacaaaaattagtgtttacaacagtaagctagatgatttgggctgttttaaattacaccaaaggtcctttgggaattatgctactacatgaagcatcatatttttttcctctttactgtctttcccattggtattcgaacatgctgttacttcctgcatttttaaaacatctcttgacctcatttctccctgcagctacatttctcacattctctttacagcaaaaatctttgcaatatttttctacatttgatgtttccgtttctctacttctgcgctctcttacatacccactgatcaacatttggtccccactactacactataatcccagttggttatcaacctcagcaatgacatctccattgctaaatccctgggtcaaatctcatttgcccctcattttactttacttcccgggagaatctgactcatcttgcttgaagtggttttttcacatggctggcaagacctcgcactctcgattcccctcattcgctgctttccttcattctcctttattggtgccttctcatctcttcaatctcagtgtggaagcagcccaggttttggccctcaacttcttttcctttctattgacattcgctccctgtggatttcatccagtttgtatattctgacaactctcaaatgttcacctctaacccagccccttcctctgtaatccagataaatatatccacctgcctaccagacagctccctgactgagctcctgatcctttccaaaatcagcttctccctatctcagttaatgcacctccatccttcaagatgcacaggccagtattttgcaagtcacccatgctttctcccactcacatcccacattcagacaatgagaatatccttcccactcaaccttcaaaacataccatggtggtccaagccaccaccctcactcacctaggttacaacagcctcccaactggttttcctacttccactcttccccgcttcagtctattctcatgagacacagcagcagcatgtcctccaagaacatcagccagatcatgtcccatctttatttgaaactctctaacaggcttctctgctcactctcagtccaaaccgaagcccttgcaatagcaacaaggccccacaggacctggcgacggtgtccggtccgaccccactgctcactgtgctccagtcacactggtgtccctgttcctggaaggcaggaagtatggctctgcctcagggctctgcacctgctgtgccctcttcccggtgcacttaccttccttcttcaggtctttcctcatgcgtcacctcaacaaggtcatccttgaccacccatttgtaactgcaactccaccccctcccaaactccctcctctgccttatttttccctgaagggcttcacactgtcaacatactacacacacgcacatgcagacacaactcatacactgtctgtcttaccttgtaagaacaaggatttttttcttttttaatttttattttacttatttttttgtctgttttgttgaccactgtatccctggaacctaaaataatgcctgcctcataggagacactcaaacaccatctgttgaatgaatgtatgaatgaaggaaaagtgactgtgacacagaactgcatatgacctattacagtacgccctgtagccttttaaaagagttgtattttaaataagtcacttggtatgcacatatattcagataccgtggaaaagacaaagctgcgccaatttgataattaaattaaccacatacaaaatctggcccattgtaaagaaaaagctctcttaactgagagatgccctgaaacactccaagggtgctaggctttctcaaaaccctggaccttgcttcaccagagctcatttaaaagatgggtcctgggccgggtgcggtggctcacgcctgtaatcccagcactttgggaggccgaggcgggtggatcacaaggtcgggagattgagaccatcctggctaacacggtgaaaccccgtctctactaaaaatacgaaaaattagctgggtgtggtggcatgcacctgtagtcccagctactcaggaggctgaggcagaagaatcgcttgaacgcgggaggcggaggttgcagtgagccaagatcttgccactgcactccagcccgagcaacagagcgagattccatctccacaaaaacaaaaaacaaaaaaatgggtcccaaaaggtccaccctttctgcaagcaggtgaatgtagccaggctaatataatggactttgatttctttagatgaaagagaaattatgatgcaaagtacaaagcactttatagttatgatacataaattccaggtgtaacccattttcagtgaacttctggactcaagtacaagacagaaaaaaacgtttttgttatactttagtaactcactcactctgtagatggacatggtgggtcccatttttataaaccacatttcttaaaaacctaaaattatcttccaggtgaaaggaaagcaaaataatctcagcaaacattttagatgtagaaataaattattcaggagggaagcagctttgtacacaacataagtgatgtgaggcagacaaatgccaaaagtgattttagaacaaaatggaaagaatgtcctaatgtctctaccttataataacccttttcattccttagaccataacaggtttgcttttgtttctgaagttatgtatacagcagaaattcttaaccaccctccaattaaccaactccaggatgtctcacaaggtgacacaagttacccgggaagacatgctggctgatgcccattcatacctgctgctcacagctggtgacagataaagaaacagaatgaaaaaatcagtacctggcgctcaggctgtggtcttaagactacagcaagctcatgaaattctgcccacatgactgaggtggcgattaccaagaatcagttgtgtttgcacctgaatggatttgtcctggttgtacttgctaccaaaattatgtaacttaaatattatgtaaaacaaacataagcataatgagagagagaggtgtattgctaaatggaatgctttagaaagaagccattaaatggccacaagagaattctactgacaaattttttattttaaaattattttttactaaacagaggcaaaataaaactttacaaaatatttataaaatacaaatattcatgaaggaaatacctctgtatactaactacaccacccaagttttttaaaaaatggaattaccattatctttctaactcccctctgaatcttactgaacttccctctgaatcattacttaatgattttataaatgataatattttctcactgactaatcacagatacatttgttttagtaacgcttctaaaatttcggctttaattcctctaggcctgtcaagttcttttaaatctataaactatattatctttacataagctccagttttagaatatgatattgtattttattagactttctttcccaagcaggacacagcaatatgagaggccaacaactgatatacaagccacaccgagaaggtaggaagaattgcacccaaaatgaaaaaatatgacttggcacagtgactcacacctgtaatcccagcactttgggaggccaaggtgagaggatcacttcaagccagtggtttgagaccagcctgggcaagatggtgggaccccatccctacaaaaagttaaaatacaaaaattagccaggcatgttagtgtgtgcctgtggtcccagctacttgggaggctgaggtgggaggataacttgagcccaggagttcgaggctgcagtgagctagaatcatgcccctgcattccggccttgctgacagagcaaggctctgtctgaaaaaaaaaaaagagagagaaaaaaaacctgatacaatcaaaagaatgaatgaaacagatctctgagactgctacatcacacccggtgaacacagcctaagcctttatctacttctatcagaagtctctgccagaagggaaagagctgggtgaggaaatccatagtaacacattactcttatcttttatgtcctagattgccatttgcaagagagctattaatgaaagtcacacacctgaagctctaaaagcagcccagggaatggggaaaattccctgtctccaaaacaggagatgaagccactgtgaagccaatagcaaaaaagtgatcaggccagaaatcctgctgactcaggaaattctattctgccgttagacgaagctaaatatcagagcacctactctgccgtatattcttaatagggttcctgtacttagctatgtaacagcctatggggtttaactcattcgctaaagaaacatattgaatgaggaccctgggccaaagcaccacatatagtcgtccatcggtaaagtggggcataagtggggattggtcatagatttggggattcaaaggtgctcaaatctcttatacaaagtgatgtaatgagtaagaaggaactaagcgcacacattctctgagcacctgccacgcgcaaacacagtgctaaatgcttccacatgtattatctttttaaaatgacttttttttttagataagatcttgctctgtcacccagactggaatgcagtgatgtgatcacaactcactgcagccttgacctcctaggctcaagcaatcctccctcctcagtcttccaggtagctgggactacaggctcgcaccatcacatctggctaaattttttcttttttgtagaggtggggtctcactatgttgcccaggcccgtagactttatttattagagtagttctaggttcacagtaaaattaagctgaaggtgaggaaattttcgatacacctcctgcccccaacacatgcacagtttcccccattattatcaacccccaccagagcggtacatttgttgcagtcaatgcacctacactgacacactgatcttatttagaccttagttccagcgtctctggaagagtggcagttttctcattggctgaccctattgcctggtctcgctgctcggtgcaaaggcctttagaaattctctgctttgactgactggctaacaagtggagatttgtacccgaagcatcgaatctgtataggaatcaagcacatggaaaaatctttgattcctccagtgtcttggatctcaaggaaagctccagcctcagccttggtggaggcagcagccccgggctcagagaaggaaggtattcagatgacaggattcagacatctcaggatgaccaaagagtatccaaccattcaccaaggagcagaagcttccctatcactgacagacagtacttcctgcggtgtccccagcatcccccagaaactgtggacaaggcacaagaagaagtctgaatatgtgaaagccagcaacagcgcctttgaggccgactaacggtgaccctccccgggtaccctgcactggctgaggttgactagacaaggggagaagggccaggactggagctgagccacactcatttctgctagcagcttggtgcaaacatatcatcctctctcactaactgatcaccctgccttaggacacagaaaaggaacatcccttgaaggcaaaatgaaactgttccttcttagaactgctaaagctgttggccagaaagtgactttgagaggtcataaagtttatatctctatcttcaagcaaaatcacacctacatggaactttcccagcctaaagacctccaaggaaggaaggcgacaactcccccgtcttccttgtgagttgctggtgttctagggtgtgtaactttctggtcttactgtaagagcttgaccctgaggcacttataaacacatggttcttaccgttcctattatcgcatttatttcaccttgatgaggtatactttttaaggaacaagcatatatcaacttagtagttctagtatctactgaagagtaccatcaagattgattgtgatggtcatttggcatgactgcatgaattctttattcttttatgtgcagtttttctatagaaaaacactgaaagttaaaagttgaaaaaaataaaaccatgtagcatttgcacataacatatttacatcttcccatatactttaagtcatctctaggtttcgtataatacctaatacaatgtaaatgctatgtaaatagttgttatactacatgaataaataatgacaagaaacagatgtccatacatgttcagacacaacattcttccacatattttgatctgaggttgattgaatgcatgatgcagaacccatagaaacagagagctaagtgtattagaatttttctcctggcttccataaagcacacctgtaggcaatcacagtctagggtacaagaaagtccagttttgccgtttaataggtgtgtgactttaagaagggcaataataattccagttcccactcagctaagtataacctaccatccaggtcacatttactgcctacttactgtctttccaaaactgtctaagccccttctaaccactaaatgttggtgaggtattccatgaggtaatgatgcagtgaggcacagagatgttaaaataacttgcccaaggtgacacagatagaagcaaatcagactatccaattcaagggcacactccaaccactatgctgcactgcctctggtaacacagaatatcctttaagagaagaacagggccaagtacaatggcacccctgtagttccagctatttgggaggctgagggaggaggattgtttgaggccaggagttgaaggctgcagtgagctatgatggcgcctgggagtagtcactacactccagcctgggcaactgagcaagaccccgtctttaaaaaacaaaaataaagaggtcaggtaagtgagtctccccctcccaacttcacacttctcactctcctgaaattcttcaggagatcctaatcaaccacataaaacaagcaaagtgtagagattatgtaaaatgtttatttttctttccatgcccttttctccccattgagtttcatggagatctgtgtgactatgggaggcctccagagattcagcaatggtaagaaaatatgagcacattttaaaagaggagggaagaaggagggaggattcctcccaagagagtggtggcaactttacaacttgaaaatgtctgtgagcctggcttaaatttttatgacacatctctaccacactggcagggggtggggggttggggacttgggttgtcttggatcaagacccagtgctgaggtaagcaatgtagccagactggcttgatcagctccttgtaatctccctggcgagggatgtttgtcaactggagaccacacccactaaagagaactaattaggttctaggggcaaccactaaggtcatcattattaccaggtgagatcagtttcccaaacattccgatcttaagacttgcatggggtgattaggaagactgctccttcagaaccactgtaccagaatcttcaggcagccctagaaatctgaaaccaggtaattcttgacagacaagtttgggaaacactatttagatcatgacattacagtatctaaaaagatcaagaagggtcttctaggtagggtgtcctcctttcaagcaattctctgtctaatccaggaggagaagactattttctatacataaaagtctccagagaactggcttccaaaatttcctttcagtatacataagagtctcaagtctgcagagctttgtggtccctctcaaatagctcaggcaaaggttaaatctccatccttcttccaaccagatatttaaaaaacaatatttgttacacaagtcatcatactgaaagttttgttaactcactttggaaaatacgtgagggcctagaactgtgctaagccctctggtgctctgtttaagataaagaacttcacttatttcaaaggtcaggaagaagaaacagaaaagacaacccacagaatgagagaagctatttgcaaagcatatatctgataggagacttcaacccagaatataaaaacaatgcttaaaatgtaagagtaaatagacaaataatataatttaaaaacggtcaaaggatctgaatagacacttctccaaagaaaatatacagatggccaatgatatggtttggctttgtccccacccaaaactcatcttgaatcggaactcccacaattcccatgtgtcgtgtgaggaagccggtggaaggtaattgaattaccggggtgagtctttccaatgctgttctcttgattgtaataagtctcaagagatctgatggctttaaaaatgggagtttgcccacacaagctgtctctttgcctgctgccatacatgtaagacatgacttgatccttcttgccttccaccatgattgtgaggcctccccagccatgtggaactgtaattccattaaacctctttcttttgcaaattgcccagtctcaggaacgtctttatcagcagtgtgaaaatggacgaatacgagccaataagcacgtgaaaatatattcatcatcattagtcattagagaaacgaaaagcaaaaccacaatgagataccacctcacacccactagaatggctacaaaacttgtatgcttgtgttcagaatggcattattcctaactgtcaaaagtggaaacaacccatcaactgatgaacggataaataaaatgtgacccatctagtcaatggcatactattcagcaataacaaggaatgaagtactaacacatgctacttcatggatgagcactgaaaacatgaggaaaaagccagctacaaaaggccacattttgtattgtttcatttacatgatatgtgcagaacagcaaaatccagactcagaaaatagattagtggttgcctgtgatgagggataggagcaatggggagaggtggcaactcatgggtctggaatttttggggtttttttgttttcttttgagacagggtctcattctgtcactcagactagagcacagcgatgcaatcacgacacactgcatgcagcctcaacctcctgggctcaagcaatcctcctgcctcagcctcctgagtggctgcgattacaggcacacatcaccatgctcagctaatttttaaatttttttgctattaaaggggtctcactctatgttgcccagactggtctcaaactcctgagctcaagagatcctcctaccttggcttcccaaagtgctgagattacaggtgtgagccactgtgcctggcctgggctgtttttgaagtgatgaatatgctctaaaattgactatggtgatgggtgcacaactccatgaacatactaaaaatcaatgagtgtacactttaaatgggtgaatcgtatagtatgtgaatatctcaataaagttgtttaaaaaaaggatcccatttaatctccatgagcctcaatttcaccctctgaaaatggagacaccacctacctttcaatactataaaggatatataggccaggtgcggtggctcccagcactctgggaggccgaggcaggcgaatcatgacgtcaagagattcagatcatcctgggccaaaatggtgaaacccgtctctattaaaaatacaaaaattagctgggtgtggtggcacgtgcctgtaatctcagctactcgggaggtggagggaggagaatcacttgaacccgggaggcgggggttgcagtgagccgagatcacgccattgcacccccggcctgggtgacaagagcgaaactccatctcaaaaaaaaaaaaaaaaaaagaatatataaatacatacagatgcatgcatgtacacactcacacatactatgtttcacatagtacctagcccataataaatactaaatagatgtcattctttctcctcttcctatccccacgcttttgtattgttatgccttgatactgtggttccaccacaaattacaaaactcaaaattaaaatgtatttcaacagaggtctaaccatgagaatttcacactgctatcctcaagactactcctacatggctaactctgaagaaatcctggagcctgcgaatgtgactgtctaccttccagacttgtcactacagagtatttggggataaagagtaagacctttttcctctgttccactgccttattagaatgttccttatttctaaccactggacacgggcaccttcacttacctatctttaaaactcagcacaatccttgccaatacagatgctattcagacatttttcctgtcaatttcatctacaatgaaaatcaactgggcctccaagacagctctgcaggtgtccccaaaacaccttagctttgatatatagcactgcccacctgattattcactgtgatactaggcagattcaaagagggctagaaattagggaaccacctacagcttgcaacaaaaagtcaactgcagccagctgggcccagtggctcacacctgtaatcccagcaatttgggaggctgagggggacagatcacctgaggtcaggagtttgagaccagcctggctaacatggcgaaaccccgtatctactaaaaatacgaaacagccaggcatgattggtgcacacctgcagtcccagctcctctggaggctgaggcaggagaatcgcttgagcccgaggcagaggttgcagtgagccgagatcttgccactgcactccagccttggcgacagagtgagaccctgtctcaaaaaaaataaatagagagagagtgagaaatgacagcccaggacagataatgccatctattaaaaaagcacttttgctgtaaagttgccctaatatagtagttactagcggcctgaagctatttaaattatcgaaattaaataaaatttaaaattcagttcttaaatctcactagccacatttcacatgcttagcagccacatgtagctactgactatcttattggacagggcaaatatgggacatttccatcatagtaaaagctctattgaacaatgctgattcaggcagtaactgcatcgattctataaagttcacaagttctgagttcttaggtactgtagtttcagtatttgctgattgtgaagtttgactcgcactagtacgatccaagtgaggtttgcctaggtcagtggacaaggttttttggagtgtacactgagctcagcacgaggtaagcacttaatatttgctgaatgcttaaatcaacagcataataatatctgtacttcagactctgccttgatactttcagatattagctcatggaaagcaatggttaatttttcttcaagggagattttttatttttatttttatttttatttttgagagggagtctcgctctgttgcctggctggagtgcaatggcacaatctctgctcactgcaacctccgcctcctgggttcaagtgattctcctgcctcagcttcccaagtagctgggattacaggcacctgccaccatgcccagctaatttttgtatttttagtaaaaacaaggcttcaccatgacagccaggctggtctcaactccgctgacctcaggcgatccacccgcctcgggctcccaaagtgctgggattacaggcgtgagccatggcgcccggccaagggagatttttatagggagatataagcatcagcgggtggggaaggtggctgacagaccttttgtagccactagaaatgaatcggcgaaacataaaaatctgcccaaaagtaactttgctattcaaacaaagtttcagatgcaagaaatatcttgcctcttcaaacactcactacttgcaccttgtagggacatgaaggcagagtcagaggagacactctggaagatcacaaagcctgctgtcaatttccaagcatttttccaatataacttcgccagaaaataacacagtcacgaagacagcagccatctaatggcatcgtctgtgccatcactcttatacctaaatttccactctcctagtgtcctatgactcaatcaaaactgtgcctatcaaataacttcttgaaagtacaagtttttgaaaatctacattcaaaaaagcatgtaagtttccatatacagagaaaagcagttccactggcccttaaccagtaatctcctagaggccaaacaaaagaagctacagctgcttctattaaaattttctacttctcttgtccacagaccaaacaggcataagaaaaccaagctgctcgatttctataattcactttttcttagcaaaggtctgagaacagaaggccagggaaacagggagcagctgccgcctggtcttatgaatgccctcggctcattccccatcctcctcctcattgtttcaagctccttttcttaacaatctctaagccccagctcatgggaagaaataacaaggaaaagcagccttcactgtgtcaacaccctctgtggttgaagcatctagatcacttctctgaggtgatgcaattagaaattaaattagaaattaaaaagaaattaaaatacattccattttaatttgttaatctgctttattgtgaattccaattaatgacacataactacgtggaactccttacatgtggtcctacagagatccttttagacaccccaggggttttgttgttgttgtttaattacaccatttctatctcttgagccaaacaacaaatctggtcccactattaagccaacaaatgtataatggtcggtgatgaattagtcatccaatattcagattccaagactcgaataatctaaatattagagccaaagagctcagtttctgcaacacgcaatgctaactttgagacataaaaacagaatggtggttaagaaaattggatgacctgagtttaaagtctcagctctgccacttactcactgtgggatcttgagcaggttccttaacctctcctgacttcagaatggaaataatgacactactgacctcatgggttgtcatggggaataagggagacaacccaagtaagaactcaataaacattagctgtgattgtaaaaacgccccatgccaggaaaatatcactcgaaataagcgttttccaaaagttaggacttggccgggcctggtggctcatgcctgtaattccagcactttgggaggccaaggaaggcagatcacctgagctcaggagtttgagaccagcctgggcaacacgatgaaaccccgtctatactaaaaatacaaaaattaagctgggcgcagtggcgtgtacctgtggtcccagccactcgggaggctgagacaggagaattgcttgagtctgagaggcaggggttgcagtgagctgagatcgcaccattgcactccagcctgggtgacagagtgagatcttgtgtcaacaacaacaacagaaaaatcaggacttaacaagaaacttagaaaatgctgctttctcagaagacccgtgtgaaaataccatgtaagaaaagaacaccagcttaggtcaaaatgttaattttcccagttatcctaaatccctaactccaataataatcttttaaaaatatccttcaacatgtataaattattctgattcatctcactgatgtacactcagaggaaagggaatttcaaaccagatggctcaggagtgagtggtcctcaagtaagcctcaaggagtgagtggtctgccatggccgcagcctgacatgcaggaaggggagaagagcgggcggatccctcacaccaccggtgtcaccaagagagaaaatgctctgccacctctgtgccctgatgtgtcaacaaagtccctccccactaggcaccaactgggcccaagtttgttgaccttctgggcgcagtgaaaaacctttcttttggtagagcaaacaagcactgcagggacatgcactgtttttatataaataagatagcacacgcaaagattcattattaatgttgagttatgccttattttcaaatgaggcatggacatttggtaatttggatttaagaataacttgttaactatatgctgcaaattatcctttttctccattgtaaattgcaacagccactacaacactacttaatttggagcttgtgaaaaatgtccttgaaagatggtcaacgtaactcagaaacactctttgaaaaaataatgccaccacttaaattctttccagcaaatccctgagtctgcatacaatatcacaaacaacacaagctgtcaagatatgggcactccgaacaaatgctctggagaatttcacatggatcctgtactctcctaaatgaaagccaggctggtttaactgtaaaagaactaggaagaactgagaggcaatattcaaagtgaaaacacttccactcttagcaaagggaagccaaggacctctgtgcttggcccagacggtccgggaagaacccctaaatggtgagaatcacaacagcagtaattcaaggtcacactagatccccagcctcctataagcctgattcacatactaaactccacagactttggtcaccagattattttttacagtctgacccaacttcaatcatgtctgaattcctttccaaaaattggaaacgatcactatccataactcacctcccaatccaacccaaacccaaagacactcttttcataatgtccaaatgacattaccccatgtaaacctcaaacaaaccagtctttaagccaaagcagatacacattttaatattcacatggttttgcctcagcatctcttaaccaagactgcaattaacctatcaccacactggtgtcttagtttatgaataatgcatgacaaatcacacctgaatttctataaaagaaaaaaaatcacctccaaaagtagtagtaccatggacatgttttttcaatgtaatgccacgctaaattccactcaaataattttccatcagggctggcaaacaaatatgtaaatatcaaggttttagaaagagggcagagccattgactgaaagtacctttaaatttttctttttcaatgagctacttccatcttactttatttttttatttccaaattcccaagatttactagcctgtaagaatttccaaggttactcaattttttaaattactagtatctgattaaaagcagaattgaattgcttaagtgcaatgtacataataaggtatatgttattctttggtcacaaatgaacagtgtcaacaaaactttctttaaagaaaacacacattaagattggcaaatcaagcttcttatgctcgcatttaaaaaaaaaaaaacaacaacaacattcaaccacggaatttggccgtaataaggttattttagctttgtagctctaatcactctcccacattcaatggtcaggataagagtgctgatccattcacagaacacacaaacagatatttagaatgtgaaattaagagtacatcactgaataagtaatgcataaaacgtgtctaggcatggaaatatcaaatggtagggctagaaggctctgaaagagcatctacctaatcccctcaccctaccaggaaactgtagcgacagaagttaaataatttgcccaagacggtggcaaaaactcacccagtcagtggcaaagcctctaagctaggtgtcctacctacagatccaagtccctttcttgataccactctactccttttagtacaaaaagcttctattaatgaaatatcttacaagacaaatcacttgtggatggatataaaaaggttgtggaaggacatccagccagccactaaaaactggttgaaaaggtgctaatttattttgcatttgcttaactggtgatgttgagcatgttgcacttttaactgctgaagaggaatttcatgactttttgaaaagaaaacctcttggtttgtaaatactctcagaaaagaaaggatcatttcttggaaaagggtagaaagtgaattccctttcctttagcaggggacatcctttccctcacatctcacaaaaatccaatcaacccctccctttcaaggtccagcataactgccagctcctctctgagaacttccaagcccggaggccagaagcttcctctgagatcctccatggtagcctacgcataagtctctcccaggcaagctctcaagcacgcttcttgaaagcagaaatcctatcctacttacctagctaccgggctttgcaaaatcctttgcacatactcaattacaacgaacgcattgaggcatttgttgccagaatcccacttacagtaattttccagatctccgtcttccctacaccaacacctggacccactcaagagttattctggagcggaaatcctggatcccgctatcgggagaaccagtgtctagaaaatgaaatcgtggtgcccattccatcctctgcctagtgggcgtttaacatcctttgacatcgaggggaatggcaaaacgaaacatttattatttaggtcaccaacaacattctaaacccacgtcctctaatcggtgttaatgtgtttaaaaaaaaaattcagaacatcattcgccagaacggaaagctgaaaacggcggataaagttaaatgcatgtaaaacagaatgacttaaacatctgtaaaagctcctgggaattgcaccgaataatcttcccttgtccgtttgctcgctcaattcaagtttgtttagtttagtctttttttctttctttctgacagaaacgtgatagtccctaaatacaagctgaccgggcaaagaaagatcggcatacgaggtcctctttcatgttgccttcttttgatagcttttctccaaagtctgaggttttcaaagccgaggtatgaactaaaacccctaaaccttaacaccacaaagttgaccctgctgggctcctaaaaaacacaaagcaagcaagcgcgaagagaaaaatcgcaccctgcacctatccagacagcacaaacccaggtggccccgggatcctgggggacagagcggcgacaaagcaacacaaaccccacgtcgaacagcggcgccgcgtgcgcaccccgcgcccgcgccccggccccggagctcaccgctgcgctccttccttccatcttccatcgccagcccggccgcgcgccgaaaccgccgccgggcgctccggggccgcagcctcagggcgcgagtgccggcggccagcgccgcgtgctctttgtt

SEQ ID NO: 2368 - DNA, 629678 bp, Homo sapiens
catttcagatgcgtgacaggtgcccgtgtgtgtgtgtctgcagtttgggactgtggaagcacgagcttacataagtggttaggcaagctggcgtgtggacttgtgtgggatgggtgcaggtctgcatataaatcatgttcctgggtttctgggtgtgaagcgcacaccgacggggacgagagcgcagaggatggcgcttttagatacttccagtcttccgatgttgtgatcgcaggtagggcagctttgcctctaatcaggcgttcattaactttttccctgaacaagctcgcccatttgtggtttggaagaaaagaaagcgagtctccgcggtgaggtgtggagggcaggggcgggtggggaggtttgttgtttgggaactgcgctagcaaaggaagcggtggctattcgcttggagaggatgacaaatgaactggttgcgtgaggagtgaagagaccgtgtttacagtcaccagcaggctgcgtaaagaagtggcccagtgagacagggaaagtgacccagaaaatttagttttgttcagaatgaaagctgctgtatttcatttttgtttcttaatttgacggagtaggaacgttattttccttctctgtcattgagaccagtagcatttctatgttacaaactgaagatatttggggtctcgtcggcttgggattatcaatgcttgggaggtgagttctgatcaatacctttaacaaccccaaagaaaaacgcaaaaataatcaagtttaggtaaaacttccactggactttctttccagggagggtgagagatggaagaactgggcttgtaagtatcaaaatggagttagagaatgagctacaagtttgtgtgtgtatggtctgtcaaaaagtgttaagactgaaaggaaactgttaggtttagttaaatgtgttgacaacacggctcttacatatcaattttcataggcaaataggtaattacatagagtgggaactgggactatggtgggaaactttctgtaagatgtatattctttattcttaatttatcactttttcaatgggtgggactactctgtgaaggaaagtagagggctgagggacatttggtgagactcttgagagagaaacctttgcaagccaaatctcgcatgctatagatgataaattctaagttctttgatattgtaccactcttaagctaaattgtcctgtaaatatgatctcatgcaccataaactatatatatgtagagagagtctattcccaataactcatcctttcctgaaagagtctgcaagttctataaatgtcagctgttgggaggtattgtgatgaaggagagaggccaccagtgtttccttttatatatttattctggcagatcttaactttacttctgattttctttaaggaatttcagttaacattcactgaatttatattgctgagagtttcagtaaaacaagactagattttctttgaagcaataaattcatcttatcaagtgaaacattatgacaatgcttttgtggcagaaatgtttatttaaatgagtccattttaattatttatttatttttgacttgcagaataagatctgcaacatagatgtttttgaagtaagtagacgtttcttgagaaagaaaaataaatttaggttactgtggacaatttgccagtaattttggatgtctctttgtctacagggacataattttgtgtgaaagtagaatcattccatttcttatgtctctcatcttctcccatgcattttatcccctgaactcctaagactttgccaggaattgctgaacattctgtttcgtgccaggggttaaatatcaggggatggaataaggagctgtgtgtcacataaacatttttcaaaaggatgctgtcagagatctcaataccgggattaatttttcctttagctttgcagttagcttgtcttaattggtattgctctgaacctaggaatgcatttaacctcttcattttcagtttccagctggaaggaatatatttaccaaatttcatcttctttgtaacatatggcatgatataaataattactatacacacactatcctgctgtaaggaaagaaatagaattacaaaatcaactttcgtgttgagtgatatggatataatatttcaaaaaacaattttaacttttcccctgattccaaaagtaatatttagctattgaaacagttcaggaaaatacaaagaaaaaaataaaggttatccataatctgctagggagagggagccactgttaacatatctttaactgtatattcttccaaatattattctagtcaattatttctacccagtccccctcccccacacatttttataaatataaaatatagcttggaaatataacttggaaatgtgttaaaggcttgggaatttactgcttgtttacagaatgattttgatcagatattagtttttactggtggtccttattttcaaaaagagtaggttctttctttttctgttctttgaaaacaagtgtttgcactttgggctggtaatgcttggggcttccttttgaatttagggattaaagcatcagaaaagaagtagaaaggtcattggccattgtgggtgggagacctgagttctggttgcagttactccaacttctcctgtggcctctgggcctctgtttccctaaagggcaaaaggtacttttagatttaactaattaagctaatgacgtatttattgctttgacatgagaatgatctttgaagagggcttattcaaacacagaaacacctgggggtcatcctgggagtctctgattgattctgtctgagatggggcccgagaaggtacatatctaacaagtccctggatgatgctgactgctggtttggtgacagtgaaaactagagggttaagtgtactagggttctcttagagggacagaactaataggatatatatatatatatatatatatatgtacatatatatcatatatacatatatgctatatatatgctatacatgatatatatacatatgatatatgtacatataccatatatctataaaggggagtttattaagtattaacttacatggtcccaaggtcccacaataggctggctgtaagctgaggagcaaggagagccagtccaagtctcaaaactaaagaaattggagtcagatgtttgagggcaggaagcatccagcatgggagaaagatgtagggtgggaggctaggctcatttctccttttcatgtttttctgcctcctttatattcgctggaagctgattaggttgtgcccaccagattaagggtggatctgccttccacagcccactgacacaaatgtttaatctcttttgggcaacacccacacggacacacccaggatcaatactctgtatctctcaatgcaatcaaggtgacactcagtattaaccatcaaaagcccaccccttgtcaacttgaacccatacatatctcctgagatcatacataatcttcaaataaagacaataatgaggtcaaaattgtgcataacataatacaactatcctttgtacaaccagaaatgcaccaatccccaatgcaaatactattacataaagttaacaatacttacatgctgttgtgaagtcaataaatcttatgtcacatgataaaggaaaaggaaatgaagatattttcttagtatgagtgtatatatacacaaacatgtttttaacaaaagaaggaggaaatactcttgacaattacagtctgtttctgcagctggtcacatggtcgtagctggtattgatgactaccttcttctacccattcagtattccttttgcctacagcaagcacctcagcaggttcttttccctggtggagtgacccaaacctttattcctgaaggatctggaccatttgtagtcccgcctggattgggctgttgtagtttcctgttgaccttaatcacagggcatggtaatactgagagatgccctaatggatttcctgtgttccatatgtagtcttccttacctctgctgtggagtagtagactgatttcctcttgatagtccaggtcaatcatgccagccaacacagtaattttcttcttagcctgttgactgaaagataggagtatcccaaactgtccaggtggcaatcttaacttccagtttaatggaatcgttgtgtttcctggtggcagtgttcctccctctggaactaagatctctaggccagcagaaggtaatgtcttgggaacaggaagcaaaaattttgctagtggatcagtaggggtgatggtgagtggtgccacttccacttccgccccttgattcctggacctgtgaatcctggctataggagaaacagtaccatatattggatgctgattcagagcatacacggccctctggagaactctgccccagccctgcaaagtattgtcacctagttggcattgtaattgtgacttcgaaaggccattccaccattctatcaatataactgcttcaggatgatggggagcatggtaagaccagtgaattccatgagcatgaacccactgccacacttctttggccataaagtgagtgccttggtcagagacaatgctgcatggaataccacgatggtggataaggcattccgtgagtccacagatggtagtcttggcagaagcattgtgtgcaggataggcaaacccatatccggagtaaatgtctattccagtgaggacaaacctctgccctttccatgatggaagaagtccagtataatcaacctgccaccaggtagctggctgatcaccctgagggatagtgccatatggaggggtcagtgttggtctctgctgctggcaatttgggcactcagcagtgatcatagccaggtcagccttggtgagtggaagtccgtgttgctgagcccatgcataacctccatccctgccaccatggccactttgttcatgggcccattgggtggtgacgggtggctggggaaagaggctgagtggtgtccacagaacaggtcatcctattcacctgattattaaactcctcctctgctgaggtcacccgttggtgagcacttacatgggatacagatagcttcacagtttttgaccactcagaaaggtccatccacataactttttcccaaatttctttgtcaccaatttttcaatcatgcttcttccaagtccctgaccatccagccaagccattggctacagcccatgaattgatatataatcgcatattgggccatttctccttccatgcaaagtgcacagctaggtgcactgcttgaagttctgcccactgggaagatttcccttcacctctgtccttcagagatgtcctagaaaaggcctgtagtgctgcagctgtccacttttgggtggtgcctgcatatcgtgcagaaccatctgtgaacaggccctagtcttctcctcctctgtcaactgatgatagggaactccccatgaggccgtgggtgcaggctaggggagagaaggcagggtggcaggagtggagaccatgggcacttgagccacttcctcatgtaacttacttgtgccttcaggacttgcctgagtcagatcacgtatataccacttccatttgatgatgggatgctgctgtgcacaacccactttatggctagatgggtcagaaagcacccagttcatgatagaaagttcaggttgcatggtgacttgatgacccagtcaaacgttcagtttccaccaaagcccagtaataggccaagagctgtctctcaaaaggagagtagttacctgcagaagatgacagggccttgctgcaaagtcctagagtactccactgtgattcacctatgggcgcctgccaaaggctccaaacagcatccctatctgccactgacaactcaagcaccattggatctgctggatcatatgtcccaagtggcagagcagcttgcatagcagcctggacctgttgcagaaccttctcctgttctggaccccactcaaaactggcagcctttcgggtcactcaataaatgggccggagtaacacacccaaatgaggaatgtgttgcctccaaaatccaaataggcccactaagtgttgtgcctctttcttggttgtaggaggggccaaatgcagcaacttatccttcaccttagaaggaatatctcaacaggccccacaccactggacccctagaaattttattggggtagaaggtccctgaattttagttggatttcttatcctctggcttgcaaatgtctcaccagtaagtccagtgtgtttgctacctcttgttctctggatccaatcagcataacgtcaatgtaatggaccagagtgatatcttgtggaagcaaaaagtgatcaaggtctctctgaataagattatgacacaaagccagagagttgatatacccctgaggtaggacagtaaaggtatattgctagccttgccagctgaaggcaaattgcttctagtgggccttatggacaggaatggagaaaaaggcatttgccaagtcaatggctgcataccaagtactaggagatgtgttaatttgctcaagcaatgaaaccacatctggtacagcagctgcaattggcatcaccacttggttaaacttatgataatccactatcattctccaagatgcatctgtcttctgcacaggccaaatgggagagtcaaatgggaatgtggtgggaatcaccatccctgcatctttcaagtccctgttggtggcactaatctcctcagtccctccaggcacatgatactgtttttgatttgctatttttctaggtagaggcatctctaatggcttccatttgggctttccccccataatagccgtcaccctactagtcagccaatgtgggggttctgccagctgctaagtatgcctatgccaattatgcattctggccctggggaaatgaccacaggataagtccagggacccactggacacactataagctggacctgagctaaaactccattaattatctgacttgcataagcccctagcttaaatggaggaccacaatgatgttttgggtcccctggaatcaatgtcagctcagagccagtgtccagtagtccccgaaatgtctgatcattttcctttcccgagtgcagttaccctggtaaaagaccagaggtctccttggggaaagatgagagaaagatctactgcataaattttcagtcatgtagtggagtccttccttaaggggacccagcctcccctttgtccaaagggttctgggtctgtaaactggctcaagtctggaaattgaatgaggagccgtgattctctgtttttataattcaaattagtcttttgtccattcaacctagaagttttctgtttgtgtaattgaagtaggaatgcagtaggcttcctatcaatttcacttttaggaacaccatgattaattagccaatgccagagctctacatgagtcagactattctgattgccactttgcctctgctgtccattatggtagttatgctcaccttgcctttgatggttgagtgctgccacttgacccctgccacctggtccctgccacctctggatccaattattcccattttgtagttgagtgactgtggttcccaccattagatctgacatacagagaatggcaattacagggctcttcaaagatgcaggtgctgccctcccaagtctattttgcaaggcattggtcaagggtatatcttctggaccctcccagctgggatgagtaggtctaaagggactaatccactccaccaccccaatctccctaagcctttggattccttcctgtacattaagccaagggagatcaggcatttccagctcactcacagtgggccgcctttaagagcttgtgtctatttttccacaatttcggctctttctctaggagataagactctcacttagtgtaatcttagcagatttgaggctcagtatctgcttctgaagctgggagacagaatccctgagttcatcattttctttcatcactttgtccgttgaacttaagagcagccaacctgcttcactgtgttccttggttctccacatatggtcaaatgtgctatgtacagagtcgctaaactccctgcctctcatgagcggtgaattaggagtgtcaaaggcatttattttgcataactctctaaacagtttctgccaaggactatcagtgttttctatactattagaagtagagtccttagcatttttgggtctaatcatattaagcagccaactccagaaaccccaaaaccaacgaaagaactccattcttaatattctgttcatctagaaccactcctggtaccaaaatctgtattaggtttctcttagagggatataactaataagatatatatgtcttagggagtttattaagtattcacttacacaatcacaaggtcccacaataggctatctgtaagctgaggagcaaggacagccagtccaagtcccaaaactgaagaacttggagtcagatgtttgagggcaggaagtatctagcatgggagaaagatgtaggctgggaggctaggctcctctctccttttcatgtttttctgcctgctttatattcgctggaagctgattagattgtgcccaccagattaagggtggatctgccttccccagcccaatgactcacatatttaatctcttttgggcaacacccacacagacacacccaggatcaatactccgtatccctcagtgcaatcaagttgacactcagtattaaccatcacagtaagctccttacaggccaaaatgcctgtttgacttttcacaggctttcacagtaagctccttacaggccaaaaagcctgtttgacttttctttgcagccatccatccagtgccccaaaatatacctgccaataggtgttcagtaagcattggttgaatcaatattagttttctcttatggaggaatatctttctggagtagtcaagacaaaagaataatcatccagaatttggaaacattaagcctgtaataagagttataatcattcatggaccacactacttcaaactgcaaagaaagcaaaaatgcttataagtaggcaattaaattgaacattaaacctaatgagttacattaaataataactaggaatacctgtttgagatgttacaaaccacaaagcctaccaaatacttcaccgttacctctctcaggtctggaagaggccatttattttctaccacatacacatatttcaaaaaatggaagtttcactattaattaccctaattaccaaggcagcagataaagcaagcaatctccttgctcccctctcctcatcccccatccctcccaccaagaaaaaaggctcattagaactctaccaccattctataagataggtcccaattttatgaatgaagaaatgtaaaactttagagaaagaaattaacctgcataaatccacaaagtgaagtagcagcatcagaagtaagatccaggcctcctgataccaaagggtgttgttctttaccacttccctctggtgacattgaatgtgtatatttgatagctgggagattctagctggctgaaataccccagttagaacttttgattatccttatgtggctaccttttatatagaaaatatatcttttccttctacttaggtgttagtaacatagggtggtaccaagaaccaccatttttatgtgtggtaacttcaaaaaaagtgtaaatatttggatatgaacaaaatagatcctcattcattaatagctcaggctatgcaaatgaattgtcttagaggctgtcttggcatttcacagtaatttggttaaactatcaaagagaaagccacctttaaatctgtccatggtagagttcactcattcactagtatctgcttgacccaagaacctattttcttgcacacatggaagcatgcattctacaaagccagctgaggtgaggtcccctgcatgaatgagagctggtggtggcactcccttggaaataccccaggcacctgtgttgctctcatgaagacctggctagtctggagctcagacagagaactgctattatttgttcttaaaggagcacaacaggcattttaaaatcctgttaattgtgtttctgaaccttagttttctcgtctgtgaaagaataatttaaaaaataccctttgagtatgtgtgaccatgagaatagaggaccctgtatgaagtatggggcatagaaagcacagacacgtaagaagatgggactgtcacagcacagttcctgttttctaataatttttagagtgagtctgttgagaaataagtgtttcaggataatggttcctctttattttctgttcctgaggcattgctgtgttagtcaagcatttgatggactcccaagtctctgagaatcctgctccatagttctcacattgggatttgaggaggcttgtagaaagcaagtggcccacacatctaagtgggagaaggcagcgtgggcaagatctctgtggtagccaaagatgcctctgtttcctggaggcgaaaggccattaatcaccagcaggaagagaagtgaaaaaggagactgctgctgcattgatagggcttatgccagacacacagagcaagcccatgttttttctctgcatccttgggatttcttacagtgcttggcacatagtaggagtttggtaaatgtttgctgagttattgagttgcagagtgacagctgtgggtggaggaggaaggatgggctagtattggtaggaattcatggactagtgggggtgcatggattggtatgagtgtggatgcaaggtgcacgtggttatagccttcattcttattgcttgcttgattttgcctggcaagatccacttcatatccatgatatagtgagactgtcatcctagtttcacattattgtgtgtctattccattgggctttggtcggtttggcttttttgttttgttttataatttatgtttgtaattttatctccacctctagcacaagaccaatacacatagtaaatgcttgataaaaattcgttgcctaaacaaaaacttgctcagcctacaaaactatgggtccgtcatatggttgtgggctgatcttacaaaataacaatcagcatttgttaagctttttgcaaatcaaagtcctttaagagatgttgggtggtattatgcccattttatagatgaggaaaccgagtggaaacgaggttcagtcacttgccctaagtcagatagtcattgaggagccaagatttaaactcagatcttttctgaccccaaagtccttgtgctgttttatatagcacaaggtggggaataaacagagaccctacccttgagatcatttcagttgtattggagagatgataggaataaatagaaaattagcaataaaagatgttaaatgatagtttaggaaaaaatgcaggggattttgtaagtcagatttggtagcaaatagatgatgaagacagtaagcacattatagtttagttcagagacagcattttatcatcagatctggaagagacaggcttcaggaaataggaataaactttaaaggtgcaaaaagggataatggcaaagttttcagatgaaaggtgttaataatacagtcacgtgtcacttaatgaccaggatacatttggagaaatgtatcattaggtgattttgttgttgtgtgaacaccctagagtgtacttacacaacctagatggtatagcctactgtacacctaggccatgtggtatagtgctcctaggctacaaactgtgcagcatgttactgtactgaatactgtaggcaattgtagcgcagtggtgttttgtacttaaatatatctaaacatggaaaagatacagtaacaatatggtgttataatctcatgggacccccttcatgtatgtggtccatcactgacttgtggtgcatgactgtaattggttattaaaacaattgtttgatttcagagtaagggctaatataaactccttatagttaaagccatctcagaccaccctagctaaaataataactcctgccccttctcattgctcttcattgtcttacttgccctatttttgatcacagctttatcaccatgacattgcattatatgtacttatatattgtctgtctccctctgctagaatatacattccataaaagcagggactcttttatttcctgttgtagattcagcatctgtcacagattctgattcatactaattgtttaagaactatttgtgaaatgaaggaagaaaatgcattttaaaaatgagttgcaaactcaaacactcaatagaccagttaggtaaaggaaatgagggaagcaagtgaggtttcttccacaatggtaacaagttgtaatttttacaaatcaaaagcatgttttgtttgtacattacacagatagaaagtttttactcccagaaatacatttatatctatttttcttgaaatatggggtcatctgactcattgtcaagagagacctggataccaaataagatttccttttttctagaagcagaacagccatccacgtgtgatgatgaatggcacctgaccttggatctcagggttggggttgcattagggacaggtggagaatgtgtttaagcgagaagtatgtgctgctcagaaagccctgttgttgccaaattttaattcatttaaaaattattaaccaatttcaattagaaaaatattatgtatatctacactgcccaatccaagagaaacaccttttgagctggctgtattttatggtgtgacctctgtagaaaaaaaagattaaataacatatgcaatatattttctccttaaacttctatggaaatgctacagtgtttagattccaaatcaagcaggaagatgccattatattattttgctgaccatacatcctaatacaaagactgattcagcagctggtcaaaatagaaaggacgcattcacaaagaataaatatattgattacattttagacttttttttaggtgaagggactttcattttcaggatagcaggtagtttagggcttggctgttggtttctgccgatagccaggggtatgtgacaggagacaaagtagctgaactctcttgatctgcattcttcccagttgcagaatagggctgagaaattgtgattgctttgagatggttactgaaagagagtgtgtacctggaaacaatctctggtttagtcaactattaatggggttgcgggggcgggatgttccgtaccccaggtcacagctggcctggggtctctgctgctcctccccactccttgtcctgctggtccgtgtcagacagtgcatctatcttcctaccaaggactcatttccagataatgattaattggatatggctcctgtgttcaagaaacttaaaattctgaagaaggaaaacaaatggagagacggaatgtggtaagcaaggcctatatatggaaagttagggagagatgacttcctgctgagggatttcactgaagaggctaagtagatgaattggactttggaggacctagaggtctggggcctgcagaaatggggccaggggacagagatggcaagaatgtacttggggcatttcaatgtaaacaaaattatacaggtgatcaaatgcaaggaatgtgcaaagaatatttaataccccccatacagagtgaggtccttaaaaacctttctggcaggaggagtccgtgttgatgaacttaaaactttaatgaaaacaaggataggggaaacctaggtttaagcaaaactgttcaataagtatttgtcatatttactgaaagtaaaatgagaaaacaaaagtagattatgagtgacattttactcaccttatgttggtaagagcagtgtgccacagtgaatttccagttacttcttgctgtttttcaggctgtcagccccccttacagtgaaatgcttacaggtagttttgctttattacagttagtgtacaattcttatgcacaagggcactcctccatgccaggctcactatacaaatgttcaatgcctttcagtcagagaggctgactgctgactcctgggtctccctgtggctaaagggtaaagtggatagatacatcttggggtaaactttatttaacttagttggcatgactgatcaggaagtcctcagatacctcacccccatgcctagggtatttagtgtcatgccaaagcatatgctgccaattccaggttttcattttttggtttcctttaagctttcaaaagcttctctgcaaaaatcacttccgctgcctgccatctgccttaaaaccccctcccccacttaaaaaaaatctgtttctaatcccaagagtcttttttgttgttgttttcgagacagggtctcactctgttgcccaggctggattgcagtggcgtggtgttggctccctgcagccttgacctcccagactcaagtgatcctcccacctcagcctcccaagtagctgggactacaggcgtgtgccaccactctgagctaattttgtgtttattgtagagacagggtttcatcatattgcctagactggtgcgagattcttatattttctaattattcttaaaatgaccaattgactatcaaaaatgtatttggaaataggtataagttgaactttgcttattgggaattcttggttgggggagttttctgtagttgagattaccatgttgttgggtatatgaagatgaacagtgacggataaaactagaagtgcaagttgaggccagtgtgcgaaggaacttgaatgccatataatagtgttgatagtgatggggatttagtcttctctctgatgcagactaaacaaaaaaataccaataacccaactgaactgaagcaaaatccaagtatctcgagcagaaataaatttatctgaccacataatctgagaattcaggcttagctggatccagggacttagatgatgtggtcagcactcttactcaacaccttgtcttcttgacttcctccttctatggcacgagagaagaagaagatggtcactaatatttctaccctcacatcttttcaacagtcacctcacaggggaggaatcttctttcttccagcgtccttatctcagtctcagggaaggactttggtcctgattagtcacatgtctacgatggttcgatctgtgtgtctgataatgaggcatactctggccaggacagtccacagtggtaacagacacaacctctggctccttcatcatccctgcaattataaccctgccatgatgtcattttttgcatcactgtatgtgagagggctgcaatgccaccttgagaacccaatatgctgcatccttcctccagatctgcatttatttgcactattctttttcaaacatacagttctactgaagtataacatatttacagaaaagtattcaaatcattgttcaataaattttcaagcagtaaacacatccatgttatctctctgagatcaagaaagagaatattaccgttcttccagaaaccacctcatgggccctcccagtaagtacatatttcttttttcccattggtaactgctaagctgatttcctttctctctctctctcttttttttttttttttttttttttttaaagagatgaggtctcactgtgttgcccaggatggccaggaactcctaggctcaagcagtcctcccacttcagcctctcaagtagctaccactaacctgatttctaacactgtaactttctcttttttgaaacaaatgaaataaatatgaaatcatacatatatgcctgtacactttctttctagatccttatgcacaacattgtttgtgaaattcatctatgttgcaatgtgtagcagtagactatttttattactatatagtattctactttgtgatattccacaaactattcatctactgttgagggacatttgggatatttctaggttagacatatgaatagtgctgctatgaatatttttgtatgtgttttgtgacacacatatgaatgtgtttctgtttgatatacacacctaagactggattgctgggccatggggtgtgcatatgttcagctttattcgatccttacaaagagttttcttaagtggctgcaccaatttatattcctatcatcagttcatgagtgtttcagtttctttatatcattggtaagacttgagattgttaaatgtttgaattttagccattctggtgggtgcgtagtgatgtcttattatggcttcaatttgcatttttctggtgactgatgatgatgtgcctttttaatttttttttgccacttttatttgtcttttgcagtgcctattcaagcttattgcctattttaaattagatttttaatctttttctcattgagttgtagaaatcttcttttaaaaacaaatttttaatacaaatacttttgcctgtcatatgtatttaaaatatcttttcccggctctagtggtttgcctttcactctcttttgatgaattggagatctcactttgaatataatctaacttatcagtctctttctttatggttattgtttcctgtgcctacttaagaaattgttgcctaccctaaggctatgaagctactctgttttaatttatagaagctctatttttttttttttttgccttttagccttttatctttaggttgtaaaaatctacctgtggatgattgttgtttgtggtgtgataaaggcatccgtatttgttttgttttacttatggatatccaataaacccagcaccacttattgaaaaatctcttcatttctactactctgaaatgtcacctttgttatcagtcacatttgtggtctgtctctgtgttttctagtccattccatttttctatttctctaatataatattgataacgcactgtcttaattacgtgagctttataggaggtcttgatattcagtagtgtgcaccctctagtttgttcttatttaagaataacttctaaagaacaaagctggaggcatcactctacctgacttcaaactatactacaaagtgacagtcaccagaacagcatggtattggtacaaaaaacagacacatagaccaatggaacagaatagagatctcagaaataagactgcacatctacaaccatctcatcttccacagacatgacaaaaacaagcaatggggaaaggatttaataaatggtgctgggagacatggctagctatatgcagcaaactgaaactggacctcttccttacaccttatccaaagattaactcaagatggattaaagatgtaaagtaaaaccaaaaactataaaaaccctagaagaaaatctaggcaataccattcaggacataggcacaggcaaagatttcatgacaaaaacatcaaaagcaattgcaacaaaagcaaaaattgagaaatgagatataattaaggagcttctgcatagcaaaagaaactatcatcagagcgaacaggcagcctacagaatgggagagaatttttgcaacctatccacctgacaaagatctaatatccagagtctacaaggaacttaaatttatgagcaaaaaacaacccaattaaaaagtgggcaaaggacttgaacagacacttgtcaaaagaagacatttatgtggccagcaaacatgaaagaaaagattaacatcactgatcattagagaaatgcaaatcaaaaccacagtgagataccatctcacaccagtcagaatggtgattattaaaaattcaagaaacaacatgctggcgaggctgaggagagagagaaatgcttttacattgttggtgggagtgtaaattggatcaaccattgtggaagacagtgtggtgattcctcaaagacctagaggcagaaataccatttgacccagcaatcccattacagggtatcaacctaaaggaatataaatcattctgtgataaagatacatgcatgtatgtgttcattgcagcacttttcatgatagcaaatacatggaatcaacccaaatacccatcaataatagactggataaagaaaatatggtaatatacaccatagactactatgtggccataaaaaggaacgagatcatgtcctttgcagggtcgtggatggagcggaaatccattatccccagcaaacaaacgcaggagcagaaaaccaaacactgcatgttctcactcataagtgggaaccaaacaatgagaacctgtagagagagggaggggaaaaacacctgaggcctgttggggatggggggatggggagagggacagcatcaggaaaaatagctaatacatgctgggcttaatacttaggcgatgggttgataggtgcagcaaaccatcatggcacacgtttacctatgtaacaaacctgcacgtcctgcacatgtaccccagaacttaacataatatataattaaaaagaatagcttcattatttctaaccatttgcattactgtataaattttaaagtcatcttctgatgggattttgattgggattgcattaaatctctagcctaaattgggagtaaattaatgtttttacagtgttggctattttaatccattaatatggaatatcccttcctttatttagatctgtctctcacgtctgtcagcatttttgtatccctctatattgtaaaattattgcacatcttttaaatatatattcctagtatttgaaattattcgatgctattataaataatacctttaaaaatatatcattttctgattgttgctgatatacaaaaaatacaattgagttttatatattgaccttgtattcattgactttgctaaattcactgaatcctaatagttctgtgtattaggttggtgcaaaagtaattgcattcataaattattatgaatttccatgtacacagttaaattacttgtaaaagagttattacttttacctttctaattatcacgacttgtatttgtttttcttgcctgttgtataggctaagacctcaaatataatggtgaatagaagtggtgatagtgagcattcttgtctaatttccaatctcagtgggaaagttttccatgttttactattaaatattattaaatatttctgtaagtgttttacaaataccgtttatcagatcaagcaagcccccttacatttaaaattggccaagagtattttcatgaagaggtgttgaatttgattaaatgccttaaagccataattgcacagaatagcgggctcacctctgtacttcctttttctcttggatcatgatcccatgtgtcctcattgccttgggagctcttctttttataccatatctacctttctagattttcttgagggttggactgttacaagttagatcatcattgtaggaattggtactgtaaattcaaattgtactatttttgtctgccatctacacggtatgagtaaaactgtaaaacccccgagaacctattcaattgttatttctttgatctatattgcttttggctggtaagctttatgaaaagattttcttttgttaaattttgctatcttaagaggaaaagtctaccattgctgctacaaatggaggcattatggagtcattgaaagggtgcaccttatattacatttaaatgccatgttttacatataaacatactgattttacctgttcctttttaaaaaagaaagaaaacaatgaaatcccaaggaataaaactgacattctttaaaaaagaaaaagccaataggagtgcttttcttcttaggtcccctgggaacatgtcatcctcttcatctcttagtcatccacttcttgtgtataaaaattggcaacgcttctctgtcactcccacttcttctctagcagtgatacaatctttcatgcgaaataagagaataataaaatgttatttctgcagtcccaatagtcagtagtattagaaactataatcttggaacccatacttaacaaaatataagccctctcatgtgagaagagagggaagacccaagctctaaatgctgactcattgctaaccaggagggtggcattagaacgcaacttgaccttcccaggtcttagtgccatcctctgaaaaccaaaggcttggacttgttcaagggacagaaaaaattgtaatgtaaagggctaaatagtaaatattttgagttctgtgggccatacagtccctgttacaacaactcaattctgctgttgtggcacagaagtgatcatagacaataagtaaacaaatgggcatttatttataaaagtgtatttatggacacaaactcaaatttcatacaattttcatgtgtcataaaatactgttctttcaacttttttttcaagcatctaaaaatgtaaaaacaattcttagcaaagagatcatataaaaagaggtaacaggcttagatttgtcccatgggcccaagtttaccaacctttgagtcagttaaattgtcaagggctgttccagagctctgtgttaggcattcatatgctagccttttaaaaaatattttttttgtcctatgaacattattcaaaagggtctatttttttcttttagaccaattatgaataagaaaaatacaatatgttgtttttacctttattccttcatcagtgcttgttctttctttttagagatccaagtttctgacctgtataattttcctctgcctgaagaacttctttttgcatttcttgcatagcaggtttgctggtgataaatttcctcagtttttgcttgtctgtgaaagtctttattttttctccacttttgaaggataattgcactagatgtagaattctaagtgggcgtttttttttttttttttttccttcaacattttaagtatttcactccacactctggcttgcatggcttctgtaattcttatcctcattcttctataggtaaggaatctggcttcttttaagatttcctctttgtctttggttttctgcagtttgaatatgatatacctagatgtagtttttctttttttgggtgtttgtcctgattggtgtttactgacttttctggatctgtgatttattgtatgtcattaattttggaaagttctccgtcattattccttctaatatttcttctcctttctttcttctcttcttggaattctgattacatttatgttacagctttttatattgttctatagttcctgaatattctgctctggtttttttcctcccttaattctctctctctttttagtttggaaattcatgattgactttcaagctcatggagtcttaaaaaatttcttaaatttttaatttttatgggtacatatgtgtatacttatggggtacatgagatatcttgatacaggtatgcaatgcataataaccacatcatggaaaatagggtgtccatcccctcaagcatttctcctttgtgttacaatccaattacactcttttagttattttaaaatgtacaattgagttgttgttattgacattagtcaccctcttgtgctatcaaatggtaggtcttactcttcttggccatttgagtctgctgatgagcccatggaaagccttcttcatttgttacagtgtttttgatttttagcatttccttttcaaaggagttttaaaaaaatgtttccttctctctggtttcattaccatttactttctccattagaatccttaacatttttcatcatagttattttaaatttcctatctgttaatgacacagataattccaacatccgtgacatatctgagtctgattctgatgattgcttgtctcttcagaatgtgtttttcttacctttcaccatgcgttgtaattttttgttgaaagccagacatgatgtgttgggtcataggaactgaggtaggtaggcacttagtgtgaggttttacttaatctggctaggagttgggttgtgtttagtgtttgctgagctgtaggtgctagaggcttcaaatccccccaagggtccttgtttttgtctcctctcttgactttaggtttccctaactactattcctcagggacgctgtgtcttggaagtcttttatctgtaatccactgttacacctgagcccggctggtgtggtggtagggcatatgtgagcagtaatgttctattaaccatctaattaagagcaaggatggaataacttccctttggtaaatggtaacgttacaggaaaggggtcccaatccagaccccaagagagggttcttggatctcacgcaagaaataattcggggcaagtccgtagagtaaactgaaagcaagtttattaagaaagtagaggaattaaagaatggctactccatagatagagcagccctgagggcttctggttgcccatttttatggctatttcttgattatatgctaaacaaggggtggattattcttgactcccctttttaggccatatagggtaacttcctgatgttgccatggcatttataaactgtcatggcgctggtgggagtgtagcagtgaggacaaccagaggtcactctaatcaccatcttggttctggtgggtttcagctggcttctttagtacaccctgtttatcagcaaggtctttatgacctgtatcttatgccgacctccagtctcattctgtgacttagaatgcgtaactctctgggaatgcagcccagtaggtctcagcctcattttacccagcccctactcaagatggagttgctctggttcaaattcctctgacagaaaaactttcccccataagaaaaaggaagatggagaacatggtggcttcagtgagggtgtctgaagatgagggacttgccttctgctggcttccatttcttccatgaattttgaagtgagctcatcagctaagactatgtgttaaatatgagctgggaaaagatatgacatagccatctcagaaagggagaaacaagcttggtaggaaaacattttgggtttggcaggcagtgttgactattcatttaatgtttgtggccatgaatttaatgcagctagtcagcctggttgtgtgacttcctctccatcccaaagtgttcatctgtttggatgggagcttggggttggtggatagttgggttccatcagtgttggaatttggtaaggatagtgtgacacagaaagggggtgtattagtgttccctagagggacagaactaatagtgtgtgtgtgtgtgtgtgtgtgtgtgtatattctatttttatatatacaatagtatatatataacagtgtgtgtgtgtatatatatgtaggagtttattaagtattatcttacatgatcacaaggtcccacaagaggctgtctacaagcttgaggaagaaggagagccagtccgagtctcaaaactgaagaacttgtagtcccaagtttgagggcaggaagcatccagcaagggagaaagatgtaggctgggaggctaggtcagtctcaccttttcatgtttctctgactgctttatatttgctggcagctgattagattgtgcccaccagattaagggtgggtctgccttccccagcccacggacttaaatgttaatctcctttggcaacaccctcacagacacacccaggatcaatactttgcatccttcaatctaatcaagttgacactcagtattaaccatcacaaggggagatgcaggagtagagggtatgtgcaagggagtgattatgagtgagtataatgatggagccagtgtgaatagtgaaggtgaagcgaagggtaggaatggatagtaaaagtgctgtgtgttcaatggattaaatgtctaaataagtttgaagattgtttgcagtgaatgcagagtaagtaagtgagctgaacagaggaagggtggacagagtggaggatgcttgtagtgggatttgaggtgatgacaaagtttaggatgtggccatgtgagatagtgactcagaaggaaaaagcttcaggtgaggaaataaggaactgagaaactggcttttctggtaggtctttgactctgatgttaaagtcactgaaagtggtgaaggtgttagggaagcagaagaaaccctctgagaggcggaagctggagtcttcagggaatgagaaggcataagcaggagggaggtgaaaaacagcagtgaggatgagcagaaagtggcagagccagatggcctgagtgccacagagcagggatttgtgttggagggagggagggaaatcatttgaaggagcggtggagagccaggaggctgcctgccctactccctggtcttcagatatatgacgtgaggacagagggctgtaggagaggagaaggcaagtttccattaaggtcacagaaggttaaagttcagagaggagatggaaggacatagtgggcatactatttacagaaatgttgaaagggtgggatgagtctgtggggagtcggaggggttggggtttccagagcagcgtggagttcagagccctggtgagagaggatgactgggtagacctggctttccagcagagattgcagtaacaggactcccagggccagcatgccctgttacatggctatctttccacttctccctcctagcttaatttttagaaactttaacagatggaatgcaaaatttttatttttatttttacttcagagatcagtcctcaccctgtcgccctggctggagtgcagtggtgtgatcatagctcagtgtagcctccaactcctgggctcaagtgatcctcccacatcagcctcccgagtagctgagactacaggcaacgcaccaccatgcctggctaatttttgtatttttttgtagagattgggtcttgctatgttgcccaggctggtcttgaactcccaggtttaagcaatcctcatgcatgcatatatatatatatatgcagctttgataatttaattagtttagcctgtcaggcagctgtgatagtgtagagaacgttgtatttatttgtaagtcttaaggtaggattggaatggagaagtcaacttcactgaaaactagcaagtagaatgaaggaaacacagattagttgaggacctactatgttccaggctttgtgccaaacatctactttatgtaggtgatttcacaagatggacatgttggaaaaactgtgggcattggaatcagtcctgggtttgaattttagttgcttggctgacaaactgtgttactttgggcaagttacctgtgctcttcagtcttacttttctcatccatagcgtgggaataataacatccacctgttgtggttgctgtaatgagctgtgcaagaaattctaatcagcaggccgggctgagaaccactgctgcagagtgattagcatttgttccattttataggtgaagaaactaaggcccagtggggctaaatatgttgcttacggccacacagcacttaaatgatatagccaggattgaaagccagttttttttgaccccagaaccttgttgtatccatttcattgagtttttgccttaatacatgggaagctaaaggagcccccccattagcatgtctgcccaaacatcaggcagcatgggatgggaggaagggatcaagtgaagggaaggcaggctccatggaatctaggtcagcggtttccaaacctggctgtacttacaaatcatctggaaaatggttaatctgtaaatctccagggaccaccctaggcctattggatcagaacttctggagcatgggaaccgggagtatgtatatttagaatatctcccaggttattctgagactgctagcctagttccggtccttgggcaagtttttgggaaccactgaattctaatcgatgtcctaaaatgattaagtgattatatcccagtaaaatactgggtgtcttccagtgccaccaaaattggcctttaggggttgagtgctattgccgtactttaagatcttggtgcattacctgaaacggacactctgtctgtcattgaacatttgaacttcgaatatataggaaatgtcaagttggcatactctgctataacaggaagagtgatttgttatttagagctgttgttcttccttctttccccttgggattcctgcccactcagtcagattagagctatataaacaagctcgtactactgagctagcacacatcttgtaaattttttttcctgaagtgcttaacgttgctgatgtcagaaaaaaaaaatccattgggttttaatgggctgaggcaaacaatgagaatttgatataatatggaggagaggaaataacttcaacagaaattcttatttggcagcataaatattcaaactatattacagtcagagtttgattgcttctcctacatggcatttccctgaatagggttttgagggctgggcactaagagtggcaggcatgatgtttaaagcatttagttgcaagccatggtaatttcagtgacattgtagggtaattgtagttggttctcctcttagctctgtgtcaggatcacctgaggaggttgttggaccgctgaaggcttcatctctgatgcacgagtcagaacatctgagggtgggggttggggtgggattctccattgaatctgatgccagtggcctgggaatttcacttggccaaaccctggcttagaacaaggtcactggtcagtttcgatattcattctgtgctggggcatttccatgacttagtgtcttccctcttcaaaagcaaccctgcgtgatggaggggtctcatcttccaggcaaggagctggaaacgtagggtgggagagcccattgtcaaaggccacatagtagccttaatgaggctagagctgagatgtgattcccagtctgacttcaaagcccttccttttcctataccatcgaggcccttccttcctgctctgctcaacattgttagctgccgaaccctaggctttgcttgttccagaggggctggcattataaagtaaacagcaggcatttattgtaactgcaagttacagatgcagtgtcagtttggagtagacttgcaggcacaatcctgactttcaatgattcacgaatctgtttgtgtcacaggtgctcaattgtcctattatgcatagagcatccccttcactatattttcttccctcaccacatattccttcttacctaaattgcttatgaattccagaagtggattgctgagtccaggctggttcatatcaataaaccttggggaaaatctttatgtgtgatgctatacatgggtctttgttgatcaagagtcttctttattggccacttttaatggcttgttatccagatgaatcttctggaaggaggacactgcatcctggtggaattttatcagttccatcattcattcaaacatatttaagtaccttctatgtgccaggttctgctctaggtgccagggagagaggggtgaaccccaacgataaagtccctgcctatgaagaactgactttctagagaggaagtccctgatagacaagtaaacaaagtcccgcagattcagatagttgcgaatccctgttatctcactctccacacttggctgtctcccacttaatctttctgggatcagattatctttgtggcttttttctcttgactgtctagcacaaagctgagccgcttctggggcttcagatttctatgcctgtgtgtgtgcatagccttggctggaatggcaaactttgcctctcccaggcttctgctcatctgtcacctcctcctactctgtgccatcataattgagcaaccacatattacagtgtcctttctgtgaacacatctgttattcctaccggtctctgaacattttaaggagaggatctgtgtctgacttatctgtatatccccagggcctagcatggaaccttacaaaagtagatgctcagtatatttgctcaaagaataaatgatgagttccaaagaacctgagggtgggtggtgtggtataggaattccgtcatggggagggatgctgagtcagatgggggatgctccaccgcagtggttttgtgatttattctttgagacattgagtgctgtcatgaatagaggagatgggctgggatataggcagtattgacagagacacgtggcatggaacattctggtgagaacctttgaaggaaagttagaaatgtgaggttctgagggtctagctcagagctggaaggaactctaaggttgctggattttatagccaatgcccaactgaggtccagggaagctgtgtgtcctggttctgatagttggttagttgcaaaggagctaggggtggggtgataccaggactcctagttcagagggctttccactatgctggggctatggtgtgtgacagataacagattaaaggcacagagaggagaaggaacttgcctaagatcacacagctaggaagtggtggagcctggatttggacatggatctgtctaatgagaggcatcttgtaaccatcaagctgtattgtctcttcttgaagactgtgaaatgcaaggtcctagcccattttcagttttcctcttgggttagctgtgagtccatataggaaaataatattaacatgctttctttcttttggtatgcagttacatgttttcagaaaaatgttcacattcttcaaatgttaatattgaagcccctgggttgtttactgtgtgtatatatatgtatatataagtacaatgaagaacattctgtttttctctaccactaaatttaaacccatttctattgtactccatttaaaagaagtattttacatcatactataatgaatgaaaacctagtcctttaatttcacaagccccagctttaatagtcaatgaatttaattagaaaatctttacctatgtaggtttcacatccagttctctataacatctgttgacctatggactagaaagtatattattattttagaaatgattctttctagacacaggaaagctaaatagcttgtctgagtttcaaaacgagttaatagaggaaccaaaaatagaaacatttctactgaatacgaggcttactaaaattcttcacacagagactatctgcattcacttagtagtttccagtctagactctggaacatcagcctgttttaacacacacaaatgcttctgttggtgggagggggtggctgggcagagggaggccgggcagagggaggcctgacacgtttgtttctaggtcatttctaaccttgctattataatacagttttctagatagaagagaatgtgctcattaaagtgttcattttaaaataaagcgacagaaacttaaaacgtctctattacatggatacatgagtatatataaatgaactcaatttttgttttcatgctctgttgtattctgtattaaggcaaaggagtaggcaactaagtagttgtttaaaaataaaactgtgtgttgttcatttaattttaaaagccattggttagaatggtaatcagtgtttccatgtagtactatattcatagaaatcctgatattacagtgtatagagataatattatagaatgatgctctttacctctttatgtaatctaattttaaaaaacattgtaatttataaatagtgaagaaagcaggtagtgttattcgaatgggatattttcggcaattaaattcttagcataaattacaaattcctctctctcccattttccacccaaatttgtttttatggaatgacctttggtagcaacttgttttataataaaatgtttcctgaatttgtattttgaattgaaatggccttttctgtcacgtatggtatttataagagtttctttgatgaaaagcctctgaattttgtgcaaataacccaggcagcctcttagatgagggataacatttgtataggacttttatggctttatactctgctctcatactcagcttatttgacccttacctgcggggaacttggtggaattcacattttactgctgaggacaatgtagaggaaggtgccttggcatgactcagagcatatagcaggtgtttggtatgtttgttttaaagggaaattaacaaaagaaacccaaaagattcttgtacttgctcaaggtcacacaataaatatagtgtcataccaaggattgaacttccttcttcactcaaaacttccatatacttgttcttatctcactgttatcttttcaggcttttcaaaaaggccacattaaatatatttatttttcttaattgaggtgaaattcacataacacaaaattagccatcttaaagtgtataattcagtggcatttcatgctttcacagtgttctacagccatcacctctatcaaggcccctgaaggagaccctgtatccattaagcagtcacccattccatcctccctgcagctactggcagctaccaatctgtttcttgtctctgtggacttacctattctggatatttcataaaaatagactccagcaatatgtgacgttttgtgtctggctttttacacttagcgtgttttcacttagcatgttttcaaggttcatccacgttgtagtgtgtgtcagtactttatttctttttattgctcaatgatatcccattgtatggatatacacgttttatttatccattcatgcactgatagacatttgggttgtttcccccttttaactattgtgaatagtgctgctatgaacatttgtgtacaagtatttgatatttgttttcagttagtttgtgtatgtacttagaagtggaattgctagatcatatggtaattctgtgttcaacttttttgaggaaacactaagctgttttcagcagtgactgtgtcattttacattcctaccagcaatgtttgaggattttgatttccctgtatccttgccaagacttacttgaggttttttttttttaaattataataatcttaatgggtatgaagtggtatctccttgtggtctggattttgatttccctaataaaatattcatattttaatgcatagaattaatcagaaaatgagctttggcaaggtgaactcaacagcaaaatgattggcttcaactgtcttcaggagattatttaagactgccgtggctgggtgcggtggcgcacgcctgtaatgccagcagtttgggaggctgaggctggtgcatcacctaacgtcagaagtttgtgaccagcctgaccaacatggagaaaccctgtctctactaaaaatacaaaaatagctgggtgtggtggcacatgcctgtaatgccagctactcgggaggctgaggcaggagaatcacttaaacccgggaggcggaggtttcagagagctgagatcgcgtcattgcactctagcctgggcaataagagcgaaactctgtctcaaaaaaaaacaaaacaaaacactgctgtatattcactcctggggtgtgcgattctgagctgaaaatcaataacatgttgtttggggattagaagaatatttgtggatagtaagactgcaatcatcccctaactttaaaaaatgtatcatgtaatatcatgtttttgttcatggcatctgccaaaagttacttaattctttgcatttcaaagccctctttatataattccttcgtgacttaatggtttattcatttatttttgcagtgtgagtgaagacactcaggatggctcaaggatccggggatcaaagagcagtgggggttgctgacccagaggagagttctccaaacatgatcgtttactgcaaagtaaggcgcctggtcaagtgccgtgcgtgctgtccgtgtggactgttgtgttctgtgtagggctgataaaaagacaaatgttttctgcctaaactgccttactgataaatgcatattttcttctcacatcctctggttctctagttctaaaattcaaggaagttcatacttgagcacttggtatttaacacttgaaaaatattatgccatttagttttctttaaacccaaaggttgcctaagcaatgcagatgggaagacacattctccttcagtggaaaggccttagtgtaagatgtatgaactgaaagttcttcagactcgtagtatgtacaaaatctgggctgaatgctgtgggagatagagaggtatatttgtatgagatgcttacagttggtaggagacataagatgtacacaaataactgttatagagtctaaatgttaatttccaaaatagatgtgcaagtagagtgttacataatttcagaggaggaggccagttctcccagcctcagaggtgagaatgggcttgtggaagagtggtctttgaactcagttttaaaatatgtgcaggattgctttatgtggaaagcagagaggaagaacataccaggtgatgagatgtttcagcaagggcacagagctgaggaaagtaacagcaaccggaactggttagcttggacataggatgcattacaaggagtaaatggagataggattttgggaagagaggctggctggagccagatgttagtgttgaattagacaatttaatcaagaaaaacttctgtgccaagagttgcaagattgagatctctttgggattatgactgttgccccattgtgctgaatggattgttatcaagatagagcggaggctctaggagagagatttctgtgtctgtgtgaaaggtaaggagggaaaggagagacactaatccagcctgtgaaatcaccttcagaattaagagaaactgataagaggaattaaagtctggattaaaaatgacttggaaactgaaggaatataggcggcaagtagagggtcaaagatgacggggtttttgacgttgggtaaatgaaaatcattggtgctattaattcaaattgggatatttggaaaaagaatacattttaaaggaagaaaatggcacataagtttattttagtacatgctgaatttgacataattgcttcttattgtacacctttttgatgtttgcatgtttgtgaaaatttaaactaactctcttgtatgttaataaggaaataagttaatgttcatttcactaactacttgagtttctactcagttctgtgcattctgagaggctctgtgtattacttatatgggcaatgtggaactagatattcctggatgatcaatatggtgaatttttctcttttccttgtaaaaatagagttctcaaattattctggctttgagtgtaagattctgtaattctttgctttgcaagagaatgtctagataacccatctctaagaatcatgcttattaaattgcgataaagaaaaaaataggttaatgggactcagcaattagtgaaacatacagaataatagacattgagtcattgttactttcttaacccacccccaaactgggagaccccgtgccaggctggtaggaacatgggctttggagtgagacttaggttaaaatgccaactttaccactctttagcagtatgactgtaagttagttctttaacttccatgagccacaattttttcatctgtaaaaagaaaaaaaaatgtgggaggaaggtaattgtgaagatcactttagataaatcgaatgaggcatcttatatcctacttagaccacaatgtggtccgtaatgaatatctctttttcttttcatgtttaggtcttgtagagtcagtgacacttggagaggaaataaatgataaaatctctaaatgttggtgctgttaataagttgtctagagcaaatttatacagtgagtttttttttaagacacaggaaaacaataaaaatatttttatattcttcagaggattgcaaattcatggattattaaagaataagaaatgcaaaggtcatgtaacccaaccacctttctactagaatgtttgtattatgtttacaggaaaaaaaaacttcctgcaggtttatgagaacttggtttttactttttggtggtagtaaggggcccttttctggtttaatttagtaactaacatgtcaattgctgtagttctttagagaaatgacaactagtaatgaaactatatcttactttcgtgtgacaaacttgtgtaaagagtatatatatatatatatatatgttcatgtttatttgctatattaattaccataaaagggacattgaattggttcagtctgttagaaagaagacacacttattgcacagtgtgagctcaggtcctgacaccattttaaacctagttaacctgactgacttaaaccatggttgtacttgaactatgggattttcatatagttttctactcctgatgctgtaggctgccttttggctacaaccaagaacttacttgctgtaggacattatcctcaaggtatcatcagtaagggttggattgtgaagccaatgacaattcaaagcattttctttggaagtccttttgtgtaatcaattattcaaagtcatagccataaacccaaacctttccttagatacccacgactacaatttacatttaaaaaattgtgctttcatttttgttttctttctcttgtttgttgttgttgttttttttctcttgttgtcagacactttcagtgtgaaatttttgcttggactgcattgtgttgattcagatgctgacatttaaaaagccaaatctagagaaatgaagcttttgggtaaactttcgagtaataagtggatgattatgtccataatgttgttgtgacttttaaatgacatttaggatggtaacctcctgacatatgagtaatgatgggtgggtttttaaagcccacacttttcagaacactcttcatttccttttcatgttttcatgtcattaactgtgagaagttgtactttcccaaggcatgacttatttattgacttgaacagactttctaatttagtttttcatccctcatattcacagtttggattggaggtgtgtatgaaaaatgtattggtcacattaaagatctatttaaaagaaaaccttaattattcatgaagacacccagacctgttaaccttttttatattcctgtatccttaggatcctgagttactgaattgcccagtgtaatgatgatatttgaacctagctatacatcacatcatttagggtgctttataaaaatgttaatcctcaaaggaccccctccacaaggtatttctatttaataggtctgagctgggtcctaggaatctgagtttcaagatgttctcaggaaaatctgatgcccaactaagtttgaaaagcacttacttagtcttttacaatatccagacatagtatgtgttgcaaagtaatgagagagttggtgttttgaattagatttttgatttcataattatttgtagatctctcaaaacgtagaagaaccaagctcttgtcatagggattttagtagcttttccttagatattttctagtcttattttatagatgaaagaactaaaagtatagagagggtgagtaacttgattaaggctcctcagcactttcccatggaagccataatggtgtccagggagcctggccactccaatcagttgcctttctagcaccctatgcgactaccatgttatcaaccacagactactgttaccacattgttggagctgagtagccatggggcacattaaattaatgaaaataatatgtggcagatctttgactttcatgtttcttctgggagagttgacttggattaatgtctcacttttttattgatttttaaaaaatactttaagttctagggtacatgtgcacaacgtgcaggtttgttacatatgtatacatgtgccatgttggtgtgctgcacccattaactctcatttacattaggcatgtctcctaatgctttccctccccactcctgccaccccacgacaggccccagtgtgtgatgttccccttcctgtgtccaagtgttctcattgttcaattcccacctgtgagtgagaagatgcagtgtttggttttttgttcttgcaatagtttgctgagaatgatggtttccagcttcatccatgtccctacaaaggacacgaactcatccttttttatggctgcatagtattccatggtgtatatgtgccacattttcttaatccagtatatcattgatggaatgtctcacatttttaatgctaaagtttcattctactcattggtgcttttgcttcttcggtaaagattttctaaaatgtttacataggtaagattgcttttgagtaagagtaggttgctttctgattttgtttggatctttggtgttaacaatgcctcttgacaaagttctcctaactagactggtaatttgatttgtttgggtcaggaggcatggaagacatcacactctggatgtcttctacatccagaaggatggaggcatggcagatgtcacactctggatgtcttctacatccaaaagctggaggctctgcctgtctggtcccagctttgtgtggagaacttcactttcctgattctacttcttgttttgttttctaccttcttcattcttttcctccttccttttcaattgtgagatacttctaacacaaaaagaatatattcagtgtccatgtaaagtagaaagaattaaaaaatgaattatatgcactcaccattagcttaataaataaaatgtaatactttggcctcatttccccttctgtaaagggaggaaattggtctaaaaatgtacaaatacctttctgcaatgatttcaaagttccattctataactttttgatctttcgtaaattagtacacttccctgatatcaaaacaatgttgtgagactatatgcacgtttaaaggtcttttgagcttttgaagaaatattttagatagttgtaggtaatctaaattggattgagataaagcccagttaagtcaggcattagaataaaaagctttaattgtaattatttaatattcaacagtggaatttagatgacatcttggtggcaacctgtttctttggcttgctaataacatttaagacatttataaaattatcattttgtagtattaattatatgctatatacataacaagtggtgtttaagtagcaacactgtacattgccagtagtatatagtgtcatagatgaaataggggttttagaggaagacaaaaaaggccaatgttcttgtatatcaacaggttagttgcctagcctcgtcactgatggcttccttcacctattcatttctagttattgactccttttctgctggaatttgagtctagcctttatgttgctctgataccccaaggtcactcttcctaatgatttagggcccttgaagtcctgggcagttgttggtttaggcatacatccagaaagtaaatgtcacactattttagttacattggctgtggtatgcagcaagaagggaaggatctagcctggaagaatccgatgctatggaggaagctagggatagagtgtggtttggaattcatagagggcagtggtagaagccagcacaattgagagtctggggacctgcaggtcctggtgactaaggcatgatgaggattagaaactgtcgaatcaggaaatacgtattgagtgtcatttgtgtgccagacactattagatgctaggaatgcaagatgagaactgagccctgaatgagcccacaggccagctgggggtaaatggggaactagacaattacagtgttggtagaagcaactgaggggcatgggaggaggtagaggggtcatgtagtccatcccaggagaggggatgatgatgtagaagacatccagaggatttggcacctgcttcgattcttgaaagatgactaggaattaaccagatggaggaggagagagaaggtgtaggaggcaggactagcacctgtaaaagagcagatttgtgatgtcgtataccgagttcaggagactttaagtggttgatatgaagctaggtttctgtgatgaaaggttgaggaatagagctagacagatggattagggccagatcacaaaagaccttatgtaccatgccaaggagtttagacattgtaaaagtatcttccctttgggcctccacacccaagttcaactcctttgcatgctgctgtctgccccagaggctgagctgtgaggactacatttacagggctcctgtgacctctgggtttcagttgggtttggttagtaaaagtctggaaagagatgggagggaaggagaatcgcaatgtcagagaatttcttctcctgggtctcactctgcaaaaccttgcactggccatatccgtctactgaagtttgttgattctctcaaggcagactactttcctcttctgggtccggacatcctttttgtctactcatccttttgggcctttgccgactactttcctcttctgggtccggacatccttttcatctactcatccttttgggccttggggtggttccagtttgtatttgttatctcttgctgtgtaacgagttatctcaaaactcaatggcttgaaaacatttattatgtcacaatttctatgggttagtaatccaagtgcagattccgtgagttctccagcacagtgtctttttaaaaggctgtgatcaagatgttgactcggattatggtttcgtctgaagtctcagctggggaaaagtctactcccaaacttacttgtgtgactgttggctggattcagctccttaggggccgttggaatggtggactcggttcttcgttggctgtttgccagaggccattcttagttatttatgacacgtgtctctccatatcgcagctcataatatggcaggttttttttttttttttttttttttttttatcagagtgacaacaggcagagaaggaagatgggtggtagtagtcttagtgttttataacctaattttggacatttttttctttattatactttaagttctagggtacatgtgcacaacgtgcaggtttgttacataggtatacatgtgccatgttgttttgctgtacccatcaacttgtcatttacattaggtatttctcctaatgctatccctcccccagcccaattttggacatattatcccatcccttttgatagtaagaagtcactaggtccacccctcactcaaggtgagggatttacacaaagatgtgaataccaagatccagaattcagaaaatctttgtgggccattttggaagccatctaccacacagctctacttctactagccaggggtttctgagtgttttttttttataatttccctgtaccctagaactcctttaaacttggtccttttggaaatacattttccttaaattgtcctatgtatatcatctgtttaccaataagaccctaacgaatgcaagtattatcccacaagcaaagggaagcgattgagactctgcgtttcttgataagggaattcttcatgaaagggtttgaagcaggggagtcatttgtccaaagtggaggatgggatctgaaatggggaagtcaatgtggagaagattcagtgtggaggtcaatgggtgatcgatgtggaagggttcggtgtggagggagagtgttggagaagtggtaggattggaggtaggaggacagtttagagattgaacaggaatccaggtgaggaaaaatgatgcccaaatcagtggcagtggtaatacagatgggaggatgtgtttgagagatgtttaggaggttcaggcaacagaatttgggggctgagaagacgtagggagaatttgagaataatgaggaggaatgaggagtcttttccctaggctatatctgtgattctcagaaagtctcctgggataaacttttgaagcaaatagctgtagaactggattgcctgcccctctcttccctgtatgtagataaattgagagagcccaagacagagtctgtaaatggaccaggatatctgggtatttgttctggctgccccactccactagctcatttatggccatgcgtaagttgttcctactttttgttaagtctagttctttaatttgtgaagtaaggggttagctatgctgggtgatctctaaagcatttttttagatctaacattctaggtcttttgtaatctaaaatagagaaacccacattttattattttactacttcatagcctcctttactttatttttaattttctttaaaaagtgaaccgagccaaaactttaaaaacaggtaagtcagaatgtttaaaacaaatggcttttggtcttcagcacttagggcttgttttttttcactctttttttttttttaacattaaataaaattcctggccacatgcagtggctcatgcctgtaatcccagcactttggaaggccaaggcaggcagatcacctgagatcaggagtctgagatcagcttggccaacatggcaaaaccctgtctctactaaaaatacaaaaattggccaggcatggtggcacacgcctgtaatcccagctacttgggaggctgaggcaggagaatcacttgagcctgggaggcagaagctacagtgagcagagatggtgccaccgcactccagcctgggtgacagagtgagactctgtctcaaggactaacttcagaaagtgttcagggtaactaatttaattgttcagtctacattttaagattcctttcattaaattttttgaagctttttttattgccttaggaaaaaactgttctgttttccttttcccccaggattagacttgctggaagaaaagctcccccatcacattatcttggttggcaggagacaggcatgcaggcaagtcccagaccagtggtatcagtgtccacagatgaaagggatggtatttttagtgtggggaatagctcagtgtggtttcatatgatgcattttgatgagtataactttctaatttgaaaagcctttggtgtgtttacgtcttcatttaatctttccaatttctccccctcatttcatttcaaggagtctaagatttttcattttggcaggcagttgatcactcttgttattgacactcctttgcagtattcttacactgtggagaacctgaatggctgtaaattccctattggcaggattttggagaaaaaaaaataaaagcgaatagatacctgtgaaagaaaaaataaatacattttaaaataattggaggatagaaggattacttttaaaagttctgttagtttgccagtacagagcaaaacagaaaatggacacatttttttgatcagcattctctgttctaaaaacttatttcaataagggaaagaatatgcaaagacatatatatagatatagacatacacccactccaaaagaatagtgatatctttctggtaaataatatccaaagtttggaaagaaatcaaatatccattgaaaggaaactaattttagggggataggattcacatttggaatgatctcatagttagtttactggatttctgttctggtcaacctaataattgtcttgaaagtgagatggctactgacattctagggtatggttagggagaatattctttatttttaaaaccctacaagattttttcattttttaaaataaaatgtcttatttgttaaatatgatggttatgtaggtttactcaaaagtgattttttccattgctctttattattttctgcatctctgtgcttacagctgaaataatttttagtattttctttagtgcaggtctgctgaagataaattctctcagttcttgtttgtctaaaatatctttgggccaggcacgttggcttacgcctgtaatcccagcacttgggaggccgaggcaggaagatcacttggcccaagagtttgaggccagtctgggtaacatagggagacaacatctctacaaaaagaaagaaataaaataaaaaaaaattagctgtgcatgttagtacatgcctgtagtcccagctactcaggaggtggaggtgggggaatcacttgagcctgggaggtcaaggctgcagtgggccatgattgtgccaccacactctagcctgggcaacagagtgaggcatggtttcaaagacaaaaagaaagtctttgtttcatcttcattttgtgaagggtgttttttctagatttagaattctagattgtcggttattttatttatcataactgtcattgtctcttggctttcattgtttctgttgggcagttggctgtaagtttgattattcctccttcgaatgtaatctgttttttcctttggctgcttttaagatttatttcactttggttttagcagttttattataaggtgtgattttctttttaatttattctccttagagcttatgagacttctttttatttggttggtgcttggggattctttttttttttgatggaggcttgctctgtcacccaggctggagtgcagtggtgcaaccttggctcactgcagctgccacctcctggaatcaagtgattctcctgccccaacctcccgagtagctgggactagaggtgcgtgccaccacgcccaaataatttttgtatttttagtacagtcggggtttcaccatgttgaccaggatggtctcgatctcttgacctcgtgatcctcccacctcagcctcccaaagtgctgggattataggcatgagccaccatgcccgactgtgcttgggaattcttaaccattaacttttcaaatattgtttatgcctagttttctcatttctctcttcttgggattgtgttcatatgttaggacctttttcctctagatttcatgtgtttcttatgctcttttctgtattttttattcctttgtcattttgtgcttcaacatggatattttctaccgacttatcctccagttcactaattctctcttcaatatattagataatctgtggttaaagtcatcccattgaatttgtaaccttagttattgattttttaagttctaaaattttcatttaattttctttttatagtttctagttttctgctaaacttctctattttgtcatttaattcctaaacttattaatcataattgtttcaaagtccatatctgatactttaaagtctttatcacttgctggactgtttctactaaccttttctttcttttttttcttttttttttgttcttctgtttatttattttattttttattttttttaattattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccacaacagtccccagagtgtgatgttccccttcctgtgtccatgtgatctcattgttcagttcccacctatgagtgagaatatgcggtgtttggttttttgttcttgcgatagtttactgagaatgatgatttccagtttcatccatgtccctacaaaggacgtgaactcattcttttttatggctgcatagtagtccatggtgtatatgtgccacattttcttaatccagtctatcattgttggacatttgagttggttccaagtctttgctcttctgaataatgccgcaataaacatacatgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacagtgtaaaagtgttcctatttctccacatcctctccaacacctgttgtttcctgactttttaatgattgccattctaactggtgtgagatggtatctcattgtggttttgatttgcatttctctgatggccagtgatgatgagcattttttcatgtgtcttttggctgcataaatgtcgtcttttgagaagtgtctgttcatgtccttcgtccactttttgatggggtggtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgacctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttctccattgcttgtttttctcaggtttgtcaaagatcagatagttgtagatatgtggcattatttctgagggctctgttctgttccgttgatctatatctctgttttggtaccagtaccatgctgttttggttactgtagccttgtagtatagtttgaagtcaggtagtgtgatgcctccagcttcgttcttttggcttaggattgccttggcgatgcgggctcttttttggttccatatgaactttaaagtagttttttccaattctgtgaagaaaggcattggtagcttgatggggatggcattgaatctataaattaccttgggcagtatggccattttcacgatattgattctccctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatggagttcactcatgatttggctctctgtttgtctgttgttggtgtataagaatgcttgtgatttttgtacattgattttgtatcctgagactttgctgaagttgcttatcagcttaaagagattttgggctgagacaatggggttttctagatatacaatcatgtcgtctgcaaacagggacaatttgacttcctcttttcctaattgaataccctttatttccttctcctacctaattgccctggccagaacttccaacactatgttgaataggagtggtgagagagggcatccctgtcttgtgccagttttcaaagggaatgctgccagtttttgcccattcagtatgatattagctgtgggtttgtcatagatagctcttattattttgaaatacgtcccatcaatacctaatttattgagagtttttagcatgaagggttgttgaattttgtcaaaggccttttctgcatctattgagattatcatgcggtttttgtctttggttctgtttatatgctggattacatttactgatttgcatatattgaaccagccttgcatcccagggatgaagcccacttgatcatggtggataagctttttgatgtgctgctggattcgttttgccagtattttattgaggatttttgcatcaatgttcatcaaggatattggtctaatattctctttttatgttgtgtctctgccaggctttggtatcagggtgacgctggcctcataaaatgagttagggaggattccctcttttcctattgattggaatagtttcagaaggaatggtaccagctcctccttgtacctctggtagaattccgctgtgaatccatctggtcctggactctttttggttggtaagctattgattattgccacaatttcagatcctgttattggtctattcagagattcaacttcttcctggtttagtcttaggagagtgtatgtgtcgaggaatttatccatttcttctagactttctagtttatttgcgtagaggtgtttatagtattctctgatggtagtttgtatttctgtgggatcggtggtgatatcccctttatcattttttattgtgtctatttgattcttctctctttttttctttattagtcttgctagcggtctatctattttgttgatcctttcaaaaaaccagctcctggattcattaattttttgaagggttttttgtgtctctatttccttcatttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttgaaagaacatctttatttctgccttcatttcgttatgtacccagtagtcattcaggagcaggttgttcagtttccatgtagttgagtggatttgagtgagattcttaatcctgagttctagtttgattgcactgtggtctgagagatagtttgttataatttctgttcttttacatttgctgaagagagctttacttccaagtatgtggtcaattttggaataggtgtgatgtgctgaaaaaaatgtatattctgttgatttggggtggagagttctgtagatgtctattaggtctgcttggtgcagagctgagttcaattcctgggtatccttgtggactttctatctcattgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatctgagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggtatgattttgcagcggctggtaccggttgttcttttccatgtttagcacttccttcaggagctcttttagggcaggcctggtggtgacaaaatctctcagcatttgcttgtctgtaaagtattttatttctccttcacttatgaagcttagtttggctggatatgaaattctggattgaaaattcttttctttaagaatgttgaatattggcccccactctcttctggcttgtagggtttctgctgagagatccggtgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaaagttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcacttcatttcattcatttcatcttccattgctgataccctttcttccagttgatcgcatcggctcctgaggcttctgcattcttcacatagttgtcgagccttggttttcagctccatcagctcctttaagcacttctctgtattgattattctagttatacattcttctaaatttttttcaaagttttcaacttctttgcctttggtttgaatgtcctcccgtagctcagagtaatttgatcgtctgaagccttcttctctcagctcatcaaagtcattctccgtccagctttgttccgttgctggtgaggaactgcttccctttggaggaggagaggcgctctgctttttagagtttcccgtttttctattctgttttttccccatctttgtggttttatctgcttttggtgtttgatgatggtgatgtacagatgtttttggtgtgggtgtcctttctgtttgttagttttccttctaacagacaggaccctcagctgcaggtctgttggaatacccggccgtgtgaggtgtcagtgtgcccctgctggggggtgcctcccagttaggccgctcgggggtgcctcccagttaggctgctcgggggtcaggggtcagggacctacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggtgggcacccctcccccagcctcgttgccgccttgcagtttgatctcagactgctgtgctagccatcagcgagactccgtgggcgtaggaccctccgagccaggtgtgggatataatctcgtggtgcgccgttttttaagcccgtcggaaaagcgcagtattcgggtgggagtgacccgattttccaggtgccctccgtcacccctttctttgactaggaaagggaactccctgaccccttgcgcttcccgagtgaggcaacgcctcgccctgcttcggctggcgcatggtgcgtgcacccactgacctgcgcccagtgtctggcactccctagtgagatgaacccggtacctcagatggaaatgcagaaatcacccgtcttctgcgtcgctcaggctgggagctgtagactggagctgttcctatttggccatcttggctcctccctccttctgtttattttttattaagttctgggcattatacaaataatatagaagacatcatttacggctctaggacaatgttacgttacttctgagagaacttaactatttttttcttttatgtcagtcaaaataggaatggattaccttaatcaagtcagacacaaagattacttgtagctggacttcagttcttcttagggctagatatatttctagatctcctttactctctgtagggagcccttctggttccaaccaaaaccctgggtgcccctcctccttggaggactctgacctctaatttttgtcctttaaactctatgacactgccaaaagctctgttcagcttcttgatcatgccttttgtttaagaaattgacaatgctcttgagaagaacaagcagctccaattgctgggctcatcttcttagttttcttctttcaggtcatggcctcacaaactcttactgtcttggttgcttttcagtgccctcaaacatgtttaacaaaatgtttttcagcatttccagttgctctcatcaggagggtgtttctgaaacatctagttagccattgtcagaagtagaaccccagaacattggccttgagagaaggtggatccatcttttatagccttggtttgctcttaaaatgttttagaaaagacatatcctgagtgtcttagtggtctagcgtgatggtggtagaggtgaagaaaagtgaaacttccagtatatttaaaaagtggaattaacccgttattagttttagatggagatgagagaggaggattcagggctaatggccaggatctggactgggcatctggatgtccagtcactaggataagtggttgggttagtgacactggagcctcaagtcaccacagtaacagaatgacattcaccacagcctagttatgtaaaactctggacagagggaataaatccaggcaaatacctctacgtatgaaatggacctgaaaagaagctttacctggaggaaaccttacctgactccagagacctttttggtttagaaaacaggaagtaacttgtatctgtcagtatgacacttttgaacatttctgtattagtttgctaaggtgctgtaacaaagtcccacaaactatggcttaagacaacaggaatatattctgtcacagttcaggaggatagaaatctgaaatcaaggactgggcagggctacgctccatttgaaggcttagggaagtcccctttcttgcctcttccaggctttctgtggctgctggagatccttggtgttccttggcttgcagcagcatcaccctggtcttcgcctttgtcctacctcaccttcctcatgtgcctacctctgtgtttcacatggccttataaggacactagttgtgggatttaggcctacatccccatacccccaattgattgtgacctcatcttaatgaattacatctcaaagaccctaatttccaaatgaacttacatacgcaagtcccagggtttaggactacaaaatatctttttgacagacacaactcaatccacaacaatttctagtttatcaccgcgtgaagcttagtgctctctgcaaagatcaaatgaacaagtagtgtacttattgagctgttgcttctgacaaagcactgtgtggggaataaaaagtagcgtggcacacagtctctgtcctagacaactttactgtccaactggggagaccaagagtgatgcagaactcaggaggaaaataagctttggttggccacctaccatttaccagatactgcagtgggggctatacatatattgagccatttaatcatcagaatagcttgctaggtaagtggtattcaccctatattacagataagggaactgagggtcagaaggagtaaataactagtattaagtggtgctatcagaatttgaatctagatttgttgtattctaaagcctgtggttttggggaagaaactgaattatgttaaaaaaaaaaaaaaaaaaaaaaaacaaagctgttagaaattaaccataagagagttagtgtgagagctgggtgtggtggcttgcatctgtagtcctagctactgaggaggctgagatgggaggatcccttgagcccaggagtttgagaccagcccgtgcaatatagtgagaccctgtctcaaaaagaaaaaaaaaaagttggtgtggacaaggaaggcttattgaggaagaagaaatttgaagagaaatcatctgaactgtgtttttaagaaagggtaggagttggctggtggaaaagagccaaaaactgattccaggtgatgggagctacgtgaaccaaggcaaggggatagaatatatcagatgtatttaggagaaaatatattttataacactatatataagatacgtgctttatataattatagcctcattcttcatatggagaccttgaagtaagaaaacaaacatttttagctctgtgtctcacatggtaaggtattggtaaagctgagccttctgccaatgaattttttttccattcctcttcagaaataatcgctttccatttaaaaagtaataattcaatttagaaagaatcaaaatataaagtagagaaaaaatctcacatattcctatcatgcaaatatgactaaagttaacattttggtctcttcctcccagtccttgaatatgtatcagtagtatacataacacattaacctagagagtaatcatagtgtatgtgctattttgtgcttttctaccataacctaagcactaatctgtgccataatatgtcatcattatcatagttttatttatttttattatttttaattttgagatggagtctcgttctgtcaccaggctggagtgcagtggtgtgatctcggctcactgcaaccgccgcctcctaagttcaagtgattctcctgcctcagcctcccgagtagctgggactacaggcatgtgccaccatgcccagctaatttttgtatttttagtagagacggggtctcactatgttggccagaatggtctcgatctcttgacctcatgatccgcccaccttggcctcccagagtgcggggattacagctgtgagccaccgcacctggctatcatagttttaaaggttgaataatattctaagtagataatgtaccatgatttacttatttagggtttgttattaatagcaaattaaaaaattcctaggtcaaaatgcatgacctgtgttacaactcctattatatatatggttttctggaaggtcaatattgattttggcatatatagactgggcttctctgggttgttgtaaaagttctatgtcattgaactacagaaagagggtgaggggatttctaacaattagggccagtgttttcttcacctctaaaccgcatccccatcctagtgtctgcttggctttgcaacaccatccttatcctgagagctttgttgatgcctggggatattcagaaattttcgacttggaacccttccaagacatttgctattttattctctatttgtttttcttaagcaactaactaaataagaataacatttcaacctctttctactccccacagcattttttcctgcctgcaccacctctgcctacagtttaaccatggggttgcttcttatattttaaagctaaatacaaaagcacagttctgagaagcagccaagttctgcagccaagtttgaagaataaaactttaaaacagctcttctgtcacacacttgagaggggaggcaggctttgctataaataagtcacattccatttctatctcatcctttgcagtcctcttgggtaatgctttttgtatatgactacagtgttctcgaactgcccactcacccctttcaaccttccattttgtgcctcactttatttaaatgttcaatagttttggagtttagggaccctgcatgaaaggagtagacctttcctttcattcttcaggcttagatgtaatgagattcagtggctaacttattagaaactatactttctctttgtctgtaacgttttcagcagctgcctggattagtttcctattgctgccataacaaattgccacaaatgtaatggcttaaaacaaggccaggcacagtggtgcatgcctgtaattccagcactttgggaggctgagatgggattgcttgagctcaggagttcaagaccagcctggccaacatgatgagaccccatctctatttaaaaaaaaaaaaatacaaaagttgtctgggtgtggtggcgtgcacctgtaatcccaactactcaggaggctgaagtgggaggatcacctgagcctggggagctcaaggctgcagtgagccatgatcgtgccaccgcattgcaacctgggtgacagagtgagaccctgtctcaaaaaacaaaaaaccaagaaaccccacaaatgcattttcttataattctagaaatcaggagtgaaaaatgatttggcagagctgcatgccctcagggggctctaggagaattcatttcctccccttttccagcttctagaggctgcctacattccctaagtcatagccccacatcagtcccacctctactcttggcatcatatctccttctccaactctgaccttcctttctctctcttataggacccccggtgattacatggagcccacacacataatccaggggtacctccccatctcagagtccttaacttagtcccacctgcagagtctcttttgccaagtcaaataacatatttataggtttgtgggattagggtgtggacatctttggagggccgttattctacttatcacactgtcttagaaaaggaaaggaaaataattttggaatttttgtctttttcatagctagggaggaggtacgctgaagttttgtttttccttcctgtatttgtgatggttgatatgtggcaatctaaactaagtctgggatgtctgtttgtattggctgaagttcattggagggcagaaaagaggagagtttcagagactggcagtgaggatgggagggtggcttaaagaccttcacaacctgctcactgggtgctcctgttaggccccacaaacaagcccatgccatcgaggagaagtgaccaagcagatacattcaaaatgaataaaaggaagacctcatttactgtagtcccatccagtgtggcttccttataggactatttgtctctaattattttatttattttttattttttcagagagagtctcactctgttccccaggctggagtgtaatggtgtgatcttggctcactcagccttgacctctggggcttgatcctcccgtctcagccttcccatagctgggactacaggcatgcaccaccacacctggctaatttttaaacttttttgtagagacagggtctcactgtgctgcccaggctgggcttgaactcctgggctcaagtatatcctccctcctcagcctcccaacatgctgagattacagatgtgagccaccatgcttgaactatattttaaaaaaatattaattatgatactaaacaatacagtgaataaataaccttctcatgactgtccatctggcatagtagaagactttatgtgcttttttcaaacaatgagagaaagtgctggcatatcgcacttcccttagcttgagagacatgtgccaatctgcttgttgactctgccaaggcctctctttccgtcattttccatgttctggtcaggatttgtgacatatagtggctgacaaaaggcacacaagtgatagtgttggtggccaatctgccagggaagagtctgaccctgggcgctaatgtgactcaaggtagatgagcccttcgaggagctagtcaaggaaacagatgataaagtctaactatcagtgagcgagcagggggtgagcattttctttctgaagggagttattactgtcattaacttcattgcgttgctgggaaggaggggtcagtagttgaaacaaaagtctcctatggctgatgacatgttacaactttaggacagttgtcagcaagcaacttgctgttgggcctaatctgtccccatgcctttgatcccttgagcctcaggatggtttctacattttgcaatggttgaaaaactttaaaagagaagccatattttgtgacatgtgaacattatgtgaaattcaaatttcagtatctgtatatcaagttttattgaaacacagccacatcatttgtttatgaattatctatggcttttttttttgagctaccacggaggagttgagtggttgtgacagagactgtccgtatgaccggtgaagcctaaaatatttactaactggctttttacagagaagtttgcagcttctgttttcggagatttgaaagagactgaaaaagcatcggcaaatgtccttgttgggacaatatttccataggaaccaagacccagtgattccatgtggtgctgatttatttccaggaacccatggagggtctaactggggagggggtatacaagataaattagaaacaagtgcacattcctgtactacaaaaaatatacaagacctgccattcacccctcaaataatatgtttcctttcctgaggggtcacataatttatgccagtacattattgatgagatttttgtttgtttttttaaaataaaaaacaggcatattgagctgctggaagtgttgagctggctgttctgaaatatcccactaggatattccacttgctggctggctacctccatctcagatgcaatgtccaaatggctgtcaatttctgcaggacccactttgtgccaggcattgggccagtgctttgggcacgtgaattgctcacactgagagcactgctgtaaaatcattgttattcccatgccgcatatgaagaaaggagcttacactgggtaaacccatgcctgggcctcccctgtaagtgggaatcccgagttgcaggtcaggctgtctcttcttcacagaccatgctctttcacaagacctggaaggaacaagacaaccacctggggagctgcttacttctgatctttcctctgggatgccagggctatcacaacctcataggcaagatactctaatcactgagttatggtgttcggtgataatatcgacttccatttttataatttcttctagcactctgcatcctgcatgttatatttgtaaaaggcctgtgaaaaacataaggcagacatatctatttctgctttgtaaatgaggaaactgaagctcaggggtaaagaggcctttctaggctcaaccagcttttagtggcagagccagacctcttgacctggggtctggtgcctgtacactacttcccatgggccaggtctttgggaatagagctgcgtcactcacacttaccttagcagaggctgtgatagactctaagccgtatggtttttagtttatcctcagtgaacctcaggtcatcaactgacctccagagacgaatttcacgttgtagatggttttttttgttggcattactttacaactgtgactctgctgaatgcactgtacctttctctttcctattaccacatccattgcttgagtttcagtcctgtcttagtccattttgtgttgctgtaaaggagtaccagacactgggtataaagaaaagaggatttataaagaaaagagggttatttagctcacagttctgcaggtgtacaagaagcatggcaccggcatcaacatgtcagagaaggtcaaaggagaagtgagtacgtgtgaagagacaccatacccaaagggcatcctggctttacataataataaaccaacctaatcccatctcgccagagtgagaacagcagcccagcacgaagtcattcatgagggttctacgcctataactcaaacaccttcccctaggccccaccttctgacaccaccacagtggggagcaaatttcaacatgagatttgatggggacaaaaaatcccattatccaaaccatagcaagccccaatccaaaccaaaagcagatccccattcgtggttcccctttccacatggttccaaatgaggaagggcaaaattcatgtgttctgctcagtaaaaggttgaaaagttattgggaaacacatcttccaaggtttgtgtcctttgggacatgggaatatgttattaaccaggacagctgctcacagctgcacagggatgtactgaaacagctcattttaagcaaattttaagtagtggagaggatcattcctgggcacatttcacaagcattctgtcttggttttaccccaatctctgcatattccttcttcgtcttcattcccggggcagcttcttctgcccaccccgtgaaactttggcccattcttttctgtatgctgtccaggggccatctcctcctctctacatgctgcattgaggatccccaaattgctatcctctctccaaactccaaatgcctatatccagctaccaaaaagacatctctgtttgaatcttcctcacttaccacaaacataacaggtagaacatagcttatttcttgccctgccaaaactgttctccttctgagcttcagtgcttggtgtagcatcctccacatagttggcatcggaggcagaacctgaacctgattctctttgacaggcctaatcactcaccactctacgcaatatgaaaatgacatgccatgtgaatccaatgccatgtaaaaaaagataacattttctgtttgtctccctaggatattgtaaatgcttggcaccaagtaggtgataaataaatgtgaaggacaaacctgttgattaagcgttcctgagacatatcctttatctttctcagatgagattctctgccacatagcttatccctgtattgggtggattgtgtaactctgaggttcaaacattgggtattgcctctaaaccttgcacagttatttatctcagaactattgagtttggcggctgtccacatcatgtaacaattctgctgttaccttcctttccttgttttcttccttccctctctcctcatcttccacattcctatctgtgagagaggatgagaaaaaaacagacaagaagacaaaccaatatttctctcaccaatgaaaaatacctttccgttctgtttttaccattaaatgtggtatttgccctctgtgtctcaattaaaacaggttatttccttcttagtttcttcttttatattttttttcttgtttcagaaatggttcatgttaattgtaaaagaaaaattccgaaattatagataagccaaagaaataaataaaacatgtaacaaccccctgctcagagagttgtggttaacttttgaagtacctacttccatgcttcttttctaggtacatattttaacagaaatagagacttactgtacttgctgttgggaagcttcttttcacataatagattgagaatattttcttgtgacagtcaatattcctctagaccagcaattggatcactttgtttaaagggccacatagtaactattttaggctttgtgggacttactgtctctttcagctaatcaactctgctgttataagtgcagaagcattcacagaaagtgtgtaaatgaatggacatgtctgtattctaataaaactttatgaaaacaggcagtgagccagatttggcccatgggtggggctgtagtttgcctatgcttgtctagaatatcttttttttttttttttgagacagagtgagacagagtcttactctgtcacccaggctggagtgcagtggcatgatctaggctcactgcaacctccacctcctgggttcaagtgattctcctgccttagcctcctgaatagctgggactataggcctgcgccgccatgcttggctaatttttttgtagttttagtatagacagagttttgccatgttggccaggctggtcttgaactcctgacctcaaacgatcctcccaccttggcctcccaaagtgttgggattacaggcgtgagcccacactccactagaatatcatttttaatgcctaaatagtgttctatcttattgatatatcattatttacttaaccagtcagagtaatagctaatgttgtttgaggccttactctgcgcttgcaacattgcttcgtttgttctatttgcattctgacttacacctgcccacagccctgtgtagtgtaggtattattctttctatttaacagatgagggaactcggataaagaacaggtgggtaatttgcctaaggttagatggttagtaaatagaaaactcaaaatttaaatttgtttgatttttagaagccatgctcttaactactcattatgtttttacgcacgttagtaattatttgcttggataaattcctagaattagaataacacatgcattttaaggttttgatatttgttgtcaggttgatatatttggccaacttatatttcttgagtggtatatagcagggctgtgtttctacacccttgtctataacaaggactcttttgacgctttgctactttaataggtaaaacaagcttcatctttttttatcttatgaatactctctatatttcttctaaggtgagtgtctgatgcatgttctttctccattgttcaataagagcatttgtcttctctattaatttgttggagccttttatgtaagggacttctgtggtttttaagttgatgctacatgacgtgttatgaacatagccttttactttaaggagatgttgtctttacaattgaagataattaaatggaaaagtatttagttttaatgcagcattaattagactcctggaattgaaaaaattcccagaaactgtaaggtaagggaggacttactcctgttggggaacttgtccctttagtttccatctcttaagtactagaatttgtgttctttaattggaaccattgctttgctgtggccatggcaacacatcttagctgccatgaacagcgcacactttgacaaaatattttttttagagagtggcttttagatggaattcattttccaatgtattcatggagtctagatgaattaatggatggtagacccatacttttataataatagtaataataatgaaatgaatagttactatctattgatcccttactgtattctagccacaatgctttattttatattatttcatcggatctttgtgataatcttatgtcatagatattgttgttatccttactttatacataaagaaattaacacagaagagttaagtggcttgctctggcttatacagatggtaagtagtggagtttgaccttgaccttaaccttgattttctactgcgtgagtcttacaggtttattatagcctttagggtatatactgaattcaacagtggtagcatggatggcaaatcttgatgtcatctagagtctaagatgacactagcatcagtgggccacagggaatctgacccagactttcataacttgtattattatgaagattagagttctgaagcttactggattagaagagcacgagggggtagctgccccaatatattctaatttctcttgaggaccaccaaattggcagagtgtctctgatagggaaaaggaagagttggaaggcatcttagcctctaggacagaagaaccatttttattggccaccaaagttacatctagttgcctacaaatttatatccaaactccttatcctgccaattcagggttctgcaaactgatgccaaactatagtttagtcttctatcacatgactgcattatacatacccaattatctgggcaaacagacctgatccaaacacagtttgtactttcctttcctttcctttgtttagcctgttccgtctacttggggtgtctttgatttctccagcctcagtctcccgctgttagaattctgggcctccctcaataccaaggttaagtagtacctaacgaagaattttttatttttacagacaaaagcagtttctctcctcctctttgattcttatggttatttatattactctcaagtcaatcataaccttcttatttgtaggatagtttctccctgtaggacttgcaggattcctcgaatacagtgcttttccaaaggtaaatgacgacataccttaatcttgttgttagggattctgactctgagagacatgaaaccactgtttagagtcttgttatgtatgaattgtgtccccctccacccagtccatatgttgacatcctatccgcccatgtctttgaacgtactttgaaatatgattgttgcagatgtaattagtaaagatgaggtcatacaaaagtagggtggactcctaatccaatttggccgtcacactggaaatttgggcttgcacccaccgagaacattgtggaaagattggaatgatgctgtcagaagccaaggaactaccagaagctagaagagaggcctgaacatacccttccccagagccttcagagggagcatggccctgccaacacctaggtcccagacttccagcctctggaactgtgggacgatacatttcttttgttgaagccactcagtttgtggtactttgttgctgtggccccaagaaagtaccacaagcctgaggttttcaccgtccttacagccagcaagacgggatgtttcagatgaccctgtcctatgtggaactgggggctgaggtggggtggcctgataacagagtcaccaaagagctgcctctcttatctgtactcctgagttctcacagccttctgggcatcttcagcaccagcaactcagcatgtcaaaactgaacatctttcctctccaaaccccttttccctcataagcccatctaaattatggttaccatgtccctctcagtccctctggaattcttcccttttctcatccccaattgaaaaaaaaatctggaattctatgttcttctggaaaataaggaagatctggcaacaccaggcctttgttactgcatggctataattggccagatggatgggctgcccctgaacatagagaatgtgtcctgggtcctgtttgacatcgcatgccagaccctgtgggcattggagcctggcccctggcagggtggaagtgattgcctctgcctcacagggacataagtggaaagcttcagatcattctctgagtcaagctgtccggtttatgtcctgctgtgtcgcttactggctgggggcagccatgggaagtttccttgatctccctgtgcttccgtttcccagtctgtaaatggagataataatggtgctcgcctcataggggtgttgagagaattaaatgatttaatgcgcatcaggagattggaacctgacacgtagcaggtgcacctgaaatgttcccttatattcttatgtagtcaagaaaatcttgtcaccctttatctaaactgctttattatttttcatgacgcacggcatatttacttcttggttttactttgctactctccatcccccaccagcttgacacacattcagaaaatgtggccatagtttatacacatagattcagggctggcctaccaaggagtttggacaaagctcccgggatctcacttggtggagctcctgggcctctcctggctgccgagtcccctgtgctttctgccttctgtgttgtttcggttccagtgaccaagggcacagcttggtgactggcctcccgaggccttccgagtcaccgggggatccctctaattaggtacactgttgagcatgcaggtgtatatcctgcaggcaagaagggctgctgaaatagtagcttaacatgaaatccaggcagcaagtcgggtgttcgttagaagtgtgtttttttttttttgtgatttgggacactgacaaagcccagacaaacctccccacaccaattgtttcccccagctgtattccccttattgggccactcctaagcagtgctgatgacttatttagctaatatttgttgactgaatttttattaatcaatagagatttgttaagtaaatggagcattattcagacatgtggcatcagatccattactagatgtaagtgataaataaagtggtaggtaagacacagtcctgcctgtaagagatgtgcaatctagtcattgagagagaccctatgagaaacagtgggtggagctgggggattaccggtgttgtttatgggatcccagagaggaaggaccctgactcagcctgaggttgggactgggggcaactgggggatcatcagacttgtcattattgatctaatgtcccagtaaaattgggcgttttcaggacagggactgtgactgtctttttattgctctatgtcttgtcctagcccagtggttgacatataacagacggtcaataaacatttgatgagtaagggaattaagtgacatctaagctgagaactgaaggatgaggagtctgccaggaggaaagtgtgggaggtaggggaggaagggggtggcgggaggaagtaaaatgatgacgaaggatggtacagggagggaggagcatgtgctccttgagggtgacaaggactgcagttctgggaactgttagcttgtatggtgggtggcatggagccatttcaaggtgggggcctgggcagagctgaatggtgagaataacatagagttcttagtttttacatgatgaggtttgatatgcatgatccaaggtgcaggaaatggattggagaggacagggtggaagaggagaggccattcgatggctattgcagcaatcttgagagatggtggtggcaggacaaattactgacacctgagatggagaggtgactagattcagaagcaactagggatgtagaattgtcagaacctggcaattaggtgtctgtggggaaggaaggagagatgtatgaatgatgctcaggcctccaggggatgtgggcaccacttacttgtgatagatgagaagaggagctgtgagaaggttaaattcacacttgggcatggtgagtttgagatgcctgtgggaagtccagagcgcagttgtatacagcaggcttcacctccagagagtgatcagatttgagatacaggtttgaacactcattggcatagagggtcagggcttcatagcctagaaggacatagataaaattaagaaggcctatgaacttcagaaattatattaaaatcataatgcatgtgcattgttctgaagagctagctttgtatcaacttttcaaaatgtctgtgtcctcaaaaaggttaacccttggtgcatatggttaatgaagccagaaggagagatgagatttttcaggcagcaagaagggaagagagccagggtttgtgctgcagaaaatatcaacatttcgggggtgggaggcactgtgctgagtcagaggcctgggggtcagagttctgggaatgagataaagacttacaggtagcaatagctttactgttcataaagcacttttacatacaatgccattttatctctcaggaactcaactagatctttataatttggctctgtatcagttagagttcagtacaagacatgaaaacttggctataaattttaaagaagggatttcctagagggaataggtgcttactatggacccagaaaatctgagataggtctcagttaatgtagaaagtgtattttgccaaggttgaggatgtgcacccatgacacagcctcaggagggcctgacgacgtgctcaagctggttggaatgcagcttggttttatacagtttagggagacatgagacatcaatcaatgtatgtaagaagtacattggttcggtgtggaaaggtgggacgactggaagcaaaggcaggaagactcaaagcggagagggagcttccaggtcatagataggtgagagacaaacagttgcattattttgagtttctgattagcctttccaaaagaggcaatcagatatgcatctatctgagtgagcagagggatgactttgactagaatgggaggcaggcttgccctaagcagttcccagcttgacttttccctttcacttagtgactttgggggcccaagatattttcctttcacattacaaaatctctggaagggcagccccagggaaagattcccagaacaatatagaactaaggtcagagtacatccctgtagctgccaccctggcatcgaaaagctgggactggaaagccaccatggctgcagctctttctcggccttcatggagctgaaggaaggatgctggacactactgtattaagaaatctgttttcgtgacctgccttgatagcagtgaacagtcaaatagaagccaaagcatggccctcatctcacttccaccttctagaactccttgcttgagtacatttaattagtggaatccacttcagtcctgaatctctagatgcagagaagtctggaagatatctttataccacctctcttcctaaaaggagtgtgaaatggagctagagaaggggtcttattttgtaagggtcaagttaagaactgtttcagtcttagtgagccatgtggtctctctgcagccttgccattgaagtgtggaagcagccagagaccatacagaaatgagtgagcatattgtgttccaataaaactttatttataaaatcaggcctggcacagtgtttcacgtctgtaatcccagcactttgggaggctgaggcaggagtgagcttgattgtgccacagttctccagcctgagcaacagagtgtgagaccctatctctaaaaaataataatgataaagttagttaattaaattaaaatgagtgatggggcctaaaggccacagtttattgacctctgaggtaagcaaatcaattctcaataattatcgtaggttcttttttacagatgagggaattaaaaccggagagcgtcagtcgaagtgaaaataagtcctggttatttagttttcaaagttcatgttctccaggaaatcctgatgctcagcctctcctcttacaaggcttgtgatctaaaagaggagataaaatatgtactttgttggtgcagaccatggtaaatgctcccgggatggtgcggaatgcttttgcatacaaggcatttttgacaggagaaatcagaagtatgatggtgaaagtagttttagctagatgttgaagaaaggtataactctaacaggtggagatggagaagggaggagtcaaaagagctgatagggtttggctctgtgttcctgctcaaatctcgtgtcaaatcataacctcaatgttggaggtggggcctggtgggaggtggttggatggtgggggtggatccttcatgaatggtttagcaccgtccccttggtgctatccccgcaatagagttctcatgagctctggttgtttaaaagtgtgtagcacttcccctctctctttctcgtgctctggacatgtgaattgcctagctcccccttcaccttccgccatgattgtaagcttcctgaggcctccccagcagctgagcagatgctagcatcatgcttcctgtacagcctgcagtgcatgagccaattaaacctctttttttttttttataaattacccagtatgaggtatttctttatagcagtatgagaactaatagagaatttttgatggagtcaaaaactgcaagagaagtttaggaaaacagctagaaatggaaactcatctgaacattgtgaccttctatggtgttagtggagataagactggatcagggagaaccttagatagtaggattaggaatccgaacttggaaaaggggaagcactgatagtcttcgagcagggttgtgatacacacattacctcaggaagaattatctggttttgttctacagaattttgtgtaagtcagaagatacagccagcaagaattcgctcaggcggttgttgtaatatctttacatgaggatgcaaaggaagaagtggacatgagtcttgggccattcatgggacagggcaacttgtaaatgtaggtggaatagaaggatggctttgatgggaagagatgaaatgaataacaatacttgggaaatttgaggaatgggagcttgttttgtgggtaaagtaatgggccccatcttggatatgaggtgctgaggggcagaaacggaaatatggagtaggcgattggaaatgttggcttcatcttcaagatggggttggttgggagtcatcccatacaggtggatagagagccaagtaagagctcagctctctgagggagtgtgtacagtggaggatgccggaaggagaacccaggagacaaaggtattccagaactgggagagggacaagagataggaaaatgtagtaggcagggtagtgagagtggcaggatggatgttgtaccagaggagtcaagttagggagctatttccagaaaaagaaagagccaggaatgttgcatgccacagaaaggtcaagaaatactcgaaaaaccactggatttggtgaccacatctcaaggtcatgggcgaccctgagagagctgtttagtgtgtgttcttctcttgaggagtttcatattgaaagaaaagaggagagaaaatgggagattgaaatttgtggcttgttttaaagtggattaattcttcagtgccagaagaccacaaagaacttggtctgagaatatatcctgatttctccccaagacttttcttaagaaaaagcaagttgaaagaggaacaccctttagtttcgttctctcttgatttcaggattcggtttttggtcagttgtttgtgtctgactccacttttggccctgtcgtggggccgctcctggcaacctgggaggtcacgcacaagtgtgtgcagttgttaagcaactgctcgcagtcgcggtggccctgctaaattgggaacatgtattcgtcccagtctgagtcttcattcagtgggaaacaatgagtccctgactttgaaatctcagaggttacacatttgtggaatatgaaatcagtgtgttgatgatttttcctacctcatagaattctttaaaaataacactggagaattgctatgcaattctgtgaaaatttagttctctctagggccttttctagaaaaaacgttatgcccaaatcccaaaaggaactgagtattttatatcaatgctttctaagataaataaaaacagaacacacacacacacacacacacacacacacacacacacacacacacacacaacgcagcaacaacagcaaaagtcaataaaacaactcaccaaactaactctagagtttcagatggaaatgatgttatcagtccaaattaaagacatattctcttattttcttttacaccttggtttgtggcttccataatacaatcatctgagtcttgtatggtttctgaaatggatgctagaagagataacttgaatgagtacttttcccctggtggaattctcttcctcatctatatttaaacagttgttttgcacctaaagggccctaagttacgtttctctggagatatttagagataagaagtgttgtaagtactctttcacatttgtgcagaactttagtctttgaagtgtttagacatccattaatctttttttttttttttttttttttttgagacagggtttccctctgctgcccagactggaattcagcagtgcaatctcagctcactgcaacctttatctcctgggctcaagtgatcctccctcctcagcctcccaagtagctggcactacaggcctgcaccaccatgcctggctaatttttgtattttttgtagagacagggttttgccatgtcacccaggctggtctcaaacaatctacccacccttgcctccaaaagtgctgggattacagacgtgagccactgtgcccagcatccttaatctcattctacctcactttctgcctattgagagataggcaccccaagtaggaagtccaaatgctgataaagaaattgggattcagagtgacttactaactagccccagatcacacagcttattagaggcagattcagggctaaaggtcagattttccagctgcagatttattctgctttgagtggcattttagacattagtgttttctttaatccttaagcatttcagtgtctaaggtttgtataacatcaggttggtttctggtagtacgttgattgtggagagggcccagaagcagaaaccacagtctttacatgatagttactcttatctgaggtttggcctttattgaatggaagtctcttgttaaagaagggtatgcattgaggcaagagtcttgccaacttttcaaaaaaaaaatgggaacccctgggctccttggggatggctaatgacaatgattatggaggaggctgcaaatgtgaagtactttataaatcctggaggtgtggcagtagactgtgtgtttctggggagacagatttttgcatacattatcctctggacacttctgcctttggtgcatgcttgtttttataaaaaagcttgttttgttcctcctgtagaaatgagcctatcatctagagtcatggtggttttctgtatgtgtgagcttatgcttcagttacactgaacactcgtactactgcaaaatcgaattcagtgacattgccaatatcttcgctctcagtagtctttaaatattcttagccctgggaactggcccaagaaactgcttattcttttccctgtatcacttagcatataaatcctgaattactgctgactgaagatacataaagtacaaatcaataagtattttgtttctatattttggagaatgagacaatgagtgaaagagaacccctcaatgagggctttaaaatattgtcattgttctatggattagtagagctgcggctactattttacttacccactggccaccaggtactcacactgcagtgaaaggattcctaaaaacatctttattaagatattcacatactatacaatccacccatgcaaaatttaccattcgacgttgttggtatattattactttgtaaaaatcatggccctatgcacaacatacaacttgccactttaatcattcttaatgtacggttcggtggcactaattatgctcacagttttgtgcaactgtcactgctacctatttccaaaactttttcatcatcccaaacagaaactgtgtacttattaatcaacacctccccgtgaaagaatttttaaacataccttgattattagctttggatgtatataaaacctttaaggaagattttgtttagtctgttttttttcagggaaagtttattttttaaggggcagttccatacagtaggtgacacaggttaggttcctccagaaagcagcctcttatagtagcatgtgggacattgccagagtctcaggagcaacacttctaggggatgggggaagggatggagggaggactgggtaaaaggagaacgtgtactgtgttgtcattggaaggcctcaccctacccagtggaactctggaactggcatttcccaagttggggcaacagggatggatctttgtaccatatcattcagtcatagggttcagctcccaggacggcgcatgagcttggacaaattctctccagccaagggtcagagaaggttgacagctgagagctaagagccagcagctgaggggtgaaatgctcagtccatactttgccaaactttgctctccactggaatcacctttgcatcctcaaaaatactacgcctgatttaattggtatggggtaagagacaagtggaatgcttccaaagctccccaggaggtttgaatgggcaacacagattgggaatggctgctttcagtcttgaaggggagtcagcatagtatacatcatcatgggaaatgcctggactttggattgaaaaaaagttgaacttggctcaaccatttactgacgttgtagttcttatttatgttctgttaagattttgctactaggctttaaaaaatatgaatggatggtgcacctgggtggctgagagggcacttacaaattaaaacaaaaacagtgaacacctccagaatttgatagaacacaagaatgcataattcataaagaagaaattcaaatgctttttaacatttgaaaatatagtcttaatagcaactgaaagaatgaaagttaaaactatattttgcttattatattagcaaagatgaaaaataattgctattgctcagtaatggtgaaggtagtggcagaagacactctcaagctcagcacagtggttcatgcctgtaatcccaacattttgggaggccaaggtgggtggatttcttgagctcaggagttcaagaccagcctgggcaacatggtaaaaccctgtctctacaaaaattagccaggcatggtggcatacacctgtggtcccagctactcaggtggctgaggtgagagaatcacttgacccccaggaggtggagcttgcagtgagctgagatcatgccactgcactccagcctgggtgacagagcaagaccctgtctcaaagtaaataaataaataaataaaacaaacataaaagaaggcattctgatcctcttggtatgtccattggtgtaacacgaatggtggaccatttggcctccattcatgtgtctaccaatgcaatgtagataaaaattcataaaaagcgaatgccttttgacataacaaatctaattctagaagtttatcctgaggaaataacagaagagtatgtaaaaatgtgtgcataagttgtaattgcctgggtcttgctggcaattaggagaagcacaaatggtcattaataaaatattggttaaataagttctggtacatacctatgtacttctaatgagagaagccattaataaaatagtgtgagcctatttttgcattaaaacatttgcattgaaaaatgactttgagaaaaatatcagatgttaatggtaaacagtgtttttccccctgagtataagaattatgggtgaattttattgtctaactcatatctctttataatatttatacttagaaagtattacatgttatttaattatgtgttaattttatattcataaagagcatagagctatttccaaaaattacatatttccaagattacacacctgcatatctctatctatctatctatctatctatctatatctccctattcattcagcaacctaaaatgaaacagcctataatccaattagtagttatccctagaatttgaggtcacgggtgatttttattttctttcttgtgcttatttatactttacagatttttataatgagatcatatctctcttataatgagaaatgttttaaaaaagcttttaatatctcagtgcacttgcctgacctattttatatccattcttgcatctatttcatttgaagggtcctttggatagcatttctttctccatgtctttcttcctgctgtcctatttaaataatcacaattctgtgttgaaatttttgtatgctttacctaattaggacaaatattctgactcttgcatttgttatcaagatgtacatttttactttattcattattgttttttttttcttaagcaaagtttggcctttagatgatgcatttccaagcctagcatccatcatctaccattatgcttttgactcatctattaaatagtaatgtgtcctccaaaaatattgatgttaaattaaatgactctatatttgtccttggaaaaagctttgaggctataaaatttaccaagcaggtaggacatgcaaaaagagaaatgcatgcaaatgcttcctataggcaggagctcttcaatgtgtctgacaaatctcatctatcctttaggtcctaaattaaacatcacttctctgtgatgcccaccttgactttcccagggtaagctggtgctgacttctccttatgtttattatgcctcttattaaatcttattttaagtagttattgatgtctaccaatgcattagaccaccagataggaaatatggttgccatccaccaacactcttccaacagtccctacctcctcatattcaagcccctgacaaatagatgatgacagacgcgaccatatgtcacttccaagattaggttttgaaagacagaggtttccgtgttgggctgtttctcttggcccactaacctatggaaagctagctgttgtgacgataggcaatgtatgcagagaggctcatgtggcaagagctaataaaaaatggaagctggccacacacatgtgagtgagctttgaagcagatcctcccccttgtcaagccttcaggtattacaggcctggccatcagcttgattgcaaactcataagaaactctgagtcaaaaccgtccgtctaaatggctcccaattcctgaccttcagaaaatacgtgaaacaataaattcttgttgttttcagttttgagttttaggatagtttattatgcatcagtagataactaatccacattggtactagaggtgcagtgcttatgtaacaagaaactaaaatgtgataggactttgaacgaggcagcgggctgtggaaaagctgtaaggattaaggaccatgttagtaaaagtgtaaagtgccttgaacacactgtccatagaagtttggactttgaggaggctgccattgaaggcttcaaggaaaatgggagaaatcctattggaaactggaaaacagagaatctttgttacgtagtggcaaaaaaaagaaagaaaaattaacaacactgtcacctgcagtaatgtagaaagtagaaaatgtgcctgataaactggtgatatagttaaggagatttctaaccagagtgctgaaagtgctttctgattttttttttttcctgttgcttagagtaaaactgcaagaagagaggagaaactgaaggtaaaactattaaataaaaaagagccaggacttgctggttttaaagattcccagcctccccacatggtacgtgatgctaaaattaagaaatggcatctgagcaaagaccaaattcagggcacttttaggaaaacaaggtccaaacattaagccaaggatgcgactataaagtcttttcttaacatctcagtaaacaaagatagtgtctcagaatactgtttagtcagaaaaacctaaagatactaagacaagcttgtccaacccttggcccgccggctgcgtgcaacccaggatggctttgaacgtggcccaacacaaatttgtaaactttctcaaaacattatgcgtggacctttatttttatttttattttttagctcatcagctattgttagtatattttatgtgcggaccaagacagttcttcttcctatgtatctcagggaagccaaaagattagacacccttggacgaagggcttgccttacagatcctctctatcaaccagtagtgctccctggaagctcacagacattgtacctcagtccaagctcaagaaggacctgtttcaaagagatttgtgggtgtggcttttgtgtagtggaattaagcctaaagggattcccagaagacccatggagttgaaagggggttgtgcttgaagaaacaccatcagctggaaagaaaagagacataaagagtacaaaatgcagagaggcctttggaccaccaagtgtcaacaagtaaaaagcagactgagaaaactaactccccaagcacatgttacctttcatgaaaatgaaaggatgcctgagagggcacactcaagatttcaaagggtgagactaaagccatagagaaatattcctaggccttaattagagaccaaatcaaggagcttccatcatttgcttgcctggatttcagaactactatccttgcatacttcccattttcccctttgtgagttggagtgtctatggcagttatcctctccttatcctgcccttgcatgttgggtgcatggggccagataacttgtttctttatttgcacatgcctctatatcaagaagaaccacattcaattgttgtatgtcagagactacacccaagaaggctgatttagatgatgagggtctggacttggaactgatgctctgttgggatgagacttttggggacagtaggaggggtgggagtccttgggagccaaagggtgtcctgtgttaggcagcctccaagatggctccctttgatctctgactcctggactcacagagttgttaatcccctccccatcccacattgtactagggttggcctgtgtgaccaattgcaaatggcataagtgatggtatgtcgctctcaatattagtttattaaagactgaagcttccattttggtcctgctctaatcccgtgctttcctggatccctcacggtggggaaagccagctgccataagttgaggacattcaggcagtctggtggaggcccacatggtgaagcagttccagccaatagccatgtgaccctctagttccaatcaaggcttcagatgatgcagaccagattgacagtttgactgtaacctcatgagatactatgtagaaaaaaactgctgtaggccttagacttctgtacttacaaagacttcttgcaaaattggcttggctggcatccaggaatttggatttaggggaggcctgacaccatttcctaatggataagagtggttcactgtgcctaaactgtaaacaatattatttatgctgagcacttgctttccatatgggagtcttggatttttatatgtgctaggcagagggtgtgtaatgagcaaccctcagtaaaaaccttgggccaggagtgctggcttacgcctataatcccagtgactcaggaggctgaggcaggagggtagcttgaggctgggagttcaagaacaacctgggcaacagagcaagatgccatttctgaaaacagaaaattagccacgcatggtagtgtgcacctgtagtcctagatactcgggaagctgaagtgggaagattgagcccaggaagtcaaggctgcagtgagccattaactgtgccactgaactcccgcctaggtgacagagtgagaccccccaccccaaactctaaaaaaaaacagacaaaaacattgagcactaagtctgtgataagcttccctggtagacagcattttccacttgtcacaatacgatgctggaggaattaagcccatgctgtgtgattccacagcgagagaactcttggaaacttgcatttggttccttgtctggcaaagagaaaaggtgctgattttgctttatattcttttgctataataaatcctagctatgaataatattatatgagtcctgtgaatcctcttagccatcactgaatctgggggtggtcttgaggacctccaacccagagctcctgagctaggagcacctagatcttcctagaccctcagaaaccataggataataaatatttgttatgttgaggcactgagttttggagtagtttgcttcacagcaataggtaactaattctggaagccagtcatttctctcttcccagcatttagtttagtgtcttggaacataggtgttaaagaaatatttgttgagtgacttgacactatttctgcctttgaagaagttcatagtccatttggttcctttgctggaggaatctaaatcctggcttggtattatgaagcaggcttactctcttttttctgtggcctagaagaatcaatcgcagtggcagcagcctgccttaacgttgtcaggttctgccatcttccctgttgaatgagatccatgggtataagaattagtgtatgaccatgcctcttctcttttactcacttcttaggtcctttgatttttattttctctcccttctatgtcatggcagtggtagctattcttactattgaaataaaaacttcttcctgctgaaaaattaattaccaaatgtttcagggccttataagatattaatatttccatatcgagtcttgcctcttactctatcatatgattgccttgaggaaagttcagacaaattaactttccattttacattgcaccccactttcccagcttctgcaaactgtcttgaaatagactttatagaaagataggaaccatttccactaaaatgagtttaatgtagggaaaaaactcaaagtatacactgaaagtagacttctttgagtcatttacagttaaaaattattttaatctaaaggtgtatttgagtgtgtgcacaggtatacacatagaccgccccccaccccatactcattcctgtggcacacttcttgctagttgttggcactgttaaataaaaattacagggggccatcgttttggactaagcttctgcacttggccccaacaaaccagattgaaaatcaaaatggagtcactcatgctaaagttccatgtcaccttccaataaatcaggggaggaagataacaatctaattttccaaacagggcagtttcaatcttcaatcagcctgatgaagttctctctgctttaatccttacaacaaaaagtaacctgaaggaacgtgatgttaactagatatttttttctctattgttctgttttcctgttcctggattacaaagaaagtaactatgcaatgaccaattgcttttgttctgtgtttctgctttctctagcccttttctgcttacaaagccaaccatctctgcccactcattgcagcacttattaatggcaaaaccgcaatacttttgcaccaaaatatttaatggaatgaagtgttgttctattctaaaattgcaaataaagctacttgagctcctgaaagtaaatttgttgtaattttgtcctttgacagatccttttcctcctctttgagtctccttccggttcagcagatgaccttggttatgagtttcatgagaatcccagggtgatctaatagaagctctctcatttatcttctttccatctaattttttacaatttttattgttttttcttgtgtcagagaatcatctacctttgtttcaaagggttctagtcctgctttcaatcccatatacttgggcctgatggatctttcgaaagtgaaattgtggcctcatgatggcatcatttgaaagcctccgatgactgtttcccgaggagggtgaactttctctccttacctgctcttgctttcctgcctccattttgctcatggcattcccttgaattaggttctatgagtggaatacagctttgaaggcaattccagagatccaacaaaaacccaggagattggaaggaattcatatttgtcaaaaaatgtgtagctcaaaaatataaaaaaaaaaaataatgcaaataaaacccaatagagtataacaactatttacatagcatttatattgtattaggtattataactgatctacagatgatttaaagtatagaggagggtggcataggttatatgaaaatactacaccactttatattaatataagagacttgagcatctgcagattttggtatcctctgggggggtactggaggcaatcttcctgggatactgaggggtgactgtaacttattttcagtactttggtaatagtgtatttaacggtctattgtttctcagggtttgtggatgatagtccattaggatctgaaaataagatattagaagttctatttacttttttttgtttttctgaaattttaagtgtatatgaagttaagggaatacatgtaattttgaaataattaaatattcatgtttggaaatctgttcaaatttttgggtggctgggaacacaaccaaaaagatatgaaaaccaataacaattatgtatcagtaggcattttataaatagtctttgatattattttggatataagtgatttgattggcacttctcatttaattgcttattaggtgggtttctgttttgtagagaacatttaaaaaaaatttagacaagcaaaagttaataaaatcacctgtggtatgaccactcagaggtaagtataatgaatgttttattgtatcttctttgcagctagttttctatacacatagacatgattttcttctaaaaaaggaaagatcatgatgtatttataatttgtaaaacttttataccttgctctttgaactttaaagaatgtcatgaacatttccttagatactaaactctttccccatatattttaatggccttattatatgaacatataaaaataatttattttgataccttaattcatgtgctgttggatttttaggctcttgcaccattttccccacttctctgcttgctgttataaacagttctgaaaaccagatgctgttagccacaccatacatatctgtgatgtttcctgacaagattcctaaaagtagcaccttcctttcataggtgaggttttacctctacctttgttgtctgtctctaaggcaaaggcaattttgtgtaatggtgaagaactcaggacagaatttgaattgtgcctcaaccagttactactgtgtgactctgggctagttgtgaacctctctattcctcatttcccctcatctgtaaactgggggaaacactaataccaacattgctgggtggttgtgagcaaacaataaacaaataatagtgtaagcaaacaataaattttagcaattgtttataaggtatttctcttgtcaagtaagccaagttaatcatctaatggctcctataaaataaagcatagggccaggtgcagtggctcatgcttgtaatcccagcactttgggaggctgacgtgggcggatcacctgaggtcaggagtttgagaccagcctgaccaacatggtgaaaccccatctctactaaaaatacaaaaattagctgggtgtggtggtacgtgcctgtaatgccaactactcgggaggttgaggcaggagaatctcttgaacctgggaggtgggggttgcagtgagccaagatcacgccactgcactccagcctaggtgacagaacaagactccgtctccaaaaaaaaaaaaaaaaaaaaaaacaacaacaaccataaaataaagcatagttatagtattcagtaaggtgaatgacacattaatgactccattttccatttgatcagttcttacatccaggaaccatgaacacagctatctcaacatatggtagtttatagggatagtctgtaatcttgcaaatttaaaaggtaaataggagtccttcagtaggcagattcatatattgacaaatgaaggaagaattagtcttgttagaagaaacttgccatttcgtttgtgaacaatgtagttaatttatcacaggctcagtgagggcaaggatggagctatttcactttactatttgtgtacagatccagctcttgggccgtggtaggcactcagtgaatatttgtgaaatacataaatattcatgagcaaatatatctatactttgttgaatgtattgcaatgtatgttgtaaacataatgaaggctttgtgtgatgaaccgacaattgacaatgaaattattgtctgcaaagtgggctggggccttcaggcttttctcctgattatagattcagaaataatgcaagaggctgttgctcaaagtgaatcccttactccgtgctggtcgtgttctttaattcatgtgctgttcccttgtgtgtgctcagtccttattgcagctgctgggtctgagctcactgtgaaaatcgtgtttcctttctgccgacccatagggctcagtgtttgattaataagtttcccattttctgagaaaaatacctaggtaaatcccccttggacagcacaaggatctgcagtaatttacaaccaccgtgtgagccttgtgttgaatgacatgctctttgtaaggatatggcataatttataatgctggccccaacgtccactcctagggcgttctcagtgcagtgccttgactctgatattggataatgttgacagttaagagaggaatgactttagttgctgctgctgaattaaaaaagtcagacacacagtctaaatggattttgctgtcttcaaagtagtgaccttgggatagatagaactctttgatgcttccattgatgttgctattgccccaaacatttccggaatcctttaaaaattacctttaaagcatgtggcacattcttgtgaatatttttgagtctaacaaatactcattctttgtatgaggctttgatttttggaaagagtgaagagtcactggcatcaagtgcaacaactgaggtgggtgatgagggcagagagtgctggttttgtttagggcaacatatggttttagaggccttttaataatgtcatgagacttgagcatttgttctaaacatgatttccttttaaaataatgtttgaaatgatgaaatagtccaagcctacagaacacaacattacatgccagataggcacgttcccagcatggatgttaaacagatgttaacgtgctgtgtttgtttgcgtgtgttctttcatcttgctctccttccctgttttttctttgaaagacagtgttttagatattcctaaacaccccccgcttccctccatacccgtctgccttctcccctttttccatcaatattcatacttctgccaatgttgccatgcttcattcccaggtgtgcttgtaccttttgaggaaatgtttagaaatttaaaggaattatcttgtgtgtgtccttctaacattgtctttgaggtttatccatgttgatttgttttaactgctgttttagtccatttgtgttgctataaaggaatacccgagactgggtaattaataaagaaaagaagttcatttggttcctggttcttcaggctgtacaggaagcatggtgccagcatctgcttctgctgagggctcccagctgcttccactcatggaggaaggtgaggggaaaccagtgtgagcagatcacatttcaggaggggaggagagaaagagagagaaagggaggtgccaggctcctttcaacaaccagctcttgagggaactagtggagtgaattaactcattactgcaagggcagcaccaagccattcatgaggaatccgccattatggcccaaacacctcccatcagttccaacctccaacattggggatcaaatttcaacatgagatttggagaggacaagcaaaccaaactatagcaactgctccataggattccagtatatacgaataaatcaagagtcttcatctgttcacctgagagaaagttcagatgctttcaccttttttgttattacaaatagtgatacagtagtaactgtgtgcatatctatctagaaatatgtactagaggttgtctagagccagtactcagaggaaaaatggctaggttctagaacgtgcacattttaacttagtggacattaccaaattgctctccaaagcagttgtaattatgcttccattggtggtttcccatatcctcttagttatcagatttttaatttttgctaatccgattggcacagaattgtatctcattgttttatattgcatttctctgcgttctagtgtgattgagtgtctcttctgtactcagtggccgtctgagtttcgtcttttgtgaattgcccatttatattccttgctagtccttctattgccattggcctttttattaatgatttataagaatcatttataatctagtattctttgtcagtttaatgggccccaaatatctttactactctgtggcttatgttttgactttttatgatgtctctaattaaacagccgtgctaaattttaatgtaatcatatttatccatttctcctttgtggcttgtacttttttatgtgtttttaaaaagaaatactgctctatcccaatgtcataagaataatttcctatacattcttttaaagttttcaaatgtagtgtttcacagacacttagaattgatttttgtgtatatgtaacattggaatccacttttatctttttccatatggatgtccagttgtctcagttacatgtatcaaatcttttcccactgtcatacaccacattcccaaacacgtgtgactgtgtgtggcttctgttctttattttatttttatgtttatttttattttttgaaacggagtctcgcactgttccccaggctggagtgcagtggcttgatctcagctcactgcaagtgctgcctcgcgggttcacgccattctcctgcctcagcctccagagtagctgggactacaggtgcctgccaccacgcccggctaattttttgtatttttagtagagatggggtttcaccgtgttagccaggattgtctcaatctcctgacctcgtgatccgccctcctcggcctcccaaaatgctggaattacaggcgtgagccaccgcgcccgactgttctttgttaatggtgtgtttgcttactctggctctaccctattttaattaccttggtcttataggtttgggtagtttaagtttcacttcagttttcttttttggaattttttttggctattctaagctcattatactttaaactgtattttaggaatgtggaagccctattgggcttttgttggaattactcagatggtttacagataaatcgtaagaatttgctctcttatcctgggtcttctcatctacaactatggtatagctatgtttatttagttctctttttaggtctttcagtagaattttgtaatttttgccatacttttcttacatatctttgttaaatgtctttgtaagtatctcatttctttctttcatttgttcctttttttgagataagatctcccaggctggagtgcagtggtacaatcatagctaactgcagcctcaaccctcctgggctcaagtgacccttgtgccacagcttctttctaagtagctgtgactacaggtgctcaccaccacatccagctgatttaaatttttttatcccacattttttgttgctgtcaatgatatctttttattgtatcttttcctattattgctggtgtataggaatgttatttttgtatatcttgctgaactcattaattttcatggtttagatactcatacattatgcagacagataaaatcttttaataataatgacaggtcttttccttttcatgttatgtggcattcacttctttttcttgtcttgatgtactgacttggactttcatgatatcacctgtttttgttaataaagttttattgaaacacagccacatccatgttgtctgtggtaccattgtattataacatcagagttgaatagttgcaacagagactacctagtttgcaaagcctaaatacctgccttcaggctctttacagaaagtttgcctatcttcacaaaacagggttgaacagaggcagtgatagtaacctttcttgtctcatccctggctttaaaaggagagcttgtgccaccaagaataagtgctgcttctgggttggttgatgtgtgccttttattgggttaagaaaatgtcttttttttttcttcaacttttattttaagttccagggtacatgtgcaggatgtgcaggtttgttatataggtaaatgtgtgccatggtggtttgctgcacacatcatcctatcgcctaggtattatgcccagcatccattagctattcttcctgatgctaccccacacctcacaggccccagtatgtgttgcttcctcccatgtgtccatgtattctcattgttcagctcccacttataagtgagaaaatacagtgtttggttttcttttcttgtgttagtctgctgaggatgacggcttccagctccatccatgtccctgcaaaggacatgatctcattcctttttatggctgcatagtattccatggtgtatatgtaccacacaagaaaatgtctttcttagatttgtaggaagtcttttcttgtttgttttgttattaaaaaaaatcatgattgaatgttgaattttatcaaatgtagttttggcatctgattattttttctctcattttaaacatacgcaattatattcttttgaatttttctattatttctagtccttggggctagaatccgcccctttgatgtgcttttataacttgtgatctcagtgggtctcattttttctgtaggaattgtctgcagcatggattgtgggaattttgctctggcattttccctgcccattcattagtccaggaccaatttttatgtgaatttctcagattgggcatttccggaccatataggaagcctaaatttgtaccgccaaaatgttccagaggcggtggtctggagtttaaactttgcaagggaaggcttttattctcctcccttggagacagacagaaacatacgagtctctttgtggttgcagctctttgaggagcctcactcagggcagcagccttctacctcgggcagagcccacagactttgcctgtttctcctctgtgctagttgaaatctaaatgcctactccccctggaccaatacttgtttctctccttctccctcaccatgatcctgtcactctctaaggggagtgaatttatgcttgcttctggttttagttgttgctttgtttctggcacctggtaatttcttctttcttattgcaggttcagctatgaatttaaaaatatatataatatttccaggtgcttgtaggaggtgagtgtgaatgtgtgtcttctcaccctcttgctgaaatgagaggctgccctctaaatgaaatttcaatattgaaaagataaaacccaaataaaacaaaaagcaaccccccaaatcagctccctaaccatgagccaggcagcacgtgaagtcctttgatattagctcatgccattcttatagaaactctgtaactctttttaagtggagaagttaagaaactggcccaatcccatgtcagggcagagccaggccaaaaacccctctgttttattggctgttacctcattttacatgtctgaacagtaataacagtgggtgtcaagtgtacctttcctaaaggtaactactacaaaggtcaacactattttccatctaacactcctaatatatttttacacattagtctcacctggtaattctaagatagaataatgatcatgcttgtctgtgagaattagcaatttttttcatggatttaagttcaagaaaaatcagaaattagcagttcaggagttttcaacatttgtaaaaaggcagatgggtgcaccattagcacttccttctgagtgaggtagatctccagggaattaataggaacccgttgttttccatgttggcaagatattagagaaatatgtcttactctcaggtttactaagacatgttttaaagataatactgtcatgcatgtggcttatggaaggctatagggatgtggatttttatattctctctagatttatttgcccatactctgaaatcaaggcagacggtaaaggtggagtcagtggtcattctgtttttttgattaggggtttatagatggctgacattttaatctcagttaatgactggggatggactccagggtccttcaccacagctcacccttgtttgtgatctaatttagcagcatcttgatttgaattgaaagacagccttgggaatattagctcggcccttgtgagagcattctggaatgctgcatattacctgatgctacctgagatgtaggtggttgggcagtgacagcctctctgagccctgacctgtcggggagaggttgagaagtggcaaaactttgattctaccagctgcaaagaccgatgtcaccatgaagttatattaatgactttgacaagaattttctcagtgtacagtaggcatatttgctgaatgagctgatcttgtaatcccagtatatctggagtagtcaattatgaattttctaattagcttgatgtttggtctcccagctaagtgagctcttgtgaactctgccagaatctggatttccaaattatctgacaggaggaaaggaaaggattgggccaaagtggccattgcaagtcagtttcttataagtcaaaaatttaatcagaccaagtgcctttcttttctgtgttcagaaaatacccattctttgtttctcacaactgttaacctgtcctaggatgaactggttctgcctccctttgctgtttcctgcattagtacttggaaaagcctgtggctgcatggtctgaggtgtgaccttcatggtgggcacaccttgtctctcttctctgcccgaaaggaggccactgttttcttgtctctgtaactgctctgtgaattcttcttcttcctgatgactaagtgtgactattctccaaggtctttatctttttgcaagttttctgagatcttcaccaataagcacgaatacttactgaatatgttttgtgtgccaggcactttttaaagcactttaataacaataactaatgtttattaagcatctactgtgtgccaggcactgcttttggtacaaaagatgtgaaataaaccacacaaagaccatccctcttggaacctatgttttattgagatccagccaggtggtagaacacatcagtaaacaaacatagacttcagcaggtggtgacatgtgctctgaaggagaaatggagtccgagtagagagtgactatgcatgatgaactggtcaaggaaagtctgtctgataagggggtatttgagaagagcacttctccaaggaagtggaggagcaagcccagtttgcttccaatttcttcctccttgtgtcttgccaactgggaccaagcatgcctggcgtggaacaaactctttctgttctctgctgatggagccattttctcccagagcccaggctctaggtctgaaccctgatccttctcttcacttttcttttctaatggccagacgtctttgtccttcctttgaaatagaagtgacagcaaaatcttctttcccacagccgttgtggataggaagcctctgcctggctgagcactttgctactttatttctgaattcctgtgccagcctcctcaatgatcttagctgctagtcttgctcttctcacccatctgtggccaccaaagcactggaacacgtaagccatcatttgagtgcttactccataccacacactggatcctcacaacttgctgatgctattacaatatgttttttttcttttttcctttttctaactttttttttttttttttttttgagatggcgtttcgctcttgtcacctgggctggagtgcaatggcacgatctcagctcactgcaagctctgcctcctaggttcaagcaattctcctgcctcagcctcccgagtagctggaattacaggcgcctgccaccacacctggcttatttttttttgtatttttatagagacggggtttcaccatgttggccaggctggtctcgaactcctgacctcaggtgagccaccctcctcggcctcccatagtgctgggattacaggtgtgggccactgcgcctggccttttttttttaaagttttatttaggttcaggggtacatgtgaaggtttgctatgtaggtaagctcatgtcatggggagttgttgtacagattatttcatcagccaggtgtattaagcctagtacccaataattattttttctgctcctctccttctgccacccccaccctcaagtagaccccagtgtctgctgtttctttttgttcataagttcttatcatttagctcccacttataagagagaacatgcggtatttggttttctgttcctgtgttagtttgctaaggaaaatagcctccagctccatccatgttcccacaagagacatgatcttgttattttttatggctgcatagtatttcatgatatatacgtaccacattttctttacccggtctgtcattaatgggcatttagattgactccaccatgtctttgctattgtgaagagtgctgcagtgaacattcatgtgcatgtgtgtttgtggtagaatgatttctattcctctggctgtatacccagcagtgggattgctgggtcgaatgatagttctgcttttagctctctgaggaattgccatactgctttccacaatggttgaactaatttgtttttcttttacaaagttttttttcaagactagtcaagtacactagtgagaagggagaaaaaagtagagcaaggagtttgatctgtaactgactgaacaatcaatggagatacctcttacctttggaccagttgctattacaattatgattcccattttgcagagaaggaaacagactttcctatggtcacttgctaatacaggaggtggctaagccaggatttgaactcaggtccaatggaatccacaggctccttccagccaccagaccaagcttcacataccctgctgtggagcaccatggagaccctggttcgctctttcactctttggctggctcaggattctttcatgcttcctattatcagtgggataaaagtccaaatgttctggaataatatttgagatctttcatgcctggaccgtacttcacctgtcttctggttttgtatctgagctccctcctgtaacaacctttgctgaacatactcaaatgtatcatggaggtaaacacagcgatgcctacgtttatacagtgagtgctttttctttccctttacctgaactcactctttcttcatgccccagctcagactccacctcctctcttaccttcgtctgtgttcatctatacttccaaactctcctgtcagttagaaggcgtgtcctgcctgtttcatgtcattcctaacatcagaggacatagctcttaaagatcttattaccaacttgccatttccatgaatttccttagcccttgatcctaaactattgagaaagcttacatatccaaaatgagtctaacttttctaagcaatggtcttgggagatgtacatatttcactagggcttcctggagctggaaatatatttggtggagctcctttttctaaattgccttccggctacccaagaaagtcaatttccttctttaatagctgtgactcatttttggactgatgatggcactattccagttcagtcacctatctgagtcatcagtagggactccatttaaaatttgactctttccctaaattgaatcaattctcaagggattaaaactagatattcactagaacattccccaggaaaatttagaaatcagagttctgaaaatgtttgctcaaaatgtcaaggggtgaaactgagagaaggcaactggaacgtttctcttaatccactgtccctcacttacctgcttggcagaaagaaggcgggggaaggaaagcattagaataaaaagagaaatgttcagaggcagtttgagtcatgaggaaacagctaaaacttccaaaacagaaactgaatgacatcctcttcctaattcaagccttcctcaggggaaaattgaacagaacatttcacttgataaatggaatgagacctggtcctggagtatttggaaagatgaatgacaggcaggaggaatacagtggaagggaatgccatttatttacaaatgcatctcctcaggtaagggaggggatttcacagagagagggaggtggaaccgcagagggcttggtccaagttagaacatgaacttactccttgctctcgtttctgggggagaaagccatgtatacctccagcactcagaagtgctcgcgacaatgagctcattgggatttgctactcaattagattctgctttgtacatgtagcacttagcactgtgtctagcacataacgaggactcggtaaatatttgttgaatgaatgaaaaataattgctgcctgggagaagttgagaggctttgtaattctgccctgtcatttctggtagtgaccaccaggtggtgccttcttaagaacaggaggaaataaaatcactccagtgaacacagaaggcttggggttgactcagaaccttgcccctgtgcacaccgtctaacagtacatcacaatttcttgttcctaacgttgaatgtgcacacaggattcagatacgtggctggcactgactttctttacttgagtcaaggtcaagtaaggttttcatcgttggctgagctctgggatttaaaaccagttctatcccaggccaagtgggtttctgttgttcctgcttatcccctgtcctccaggagaacacatgctgcccttgcttccatattttctcagaaattcgtccccagcatcactaatggattcatatccagctcttgcactcacgggttgaaaaacttggtacccctgtgtattttaagcagctacctgatgagtacctatgttgaaataggtttctgtggtcgaaattctcagaaaagtcccacaagatgggcataaatgaacaaactagctcagcaggcttaggtggctctcccaaagtaacacagataagtgagttggcagagaggattccagcccaggacagtctgcccttaggttgtgctgtgatctctattctgttttatgtggagtgagtttaatgtatctgcattaacgagatccagggacaaaaatataacaaaattcaaggaatgtgaagcaatgtcctatagaaggaggacagttcactatcagtgtgagccaacacactcagctcttggcagttttcagacagttgcaaagaaatacttagcctgaggcttcttcgtgcccataaacctaattaagggtactagagattctgattggcaagagctagggacagagaggctgagtgagactatacgtgtccctatgtttctgtatataaagacagaaagagggagtttgagagagcgaatgagttaaatcctaagtagacctggaaaactatcattttgctaggactggacttaagcaaaacagcagagcaaagttcagagttaagccagaactttgccttgaacctcaggcccattgagccctctgctccaacagggccaaatcagcatccaatagtccccttcaagttgtatctgtcccgtgtctcggtgtttctggtttctgttatttggtaggtcacaattaattatacagggttaacaaaaatagattaacataatgtacttgccgaatagtgtttctttgggagaaaatgacttaactcacctaaaatatctccaggcataaaagatattaatgttgggaatatcaggagtgattaacctctgagagaggttgaagggaagcaaaattggacaggaaggataggaggaatggagataggggatttcgggtggggagagcctcttagagtcttttatttcagaccttactctgtgcctttccatagggccaagtctgatcatcctctttttatggtctgaatatctttgagcccttcagaaactttcaaattagtaatatacatgattaatatttttgacacttacatgttaggaactagacattatttcagtaatcctcagaggagccttgagtggtagatgctatcattcttccccctttcttttaaataatgaaatagaggtttaggaagacccaaagctagttgatgtcagagccaagatccaaagcccatgtgtggttataaagccgtgttcttaccactatattatgctgtaagaataaagggacaaacctcaaaataaaagctttcactatcagtaacacagcaaaaaacaattattcattcaataatgagcaggatgaataaaaacagacaaacctcatcacatgaagttgaacttcagagaatagtcgaataaaaagttccctcaaacttaggagaaacctaaggctatgaaactgattgtttcatagccttggtaataagtagccatcaggggccgggcatggtggctcacacctgtaatcccagcactttgggaggccaaggcaggtgaatcacctgaggtcaggagttcgagactagcctggctaacatggtgaaaccctgtctctgttaaaaatatgaaaattagccgggcatggtggcacatgtctgtaatcccagctactgaggaggctgaggcagaagaatcgcttgaacccaggaggcagaggttgcagtgagctgagattgtgccactgcactctagcctgggtgacagacagagactccatctcaaaaagaaaaaaaaaagtagccatcagaacccatttaaaatctgttcatttggtcaacaacaacttgtcttagtgaaagttggttttaaaactggcagaactgaccagtgtcaaatccttacttcagcccatcagggatgcagtttccagtaaacatctctctgagtgccagccaatcaaagaatcaattacagcctcagctgagcacccacgtgctgtcaacccacgtgtgcctctgaacatctcacaaccacagagctccatgctttcaaagccctctaagccatcagccatctgtcctgctcacagacactgtttggccagcatagctctcttctgtgatgagcaatgtattcagccttggagttctgtgtcagatactaagtggtgatctcattgttatttgaaaaaacaagcacacatcagtatgtatgtagtgtatggctacagagacaatagcacaggtaagaggttgggtagggcaggtgctagggggggctactttggatgggaagctcaggagagcctctttgtgggtgcaaggtttatgaagagacctatatgatttgagaagagtccagacattcacagatctaggcctggggcttccaaaaagaaggaaaggtcttaaggtaggagaggatgcctgcgtgtctggggaaggagtagaagaggaggctggagaggaaatgggtggaggctgatccttcagggccttgtgggtcatggcatggtcaggatttgggattttgcttcaagtccaacggggaggcaggaaaccacccagggaaggactatgtcctctgctttaagagagagagagagagagtgtgtgtgtgtgcatgtgtgtataatatacacttgcacatatgtgcatattgaaagaaaggggatggaggcttagggtcaggagtgcctcttagagtctcttactttataccttactgtatatctataaatgcacatacatgcatatatacacacaagttttgcagttaggttcaaagatcctgtagatctagaagaatgtctatgacattgacaatgtgagtcagtacaccctccactgtgtgctaccaaatctgcccaccctcttccactgggagtcccataaatgaagtggttttactaccctgttgtagcccagtgacagatgatcagtgatgtcaaaagcgtgattctggagaggttggtcactttgttgcaaagctgctgtatcatttcaggtacatagtctgggaggtacagagtctagggtcagagtagagtctcaagccattgtgcatgcctgcccaagacagagtggagttggtctactcctgaatatattaaccattttttcccttagtcattacatgtaaagcttcatgtctgcatttgtcagttatgatttatccggatcacctttcttacagaaagcggtagatgccaaccagaagactggaataggcttccttttatctcttttgcacagttgtgtcttcggtgagatgacttgactctctgatgttgagagtgtttttgttaatttttgaagcatgatctcagttggtttaggatatgaatgccatacacactcattgttttcgtttggggactgccgctgtgctgggtgactgcgtgtttgtgctgctggcccttgctgacactgatattggatttacaaagccaaccttgcagttttgtgtgggcaggtaggctgcctttaatttgtggttgctttgcccttctgaaaacacgaacttctatctggttggaagtcattttctttttcatcaatctcaactactgaacctatttcttcaggcacatctccagactgccttggatatttcgaggatatgttctgcgtgttcacatttgaactgcagcttggtttgcagacaccctctccttagattggcagctgtttgtggaattcctgagtaccaattacatccagtagcaggaaataaaagacaaacaaggaactagtagagctcaaggtattctttcatccttcctccttcttagctaatacatcttacagttagctctgaaaggagaatttatttaaacatactaaacactgtgcatagtgactcttacatcttttctggtaatagcatgctaatgctatacttcaaagtgcagtgaataagccctgtagagaaatatcctcatggtatggtttcaaaggacaggcatccttctggaacatattgttatcttaggtttttgttttaaatgtcagcacatggagaccttattctaaggctgcgtctgtgctccgctagtgagtatggaaggcttaggtgattcatggtgggaagttgaagtaactagagaagacttggtgctgtttggctttagtgaaatttttagaagctgtagttgaaaaaccaacacagattggccctctgtttgttgcttttggctgtctagggactgcaaagtaaaaaatgacattttcttgatgtctttctgacagtttctcacctgtaggtcaagtcctaattgaaatatgacataaatatttggcgtcataaaagcagaatctccataacacattaggtgatttctagagtaatgctcacttttattgtttgggttccattgatgagttaggcagggttatattttaagaattttcttacatcaggaagagtcaacagaggatggataacatattttgaacgtggacattgcttgtaagttgcaggacacttgtaaacactattgagtgtcacctatagcaggaaccagtttttctttatccctcgttctgtgacagctacctgggttctatgttggagccccgtagtatagtttcaaatgcaatagccactgcataatccttgtcacccaaagactgcagatcttgacagaacttgtacaacagtggccttgctgaggagtgatgtacatttcttttgtcatttggccacataagaaaactgcagccatcactgtattttgatgcatcagactctgtgtcctctgagtgtgattcagctgttggatttcttgattatgaaagtatctagagtacctcatgttcagtgatgtgaactgctatgaaagttccctccgtgtattctgctggatttcttaagttatatcttcacagagagggcttgcctcttatacagtctgcatccagcacccataagtactttcctttgctgcaggagcaggaactgaacccaactgtggatggagtgggaatgtgtgttctgattcctgcttattagcggtaggatgtgataaatatgttccaaagcaatgcctggtagaagtgttcccctacctgcatgtgacaagaagcattttcctcccttcatttggatagaggaagggctttggataaggaaaaaaaataaagaagatcttggaccttaagctggagacaggaaggtcaagtgctttattttttctgtgatgagaaccagctcatttgagaactgaaggtgaatactgactgtcatatttaataagtagtgatggaatttgcatttcttccttgaggtcagtagtctgctttcatagatagaacaggagtttaaattctgagcaaaatatgcaatcttttctctttctttgattcttatcctgtcaattatctcgtcattctacagaggactaaaaggtaaagagttctaagatcttcgcattgtctgggaagaagtggaaatgttaatattagtctttaataagttattaatgacacatattataattgttaggataactcctaaaaggatagtgaagagcatataacttccatattaatggttaaagatgtgccaaacaatagcaacaaaggaggaggaaaatttgaacattgggataaaagcactgcacacagtggtagatgtaaacacaaatatttcagcaattacattacatataaatggactaaatgatgcaattaaaagataaagacatggatgaaaaaacttttcaggaggcatatttaaaagataaggaaataaaagtttgaaaaaataaaaggatagaaaaatattatgcaaatactaaaggaaagcagctgtaggttggctggtatcagtgttgatcatatcatggacatggttgattatggtatgagtttgtgccttatgttgtaagtattcacaatcagagtttcttatagttagaaaaaattagatgatcaaattataaattactagaaagatttcataattgttaaggtgtaggctttttactgcacctggagaggcctttcagccatgatgtgaattatgtaccattatgtaagataagtggagcgtaaatgctttgttcaaacaattataatgtaattggaaacttcttgtgttaacaatatcattatcttaaaggtgaaaggggtgggaagaatgtggtagaaatcaagttccctggggaataggctttacagccaaaagtaaagtcattttttcctgaccagtgacttagcttaaaacaggtcaatgatattctttaaataaagcaatatttaattggattcatttgcagctgatatggattctggggcttgatagcacttacatattaagctggaaatctagaaataagaactttagcaacaatttttttttttttttttaggatttgagattagttattaataacacaggatgcaagactcttaggttgtagttgtgggtaagcataaatatatactgaatagattcagacattggccaagtagactcagtttttttcaggagatcatgttcattcaaagggataatttcttctttctgaaaaacttctattttgaaaatattaaatgatagaattccccctgaaattttttattgtgctgtttaaggaatggtattttacccattagtgataatccatgaatgcatgctatgaatggatacttaggaaacatttcctgcatgtccatggaaagataattatttttaatatttgtatggactgttaggcttttttctgtgagtaagatgtttttaatgtagaggtgtacttatagagtatacgatttttattgtattcttttaaatggactatttaatataattgacatatttcccatggagtaaaaacactatttagatgcttgtggtaacataactcctcaaatcttagtgacttaagacaacaaaggtttattacatggataatgtagatcaacaggaaactgctcattggaattgaagactccatgctgacactgatgggaggctccatccatgcacaggcactcacagtcaccaaagcagcataggaaaatatggtaatccttgcactggctgttaaagcctttctagaagagaaataacacttgcttatatttcattgaccaaagcaagtcatgtggccatgctaacttcaaagaaggtgggcaagcgcaatcctgtatgtccaggactggactattagggaacagcctaattgactactccagattgctactgacaacacttttttaaatgattgggataatactccaataaatgcctatgccatagtttacagagttagcccattttaatgtttgcagtgccaatagtttattaataatgctgaaatggacattttggtatagtcaccattcctccacactgctccttttctggggtacttaaactaatcctagattaagtctcctgttgtatagtttaatggactgctgtatgtctactttgtagcacttattttctaccaacacgctataaatttcatatagagaccacacctttttttcagtgctgtgtctgctaaccgttacataatagatattaaataaacattaatgaaggaatgaattaattggggaagtgggaagggtaaattggtaaaactactattaaggctttttctatatgtttccaaattgctttccaaaagaattatagcaaattcacatgtgagtcagcagtggtttatcagtttaccacccattgccaccactggttattttcctttgctaaatggaaagtcaaaataaataatatctcaatatttttagcactgtaattggcatatctttgattatcaataagactgggtatttttcatacatttggtttttgttattgtgataaaaacataacaaaagttaccatagtaaccattttttaagtgtacagtaaaatataactatgtgtacattgttgtgccacagatctctggaaacctcattttgcaaacctgaaactctttaaccattgaacagtaacttgtcttcaccctcctccaacacttggcacccaccattctactttttatttctaaaatttcgactacttaagtatacctcatataactagacttatgcagtatttgtttttttgtgactggttaatgttacttagcataatgttctcaaggttcatctatattgtagcttattgccagatttccttctttttaaggctgaataatattttattgcatatatatatgtatatcaaattttaaaatctgttaatccgttgacatttaggttacttctacgaacttggctattgtgaataatgctgtaatatacatggtgtgcacttatctcttcatgattctatttttgattcttttgaatatacagatgcttgacttacagttacgtcctgataaaacccatcatcagttgaaactatcataaggtgaaaatgcgttcaatacaactaaccaattaagcacaatagcttagcctagcctaccttaaacatgctaagaacacttacattagtctatggttgggcaaaatcttccaatacaaagtcaattttatagcaaagtgttaaaattgtcatataatttattaaatactgtaccaatagtaaaaaacaaaatggttgcattggtgggtttttgatgttggttatcatgacaaggtctctcactctgccacccaggctggaatgcagtggtgtgatcacagcttgctgcagcctcaatcccctgggctcaggtaatcctcctacctcaacctcccgagtagctgggactacaggcatgagccaccatgtctggctatttttttttattatttgtagagatggggtctcactatgttgccccagctggtctggaactcctgggctcaagtggtcctcttgccttagcctctcaaagtgctgggattacaggcatgagtcagtgtgctcggctgatgctttggttatttaccctcatgatcatgtggctgactggaaatggtggctctttgccactgccccgaatcataagcgagtatgttactgtatattgctagcctgggaaaagatcaaaatttaaagcatggtttctgctgaatacatatcacattcacaccatcgtaaagttgaaaatagtaagtcaaactgttgtatgttgaggactgtctgtatatctaagggcaggattgctggataatatggcaattctacttttactttttttcagaactgctgtcctgttttccacagcagctgcatggttttatattctccccagcagtgtacaagggttccagtttcttcacctcttcaccaacacttggtattttctgttttgttttttgtttttgtttggttttgatagtggccatcctaacaggcatgaagtgattatggtttttgattagcgttttcttgatgtttagtcatgttgaatatattttcatgatgctcgttagccatttatagtatatcttctttacatagatgtctctattcttcaagtcctttgcccaattttaagattggtttatttgttttgctgtgtgaagagagataattttactccaatttggatgccatttatttattgcctaattgcttgggttaggacttctagtactatgttgacgagaagtggcaggagtgggcctctgtcttgtttctgaacttaaaggaaaagctttcagtttttcaccattaagtttgatgttagctgtgggattttcatatatggtctctgttatcttgaggtaatttctttctattaatgaaattttttgtgtgtttttgtcatgaaagggtattgaattcttttcagtgcttttttttttttggcaccaattcagtcatgtggtttttagccccttattaatgtggtatatcacattgattgatttttgtatgttaagccatcctatcattccaggaatatatcccacttggtcatgatgtataattactttaatgtgctattgaatttggtttgctagtattttgttacgaatgtttgcatcagtatttatcagggatccttgtggttttcttgtagtatctttgtctgctttaggtatcagagtaatgctggcctcaaaaaaatgagtttgaaaattttccatctttttcaatttttttgtaagagtttgagaagaagtggtgccaattcttctttaaatgtttgatataattctccagtgaaaccatctggtccggggcttttctatattgggaggtttttgattacttacttagtttcctttccagttaccatattcccctattatctgagagttcactttctgcagtttcaggtactggcagtcaactgcaatctgaaaatattaaatggaaaattgcggaaataaacaataagctttaaattgcatgtcattctgagtagcatgataaaatctcccactgtcccatttcatcccacccagaacttaaatcatccctttgtccagcatttctacgtatacactactcccccattactgtataggaaaatacatggcatatagagggctcagtactattcagggtttcaggcattcactggcggccttggaatgtattccccatgtataagggggaactgctatattgctatgttcagattgtttattactttatgattcagtcttggtagatggtatgtttgtaggaatttattccttttagattatccaatttactggcatatgcttattcatagcaatatattataatcctttttatttggacatcaggtataatatctcctctttcattttgatttttgttatttgaatcctctatatttagtctgaggatttatcaattctattggtctttaaaaaaactcaatttttgttgtttttttctattatttttctattctctaatttgtttatttttactctagtctttattatttccctctttctcgcaactttgggtttagtttgtttttctagttccttgaggtgtaaagttaggttgttaatttctttcttccttgttaacgtaggtatttactgctataaaattccttcctagtattgcttttgctgcatcctatatgttttgcaatgtgaatctcaattgatagaggtttatttagccaaagtttgaggacatgcccaagaaaaacatgggtcacagtagcatttgtgccctgtgcttttccaaagagcattttgggaacttcagtatttaaaggggaaatagcaaaaatgaggctctgattagtgctcagcacatctacattttatttatttgttttaacttcttaaaattttactttttaaataaacatatggtaaaattgacgttgtatgtgagtacagttctatgaattttgacacatgtatacatttatgtaaccactgccataatgagaatacaaaacagttccgtcaccccagagaactccctcatgtcatccttttgtagtcaatatccctagtcccacccgtaacactaacctttagcaagcactaccctgttacccatcaccaaagttttgtcttttccacaaggtcacataaatgaaatcctaccgtatataatcttttgagactggcgtctttcactctgcataatgcctcgaagactcatccaagttgttgcatgtaaacatattattattattattattattattattatggctgagcagaattccactgtgtgaacataacccgttttgttttgttttgttttgttttgtttttcacccattgtagagcatttggctgtttccagtttttgataattaagaattaagcttctataatcattcttatacaggttttggggtacagatatgttttcatattgtaatgcttaggtaattcctagaagtaaggttgctgagtcaaccggtagatgtgcctgtaactttatgagaaactgccacactgtttgccagagtattttcaaatttcagccattctaatatgtgtatagggtattttatcatgattttaatctacatttttcaaatggccaatgatgctgaacatcttttcatgtgcttatttgccgaccctacgtcccctttggtgaagtgtctgttcaggtcttttgctcattttaaaaattggactgcttgttctctcaatattgagttttgagagtccttaatatattctgagtgcaagtattttgctggatatgtgatctgtaaatattttctcccagtctgtagtttgcctttttattcttttaacagtgtctttctaaaaacaaggttttaattatgatggtgtgatttattttttctgttatagatcatgatttacccctttagttataaaaattttataattttatattttacatttaaatgtgtaacttagtttgagttaattttggtataaggtattgagaggtgtagccagctgggcttctgggtcaggtggggacttggagaactttcctgtgtctagctgaaggattgtaaatacaccaatcagcactctgtaaaaacacaccaatcagcgctttgtgtctagctaaaagattgtaaatgcactaatcagcactctgtaaaaacgtaccaatcagtgctttatgtctagctaaaggattgtaaatgcaccaatcagcactctgtaaaatggaccaatcagcaggacatagatggggccaaataagggaataaaagctggccacccaagccagcagcagcaacctgctcgggtcccttccatccacactgtggaagctttgttctttcactcttcacaataaatcttgctgctgctcactctttgggtccgcaccacctttaagagctgtaacactcactgcgaaggtctgcggcttcattcttgaaatcagcgaggccgtgaactcaccagaaggaagaaactctggatacatctgaaggaacaaactccagacacaccatctttaagagctgtaacactcaccacgaaggtcccaattcttgaagtcagtgagaccaagaacctaccagaaggaaccaactccagacacagtatgagatttaggtcaaggttcattttcttgcatttagatgtttgaatgcttcaaacaccgtttattcagaagactgtcctttctctgatgaattgcctctgcaaatttatcaaaaactcagttggtaaaactgtagttgcccatgggtatatgcagcagagcagaactttctgaagtaatggaaatgggaatacacgttacagggtgtgttatgtgggcatatgcatttgtcaaaacatcaatttacacactttaagtcagtgaattttactgtatgtgagttatacttcaattaaaatatcagttggccatatttctgtaggtttatttctggaagtctattctatgctgttgatctacatgtttatctttttgccaataccatgctgtctttattttttattattttattttatttttgagattgaggctcgctctgttgcccaggctggagtgcaatggtgcaatctcagtcactgcaacctctgcctcccaggttcaagctattctcctgcttcagcctcccaagtagctgggactccaggcacatgccaccatgcctggctaatttttgtatttttaatagagacgaggtttcaccatgttggccagtcttgtcttgaactcctggcctcaatcaatccgcctgcctcagcctcccaaagtgctgggattacaggtctgagccactcccggccaaccatgctatcttgatctcaattactttagctttatagaaaccttgatgaagtggaaaagtgtgattcctccaactctgttctttttcaaaattgttttggctattcttgtttctttgcctttccatatacctttagaatcaccttagttctacctacaaaaatcttgttgggattttgattaggtttgtgctaaatttatagattaattaggggaagattcacatcttcacaatactatcttccaattttgaacatagtatgtttttttcatttatttaggtcctctttatttcattagcattttatagttttcagcataccctctaattgtttacataaatatttattagatttatatgtaagtatttcaattttttggaattgttttaaatatcatttttggagttattttaaacagcatttaaaaaatatttggtttccagctccttattgctaacacataaaaatatgatccatttttttacatgtactctacaactttgctaaatacattcattagttgtaggaggtttgtatgtatgctatttcttgggatttttcatgtaaacaataatttcatttgtgaacagggacagttttatttcttcttttccagtcaggatatctttatttcttttccttgcctgattgctctggcttggaattccagtatggtgtgaaataggaatggagatagaagtttgccttgttttcattcacaggaggaaagcattcagtcttcatcattagatgtgatccttgttggttttccaatgatatgtcctttattaggttgacaaaagtctctttttgtagcaaatctacattttacatgtcaaaagagggagtagatgaaaaaagtaaattacatattcatctcatactcagtgaatctacattttactaaataagttgaagtaaacataaaaagaggaagcagaggaaaagtcaattatgcattaatctcagggtaggtgaagagataatttctggtcttgtccttgtcctgtacccgcaaagataagctggtagttgacattgtgagggtgagagtcaacagagctcagttttagggctagtttataggagggatatagatcctgaacgatttagggcctcacgtttatacttattgtatcttccctatgaattggcccttttattgttgtataatgtccttttttgtttcttctgacagttttgacttaaaatctatttgtctaatattggtatagctacctctgttctcttttggttactatgtgcatggaatatctttttccattctttcatttcagcttatgtgtgccattatatctaaagggaatctcttgtatacatcagatagtgaggtcttgttttttaattccttcagccattctgtcttttgattgaggcatttaatccatttacattgaagcaattactgattgggagagactttctgttgtcattttgttaactgtattctgtatatgttgtatctatctattcctcttttcctttttcctttttatttgctgccttcttttgtgtttcattgatttttttttttttttttttggtgacatgctttaattcctttctcattttcttttgtatgtcttctataggtattttctttgcggttgctatggagattacaaaaaacatcttatagttgtaacaatctattttaaactgttaactacctaactttgatcacataaaattcctttacatcccccgtcctactttgttaccaatctttcaaattatacctttttatattgcatatccaatcaagctttcaaactatatccttttatattgcatatccatttatagagttttataattgtagttattttttaagcttttatcttttaaattctataccagaatttaaaatgacatacaacctaccagtacagtattacagaattctgtatttgtctatatattgacctttaccagggagcttacattttcatatgctttcatattgatatctaggatcctttcatttgaaggacttccattagcatttcctgtaaggcaggtctagtggggatgaactctcccagcctttgtttatttctccttcatttttgagtgacagcttttttggccatggtattttgtgttggcttttttttttcttttagcatgttgagtatattatctcacttccttctggcgtataaactttctgctgagaaatctgctgataatcctatggaagatttcatgtacatgatgacttacttttctcttgctgtttttcaagattctctctttgtttttgattttgacagtttgattataatgtgcctcagtttaggctcttcaggttcatcctagttggagtttattgactttcttgaatttagatgttctttttccccctagatttgggaagttttcagtcattattttctcctttctctcactgttctttctcagggactctcataatgtgtatattgatctgctcaatggtgtttctttctttgtttcttttttggctttgactagaaaatttcaaatgacctatcttcaaattcattgattctgttttgctcttgatcaagtgtgctgttaaactcctctggtaaatcttccaattcagttgttgtattcttcagctcaagaatttgttaggttcttttttaaaatagtttctatttatattctcattttattcattcttcattttttggatggtttattttttattgctggttgtctgtacacccagttaactctttaaacttctttaagatggttattttgaatcctttgtcaggtaatttatagatatctgtttttctgatctgcttttggagatttattttattcctttgattgggccatgttcccctgattcttcatatgcattgatttttgctgggatttgggcatttgaaaaacaactacaacaaccagctcttccagtcttaatggactggctttgtgtaggggaagacctttaccagtcagcctggctagagattctgagggtctctgcgaccttctctggagatgtgtcttgtctgggcttgcatgtaatttcccaattagagaagtttgctaatttctttttcaacagtttgtgttctcttgctttctctgtgacactccacagtactgtaggttctccggtacagcaagaaaacatcaagttcttttgttctctgcagccctagatgtccaaagtataccagtttcccgttagagtctgtgttaagcaaaacagaaactagtctcttaggcagccccctgaaaaactggaacactggatgtgcattcactcctcttttcctcccaaaggagaagctctgagtaggttgttttctcccaattcattgagctgtgccagcctggggaaaggctaagaatagcaaaataaaatgacttttcctacctgttttaattctgctgttcttcactttgtatttgcctaggggcactgtggtttcataactggtttctggaggtcttataaaggcattttgtacaatatattgttggtaagtctgtggggggtgggcagggaatgagatctggggcatcctattttgtaatcttacttatatcacctcccaggaagatcaaattttatacttatcagtgtatgagagtagaaatgtcattgtattggggggtcagtagataagattccatatctgtttctatcactaatgatagaactactgctaaattataaaaatgtaaaatggtgctagaatagagattagagtaacatatttttgaaactttaaaatctgaaggaatttactgcttaacttctgcctactttcagggtattaatactagagaaatttcctctaatactttcctttttctttttctttttcttttttttttttttttgagatagagtcttattctgttgcccaggatagagggcagtggtgcagtctcagtttaccgcaacctctgcctcccaggttcaagcaattctcctgcctcagcctcccgagtagttgggattagaggtgcatgccaccatgcctggctaattttttgtatttttagtagagatggggtttcaccatgttggccaggctggtctcaaactcctgatctcagatgatcctcctgcttcggcctcacaaagtgctgggattatgggcatgagccaccgcacccagcctctaatacttttctaattatgaacctgatgaatgcttagtaggatatatatgtaaatcatctgcaattcattcaacatgagtaattactgttaacattttatagtattttctttacattttgtatgtatctgtataatgtattcaaaattatgtatatttaaatgttctctatacacagatctgtttgctctctgatcaccaggctttatataataaactttttttttcatgttaaacattcactggtttttcaatatctgcatattttcctaataatatattgctgtaatatacctcatttgaccatgtaaccatatctcatatttctattttgggaggttattataaatatggggccatgaaaatgtttgtagaaatattctatatgcttttaaaatatcctgttttcttcaagtagattgctggagatggaatttctaggtcaaagaataatgtggacataaatgattttagaactttttctacctttgccagttacctttgaaaaagtgtgagagtgttacattgcttttgtttctcatgaatactatcttttaaaaattttagctaacttgataggtaattttatttgtatttctttgaacattaattctgcttctgtggcttgtttattcttatcccctttgcccttttctttattgtgatattggaaatgtccctttcaattagtttttactctttatttattaagggtgttaatactttttttagatttgtggtaaatattttcccctgattcgtagtctgcatagcttttaattgtcttatgttattgtgggttgaaacttttatttagtcaaatttgtacaactttctttagtaacttttttcctttgctgttgtgcctgcagtcacacaccatccagatattaatcacctagattttaaattttctatatatatacaaatttctgactatactatattccttctctatgaataacctcttttaacatttttttgatgggcaaatttgctggcaatgaattccctcagtttttgtttgtatgaaaaagtctttattttttcttcacttttgaaggataactttgctgaatatagaaatctatgttggtggactccccccatttaacacattaaatatttttctccattctcttcttgcatggtttctaacaaaatgtctgctgcaactttcatcctctatagatgtttccctccttttggcttctttcaaaatttcttatttgactttggctttcagcagtataaatatgatagcccaggtgtaggtatttttgacatttattgtgcttagtggtggtctctaagcttcctagattggtattttggtgtctgtcatttattttggaaagttcttggtcattattccttcaacatttcttttgcttcattctttcttccccttctgttcagttacacacatgtcgcacctttgcaattattccacagttcttggaaggtcgctgctgctgtcactgctgctgctccttcctactcctcctcttccttgttccgcttctcctcctcctcctctctttttcttctctgcccacctcccactctgttttcttctctctttgcatttttatctgggaggtgtctattgagctatcttcaagttctctgattctttcttcagccatgactagtctcctcatgagcccatcaaaaacattcttcacttctgtttgtctgatttctagcaattcctttagattctctcttacagtttccatttccctgttgacattacctgtctgttcttgcatattgtctgcttttcccatcagtgttcttaacatactgtgatagttaattttaggtgtcaacttgactttagaagggatacccagatagctagaaaagcattatttttgggtatgtctatgagggtgtttctggaagaaattggcatttgaatcagcgtactgaataagaaagatctgccctgccccaatattgacaggcaccattcagtcagctgaggtcccagatacaacaaaaagggagaggagaaatgaattcatattctctttctctccccttctctctcttccttcctccctctccctctccttttccctctctccctcccttctagagctgagacattcatctgcttctgatcttgaacatcagaactccaggttcttggctgggtgcggtggctcatgcctgtaatcccagcactttgggaggccgaggcaggcggatcacttgaggtcaggagtttgaaaccagcctggccaacatggtgagactctgtctctactaaaaatacaaaaaaataagctgagtgtggtggtgggtgcctgtaatcccagctacttgggaggctgaggcaggagaatcacttgaacttgggaggtggaggttgcagtgagccgagatgatgccactgcactccagcctgggcaacatagtaagactccgtctcaaaaaacaaaaaaaaccaaactaacaaaaaaacccaaaaaactccaggttctccaccctagggattctgggtcttgtatctgcagtcccgcagtttcttaggccttcagccttggactgagagttacattgttggctcttctgattctcaggcttttgagcttggactgagccatgctaccagcttccctggttctccagcttgcagatggcgtactatgggacttcccagcctccataatcagatttaattcccctgatgaatcccctcttgtctatctatttatcctattggttctgtttctcaggagaaccctaatacacatattaatcatagttattttaaatttcctatccgataagtccagtatttatctggtttgattattactttgcctcttcaaattgttttttcttgccttttagcatgccttgtaattttcattgaaagctgaaaataatggattgggtaatagacctttagtataaggttttatgttaatctagactagattaatcacagactacagttggcctgtgtttagtatttgctgtagctgtaggtgccagaggcttcaaattcctctggcgtcattgtttcagtctcccctgttgtctttgggattccctaagaactcctcagatagagtttgcatcttgcagctcttttagacgtaatctaatgtaatctgttattttactggtgaggtatggtgctaaggtgtagggaaggggaaacattctgtaatcttaggactacataccagtttcttagtgggcttgcattcatggcctatgaccttcacaagtgtttcttagcttttattttcttaaagaaaaaaaaaaaagctcccataatgagataggaaggctagagggggccagagtaggaggaatgtccttccctcaggtggataaggctctggtaaagtctttttggattccactctggagagtaggcctttatttttgaaactcctctgggcatatttcacaatagttaccattagggatggaatatttgtgtccccccacgcccccgcaccccgccaagtttatatgtggaagtcctgacacccaatatgagtgtgtgtggtaggctgcgtgtggaggtattgggaaattcaggttcccaaaagtttggtcgtagtgaagtcctcagaggtcttcttgagtctttccttttcttcaccaaaggctcactgacgtcatccatcctcctgatggaggtcaaagcattaaagtcatttttctccctaggagcgtctcccccattgccaaattgccaggctagtattagggagaaatgtcctccctgaatttcattgttgggtttttttttttttttttttaaaccttattatggctttaatgttgaaatttctgttttggactttttagcatgacacatacacacacctctcattttattttcattgctttttaaactcccatgtccaatgtctattttaatcttatgtttggcagcctgaaacattttatttctaaaattaattctctaattatacaacatctacatggcttgtaatgacatcagtagagcagaatctagaatccaactcaaggttttcgttttgttttttaagagtaagtaacttattttgatcaatgtagtaagaggagattgaaaggtaccagtgtgtgtgaaagtgaatagttgcttcctctccccatctcctcttcttcctcccctgctcctctcctcttcttcctccccctcctttcctcttcctcctcccccaacccttcttccttctactcttcctcctcctctgcttattccttcatcttaactcatccttcactaaaaagagttatattagcattagaagtattccttaatggctatacttttcagatattataacttcagaattttctagccaataacaggattctagggcaaatgtcatgtaggatatggctcttcgagtaccaacatggcaagaaattgatttcctctattgaagacacattgattttcagctgtactgaaaaactcacagccttccagtatcgacaaatagtaaaaattgacttcacataataacacctttatttacctagccttgtgaccctctgattttgttagatgatcctatggtgaaagaatgcaccaggaccaatgcttggacaaatagtaagtctccattttctttatagtagatgcttctacataaaattccgctttgggcagtaacttgcgtagacagctgttcttgtgacacgacataatgcacactgagcacggtgacagctccagacgatggtctactctggagtttccaactggactggtaatctactggatactctcatctggaattgtctcctagctgagtggttaagctatagaagcccatgattaaacaatgttgtttctggaaagaataatagaaatggttattattagtgagtacttactgtctgccaggccctgcactaagggctttttatgtgttagttttgtttaatccccacaatatatctaagaggtattatcccccttttcccgtgaggacactgaaggtccaacagctaataagtgaagctggcgatatgtcctgttttagctactaacatttatcagcttcatcatacagacatactttgtcagattggttagccaggcaagtgaccgctgagagaatggggcacaggagaagtaagtgatgactgcgaacacaggctggacaaagatcactttcttatacgagtctgcagttcttgaaataatacctatcagatatggcattaacagtgattggtagccttatccaaatgcgatatttgacttttgccttcatatcatggtttgaatttacaaacttcatttctttttctttttttttgagatggaatctcgctcttgtcacccaggctggactgcaatggcgcgctcagttcactgcaacctctgcctcccgagttcaagtgattctcatgcctcagcctccagagtagctgggattacaggcatgtgccactatgcccagctaatttttgtttttttttttttttttttttttagtagagacagagtttcaccatgttggccaggctggtcttgaactcctgacaaacttcagatgggggcattgccttaagtgtatgatgcccaccattgaggtagactaccacatggtacctggatgagcatcttatgtttcaccaaaccagaaatttcccaggcaaagtgaacggaacaagagagactgcggattcagacgtttcctatgcagttatacttctgaatgggtagtcacagtgtgttcaagggtaaatgatagctaaattatcacccatctttaaatgttttcactttaacggggttaccaaatcgctctttaaacttgaatttctatcaagcttcagaaccataaatgttttcttagaatttttccaagattatctgaatcagtgagtcctttaactcacttctccaggtatcaaaagtcttttaagtcttttttctgccaaaggtgaatctatgctaacgccttctagtactgattctcctttccattttcccatgcaccctactgctttctgtctccctttgcaattcaacagaaagagaaatcatgaggcagtatgaaatgaaggacttttctgggctgattttccttttgaatcagaatggaaatttatggtcatagtgctttccatgaggtatttagaagtttccagtcaatcattgctcttatcaggggttcttaaaggctttgggagatactaggttagctttcttacaatataggctgccctttgttacagcgacactttctttttgcagattttttttttcttaacagagaaaattgagatatgaaattatttccttaatctctacaataatcaaatcataattatttctattctattttttaaacttttaaatttcactaacagtacatagccattgcagtaatttttttaaaaaatagagaggagcttaaaaataacaaaaacctctataatcccatcacccagagatgagttttggccccattcatctcacaagttctgtgcaactattgcatttcatgttgcctattcatattaagagaatagcattacttttattatgatgatgatttgtaaacaatttcccagagttaattcccagacatttaaaaattttggccataattgaaagtcaggattttatcttctcagttggaaagtagaagagaaaagtataacagtgaaaaaaatttttcttaggtgtgtatttgtgttggattgttctaatttcaaaacagagaaagttttgaactcctgctttcatggttcattcttagaaataaatagaattgttttcccaagaaaaccttggaaaactttctagtaatagcaggaggaatatgggagtaggaaatggcaagttgaaggattttaatttggaaactgccaccttttggaatacagaagagctggttatgggattggcccctggctttacttgtccttaacatgggctttgataaggggaaaacaaagtgagggcttcgagccacaagtcaaggtcttgggaaagcttagcaaaatggtgcaagtctctcgtgatatctacctttatgcttactgctttctattggcaaaaatctctcatcttttgcagatgcactgagatcccatcagtagacagagaaagaacgtgggtgagtcagaagcaatcagccagaagcacacaaatgggtgtggacatgtcactgccaacaacccacacagagtggctggctactgcattcacccttaggatctcctaatgagcacagttaacagtagttggagctttgtctctgacatcctcttgcagtcatctgccttatttgctgattgatttctgttcttgaaactctgaacaggaagccttctgttgactcatccctgcttttcagactggaaagcacttgtaattttatctgccatgtatagtctctaaaaatttattttgaagatatgctgtatcaaaagcaatttaagaaagtaggaaggtaggaaatataacaaccaaaaccaaacagtgacactaaatatatacatatatatagctgtacactagacttaacctaaactgaccagctagatgattttgatgcagtaaagacaagttaagaaaatttgtctttactgtcaacaagacagtaaacttgtctctatgtcaacaagaaaaaaggcaattagaaattcttggaaaaacagaaatttgcaaatgaagtcccaatttaatatgaggtaaactgaaatgtgacagaattctgcataattgatggtatataagaaaaaagaaaaaagaatacattggaacttgacgcttacagctagtatggtgacaacggactatatctcctttaactgatttagtttcaccatctggaactgcactgaataaaaatatttacctaattgtaatactgaatatattttattagttttcatttttcataattaacctgtatgcaaagcatggaagataaattatatttgctgaacaaaatggaaatattctaaaacttgatgttgtaaattaatgcttattataggtgataaaatgtaagggggggattgaggtggaatggagtacaagagcatatgttttcttctgtttcatagtggatggttgaaatggtactctttagtcttgatacatagagaagtagagatttaggaatatgattacatgattaaggtaacaaatgaaagattatatatctgaagaggacagaggggaaaggagatgctgtgtctcaaaattgtgttctcctctagcagggaatcaatataccgttgacccttgaacaacacgggtttgaattcaggagtcctcttatatcccagtcttttttaaaccaaacatgaattgaaaatacagtattcccaggatgcaaagcctgtgtatagggagggctgactttgcgcatatgcagattctgcaggtggactgcaggacttgagtatgcctggattttggtatatgcaacaggtcctggaaccaatcccccaagtgagtatactgaggggcgactggattgtttcacttttgtagaggcatatgggagttaggcagccttgtgcttttcatactatgttcttgtttaatttctggggttttttgtttgtatttttgttatccatgtacatcttttgaaactgaaaaaatggtgatcagatgatttacaagaaactttgattaacaattatactagcacaactttgttaaatttccctaggagaagacaacagcctcaaatgcagtgggaaaaaaaagcaaaatctgcctgcttccacattgttttcaaggagagcacttgaacaaaatggtactatttggacaataaatagatgggtaccaattctagacaagcacaagcaaaaagaaaacagggctggcagtattcgcatgggggcaatttcaagacagaaagcattaagtggacaaaaggtgatattttgtaatggtaggggttagaatccaccaagaatttatacagccatggttctttacgtatggaaaattagcgccgaaattggtaaaggaaaaactgttaggagataaaagaattaaagaataaggcaaaaaatattagtacttagaaaattataatagccaatggtataatttaaggtatgaaaataaaacaaacaaaagtctgcacctgcaaaggaaacttgaaaggcagggctgttggggatggggtgtgtgtggcggtgaaaggggtacagatagtttatcctaatcataggttttaatcactttcttgtagaaggaaggaaaagttttatttctgtgacaccatctcattgtaaaatccagtaaaattgaaaactttgagataaatgtattatcaggagttacagccataacttttagtatgtgagctataaattctgttcttatcactaagtcactgagaactaaggctgctgattttcccaacatagtaaaacagagcgacctgaccaaaaaatgaaaaacatttttatggacttttattctccttcctgcaaccctaatctccttccttcctctatagattctagtctatctaagaaattctaggtggatggtttgctttctctgagggaagctaagattgaggccaaaaggagatctgctaggtacctgtgcaaacgtcaggtgggacagtgaatagaaagtaggcatgcaggggaccgagaaagataggctctgggcatcacaaacagcttttccaactctagagacttgaaaaatgtatttggagttacatctaagtcagaagagtacatcttgtttatccccccaaaaagcctcctggtatataccttttagtcaaatagcattgtgatcttgtcacaatatatggacaacagatattttcagttcatttgatacttaacatagaacatattaatgtgccattttatcagaaacctgtaaaggagtttaataatggataactagaatgaacataagtggtagcaggtccttactctcatcccccctcccacttttcataatgtactgatttgaaatgttcgtgaaatcaatacagacaaattaactcagtgagcagcttctccccagtctcttgctgcagtgatgagaagcctctttctggatctacttgtttccagatggtagacaaggcttattctgacacatggactgaaaacagggcagaccagcagtcggaatcttccctgcttagtgtcttaatctatagtaagacctcaaagaattagattccctagcatgaggaatttttcttactgaattttttaatgccactatatggcagtgattaaatagcaagttcaagtgattaaatctggtccatctctatacttttcctttacaattgctatcaggttttgtaagtaaggaagtggaggcatttttgtaagtgtgttaactctcaaagcccacaaaagtatgtttttaaacttagggatcaagttgtgtggatccgatttcagacccccagaggttcttccaatgtgtctaatgtccaggacagtgcacatgttcagagtttcattgtatttttctttctttctttctttctttctttctttctttctttctttctttctttctttctttctctctctctctctctctctctttctttccttctttctttctttccccctccctccctccctccctccctccctccctccctccctccctccctcccttccttccttccttccttccttccttccttccttccttccttccttcctttctttttttgatggagtctcgctctgtcaccaggctggagtgcagtggcatgatcttggctcactgcaacctccacctcccaggttcgagcgattctcctgcctcaacctcccgagtagctggggctacagctgcccaccaccacgcctggctaattttcgtatttttagtagagacggagtttcaccatattggccaggctggtctcgatctcttgaccttgtgatctgcccgcctctgcctcccgaagtgctgggattacaggcatgagccaccgcacccagccagcagcatgttttctttgaagtgttgttcaggggtctcttgcatcagaatgtcctgaactgcttgttgggaatgcagtatcctgatcctaccctccagattctgattcagtaagcctggactgagccttggaaatctgcattttatttagcataatgtcctgggggcttgggggctccccaaagtttgaaaaccaccgctaagggctattatgtttctgtaggcaaacctatttttctgttttcattttatgtcatacaaagtaggagtttaagaatttatttttggtgaaactagaacactgtcttcaaattaataagagccttgttgtgtaggagaaatattctcttcaaaatctctccacgaaattgatctcaaaaagactggctgagtcaaatgctaaacagatctgtcctgtatctggctgccacctgtcaaaattgctgaccttacacttatgtattcaaatgcttcctggaagtcaaaacatattttcaaaagtttctagtggaaaagaactaagcctgtcgcttggttttaaaaggtggaaattgagataagaccgaatggttgagattaatttcacatcacaagaataggggtgagaagagaatagcaatttccataacttctatcatttatcttttaggttgaggatactgtgaaataatccttccctttccaaccaacatgaagatgactgatacacccatcatactgaaggattcctactgtgtcagagattacattatattaagtccttacagaaatataaagagtataaccttcaaaaaactgggaattgttaaattatacattggattttgggggctattgtttgggaggttttgttttgttttgttttgtttttccttctttcataacagttcgctcaattaactataccagaggcatctttggctgcaaaggtggaggaatcactgtgctcgaagatgacagttctacaccttggcctgacagttttgagattcttgcttctaaaataagatggaacctgaaagatgggatgattctagcatactaagtatttgactttaattggaatcattgaacgtcccttgaattttttttctcattggtattggattctgttgtctttactgatggaaatttcttttccttccattcttggttcatgacaaaccaccaactgtccacgcatgatctcctttcattttacttgtatttgaaatgaaaacctgtgagtgcaatgcctaatctaagaatcagaacattattcttttatacccctatctctgtaattctcctttatcttactccttcacctccccatccctctgccaccagaggtaaccaccattctgaacattgtttatcattctcttgcttcacccctacatatctacatgtagccttaagcaatacattgtttcattttgcctggctttgaactttatgaagaggtatcatccctggcttatatgatctcttgagacttgctgtttcactcagccttatattcctaagattcatccatgctgtcattgctgtgtagtatttttatttgtgcttatactgcagtttttctataaatgttagtataggttatactatgatttatcaatactcatgtcattgggcattcagggtgtttcctgtttttgtatctatgagcagagctgttagtaagcatttgcgtctcctggcatgcatgtgccgaggtttcccttgtgtctatgcttagaggaagtacagcaaccactgctgtgttgtggtgtatgaaatcattcaactttacaaaagaatgggaaagcgctttcagggtcgctatatccatttacacttccaccagaggtgcagaaaagatcctatcagttcacctcttcaccaactctttgtattttcagacatcaattttttttttgccaattttgtgtttataaatctactgatatacttcttaagtattttatctatcccttaggaaaaaaggtaggaaatagaatgtggttgccttcacatagagaggctagaaaacaaagtatcatgcctgcttagtttgatggcacccaaatttttctcccagttatctcactactagtagttgacattcttttctcaccctcgctagaaatatgaaaaccttgcctctgcacagtggaatcccttggaacatttaaaaaatgctaatgtctggaccccacctccagagactctgatttctttggagcccagcattgaacatagggatttttttttttaaataaaagcttcccaggtgattctaacgtgcagtcaaggttgagaatcactgctttaaaatacagaaatcttgacaagcaagcataagctcagggtagcctgatattgttaattgttctttttctcatttctaaagtacaaagtttgcataattttggagaatcctcttgcctctaatttctagctcagcagcctttgagagttttttggtttttgttttggtgtttgttgttggtagaagtaaatagtagaaattcaataaaagttagtatgggctagaaattgtgcttgacatttatttttttcttataactgtggatctcaaagtttagtgtgcataagaaacacctgggaagcattttgttttgttttacaatgcggattttgattcagtaagtcttggcgtgagcccccgggaatctgtgttctaacaaagtgattatgatgtaggtggttctagaatcacctttggataaaaactgcctcataataatcctacagtataagcagtattctcatttacagatggggggatgtgaagcccagagaagttaagaagcctgcgccgtgtcacagagctccctaggggactagcctttgctctgtaagctctcagccctgctcatagtatgcctccaacaaggctctcagaatttaggaaagtctgctttggaacatgtgttatcttctctatacttacattctttcttaatctgccatgactttctctcctcatcaaaaaacagcctttaatctcctacccaaatccacctcgtacctgtgagtcttcaggtgtgttacactctgaacatggtcccgtgagagaatttcttattaaaaattgagcttgcaaaaaatcaaatgtgttatatttttgttcttatttcaccctaaaacaatgactttagttgacaatcacttttatgcaaccttagtaattatttctaaactcatgtacaagtggatggaagtatttctgtgcacatttagaaaatttatattcattgcttgtttccctcccctgccaccccacagagtgaggactttaccatgaaatctgggcctttggcctatgtatttttaatcatgttcatattgtactgtatctgcaaccatctgtaatacagctgtatatgtttacatgaaacacaataaacttttaagtttaattccatttgtgagcagatggtagcttgtcaaggaaacatttgatcatgtttatgtctgtatttggccacaaaaacctcataattactctcattaattacatatccttttcatgttacctgtaataaatgctaaggtatcatatgtgttggccttgtgggatatatttttgtatgtagagacagtcctcttaagaatgtttgcggcctggagcagtggctccgacttgtaatccaagcactttggaaggccgaggcaggcggatcacttgaggtcaggagttcgagaccagcctaggcaacatggtgaaaccccatctctactaaaaatacaaaaattagctgggtgtggtggcaggtgcctgtaatcccagcttcttgggaggctgagggaggtgaattgcttgaacctgggaggcagaggtttcagtgagctaagatcgtgccattgcactctagcctgagtgacagagtgagactctatctgaaaaaaaaaaaaaaaaaaaaaaaaaaagaatgtttgcttctgtaggcacatttatgtctacctattatgatgtcaagggtgtattccagtttgtatctgtagctgctacaagaagggtgtcatgggatctgtggttacactcttactcttcccatctgggtatttctgagtgtatttgctccaggagagccactggttctgctggcctacatgcaaagtgtatctatctctctgttaatgcgtttcccatgatgatactcgctgctgagatacttcctaggaagttttgctttcctatcacctcctttaagtgctttcctttaagtgttctcattttaactcattattaaactagcagacttgattgcagtgaatttttcttaaataacttaattgtagggccttttgcgcgtcattttgtgctcctacttactgctcagaggtggtacaaagtcagcagctcaagagacagacctgccacccatgatctctcctccaagttctcaggatgttcagaaagttaaaatttcactctgtcgagtttccatctggcttggcaatcaatgccggattagctccaaatactctttccaagtctcttgaaggatgtgctagcctctgttttgaattctacttcaggatcacaccatctctgcatgcaagaatgacatatctgagtgactgccactaaacccacatggtggaagtgtttgcttatcctgctatgtgatgctggctatcatattgtcagtttatgaggtgtttttttttttttttgcttgtcttcttccatgtaagtatttccagagcagaggcattggcttgcagaaggtgtgcctgcaatcagtccagcttccccagatgtgctgaggcttcaacaggggtttttaaaacttgtgctagaatactcatcttccaaaaaatctttaagttgatgcaatataatagctgccaattgagcatacattttgaggtagttttctttaatgggagtatatgctcatccacactctctttccagtgttaaatattttaagacagctggttagagttgagggtgccttttttttggtcataaaacgatgacagaactctaaaatcacatggttatttatcaacattaaaaacattcttttatatccattaattaatttattctttataacagcttctgtggaataggtatataaagggtttttttttttgtctactgttatttaagagtatcataaaacctgagaaagaaaaacataattagttgtcatctagtctaatgctctcattttgcagataaataaattgaagttcagagagatgaagtcactcacttatggacctatagctagtgaatggccctgaaattgtttcccagtcatggctggaggcacaactttgtctgagacctgactgatacttttgactatgtgatgttgtgtcaattatctaacacttctggacctcagtttctttacccatattatggattattgtgaatattatattagactacatccaagaatgctattaacccagggcctaccatcaaataagtagttaatttatatcagccacttcacagctgcacttatttttatttttattttttctgagacagagtctcgctctgttgcccatgatggagtacagtggtgtgatcttggctcactgcaacctctacctcctgggctcaactgattcttgtgcctcagcctcccaagtagccgggactacaggtgccaccatgcctggctaatttttgtatttttagtagagacggggttttgccatgttagctaggctggtcttgaactcctgatctcaagtgatccgcctgcctcagcctcccacagtgctgggattacaggcgtgagccaccgcgccttcctgctgtgcttattttcaatactcttttctcagggatcttggtaaccagagcagaatggcagtttttcagctcttacaatgcctttgtttagaagtcttgtatgtgtatatctgctccatcacttaaaagttctcctaatgcaatttggaagggtttaatatggaacaagagcagggactttgggatggagtctaatgataacttgtcacatgttcttttagaagctgaattaggtagtttttgccttactggtgcgctctcatttaactgtgaggtatcctggcacttcaaacaggtaccatatggtaactgttttgtgttttaagcctggtactgtttagaacacatgcttcagagagtggtcattgtttcgctgccacccagttaaggcatgtgttacctcttgttatggatggaatgcctgtgagccctaggttcctatgttgaagccctaacccccagtgtgatggtatttggagatgaggcatttgggaggtgggtaaggttagattagctcatgatggtgggaccctcttgatgggattcatggccttataataagaggccatgtgaacacagagaaaaggtcatgtaaggactcggcagaaaggtggccatctgcaagccaggaagggaggcctccctagaagccagacactgcctgatcttgatcttggactttccaggcttgagaactgtgttgtttaagcccctcagtctgtgatattttgttatggtagctgggcttgaacagactgagagacctctgctggagtgtgcgttgttcaatgatttacttccttgtttgcctacattatacactttcactatgtctccacgatggaagaggcatgactgttcagatgcatcggggttcgtctctacctaccaaggtcctgtgccatgaggagatgtcgggccagggactcaaacaggagcagtcatccaactcctttctattaggtctttggtgatttaaaatctcatatgaatcaagagctggtagagtgctaatgttcacaggtttttatagaacattaaagctctgtaatagttattttgtatgttatataaataatttccctgcaagtatttattcatttactcttcatttacataattgcttataatcttttttaatatattcttgtcccctgcgccacccctcccaccttttttttttttttgctgtggttcatatgcttttatgtaacctgagctataaaagactagaatactgcagatattctatctgccatgtctgtcattttcttatgatgggtacttagtctaccgtatacaaatttctgtatagttaccaatgtctttttagctatttattaatcttatcttgtttctttggcttctgaatcactttgctgaagttgaaatcatctgaggtcagagccagtttttatttaaatagactgaatgcagctaaacctggattatagccaagaaagatcttacaccaagtgcctacaaaattagaagcattgccaaggacgcatcagcagagtgttttgcttactgaagtcttattctgaaataaatttgaggccctggcgatgggagcttttggttgttattggtagacctcctaaaaaatgtaatgtagtttaattttacttttaatttttttagcatgaactttctccttcatttcttctttccagagatttttgggtctatccattggttgccatctatgtgttcaaacatgtgactaggtagaagagaggtaaacaggagtgtattcacctgttatcatggagaagttattattcaagacctgtaaggggaatgtggcagtcctaaaggctgcaaatattctggcagcattgtaggattgcactttccctcctcctctgaaggtagatgggagccatgtgtcttgctgtggctaatgaaatgtgagcaaagtgttgcaagctttaagagccagtgcatgattcatcatgttcccatcccattgccacagtgtttgtgaaagcgagtgttgagatggaccctttgttttctgggtccttaattgactgtggtaagataaattattgacaacctgtactagacatatatcttcagcagtatcctttggttgggattttgttgagataagggtccgtgatttggcatactcagtgtaacctaacctattctgattcttatagggaatcagagaagtgtccttacactcagggagcttgtgatttaatatagttgagaagatgtgtttgcataatgaagaaggaaccagctgcttaactgtactctttatttagccacattactgaacaagagacaagctgattatagcataatattgagattttgagtatattcctgagaccctggtttcaactggaaaagtaactttttttttttccttgacactttcagatcacaattgatcaaaacacctatgcaaggaattaaacttgctacaaataagccactagatgcatgatacctttaaaaaagaccaattatgagttatcttttattgttctttttatattaaaaatctgcatgggaaatggaatgagaatatttataacagtacagatttgctatgatggtgtctattaatcaaagttctttattttttagtatgtggggacgacacatactcatggctaatattggtgaaattgctaattcattcattctttatttggtgattcactccacaaacatttattgggcatttggtataaaccaggcatagctctcaatgctgctggtacagcaagaaacaagacagagcctctgactttgtgtcttacattttagtgagagaattgggtaataagcaaacaaagaaaggtacagtgtggtatcaatgatgagagttataaagacaaagcagagaaatgagacagacagtgcaaggtgtgtgatctcacatagagtggtcaggaaaggctgctttcagaaggtgacatttgaacaagaaattgaagaaagcagggagaaaagccatgtgactgccctgaggaagaatccttcaagtggcataaatagccatttcaaagaccctgaggcagggatgtagtaggatgtttgaagaacagcaaagagaccagtgtggctggaagaagggtgagcaagtgaggagaggtgggtaggagatgaagccagagacgtggtcaagagccacagaaccagggcctgccctgcctctgatgaaaaggcactgggattttgaatgtgagagaaccatgacctgctttatgttggaaactgatgtagtctgtggagggcaagaaaacaaacagaccagcaaggagacttttgcatgagtccaaattggagatgatggagtttggacacagttggcaagtgtggtggttgtgagatgtgttgggttcaagatatcttttgaaaatattgctattaggactttgtgatttgttgtggactttggcctgagcatctgattgactgatgatgctattttctcagatgaggagaatgttcaagatgttgttacctatttaagagaaggtggccattgcatattgcatatgtgagcctggacttcaggggaaagtttaggactggagataggcggttggtcattcaatggataggtggatttgaatccatgagattggatgagattcttttttgtttgtttgtttctgagacatagtcttgctctgtcatccgggctagagtacagtagcacgatctcaactcactgcaccctctgccacccaggttcaagcattcgtgcctcagcctctgagtagctgagatttacagatgtgcaccaccacgcccaggtaatttctgtatttttagcagagacagggttttggcatgttggccaggctgatcccgaacttctggcctcaagtgatctgcccgcctcggcctccaaagtgctgagattacaatcatgcgccaccacgcctggcctggatgaaattcttgaggaaaggagggtaccgagaggagaaaagatgttgaagaactgaatctggggtgctcccaacagttagaggttgaagagctgaagaggaaccagtaaaggggaccgaaaaggagcagccattgaggagagaggacagccagacaagtgaagtgatccacagctacatgaagacagtgccaaggaggaaggagaaatgagaaatgaaaatactactgagaggttgagggcctgggctgagactggaacacaggatatagcagcatggagatcatggtgacattgacaatatcatgtcattgattgggtgggggcacaagcttgattgaagctggttcaagtgagaataagagatgaggaaataaagataggatatacgtttcttgagagatttttgctgtggggtgagaggtaagggaggatagctatttaggatgtgaagtcagaaaaatttaattttttaaagatgggggttatattacacttgaaagctgatcattatttagtagagataaagaaattgacagaagcatctccttaagtaggcaagaggggatgggacctagtgtaagtggtgggttggctgctgcattagctggagttaaggcattgcatgttctagatttgtacggagacatataggtgaatgcacacacttatgggaagatactgttattatcttctgcttgcctttgttttctaagaaatagaatcaagatcatcagatgggtgtgagtaaggggtcatttctaggagtaggagtgtaagttggccaagaaagtgtaataagattgctgagcagaactgaaagcacattgagattactatcatatctttaaagcaaaatcagccagtgtagttctttgtttttctctagattgtgtcatttgctgtggtgtagggagagagtctaaggattctctcgtaggtaatcatggtcatagttttgcaatctgaataatgtggaagtggagatgggcagccgtgcagtagggcacttgcaagggagcaatttttgggagtgccaaaggccaggctggaagaggtgaaggaggagggagtgatttttgggtggtgccctagaccaggctgaaggaggtgaaggaggagggtgaagacataaagtggggaacggaccatggagaggaggtcaagtcaatggatccagagggcactgatgccaaattgttgacaggcatgagagggaatgagctggaaattcctttgaaataaaaagttggcagctttcctcaagcttaatctcaaaagagacatttaaaaattacttacttttgctgcatggttggggaaaaatgtatttttcaagcatgagttcaactcattttgtaccagggtattcacactgatattcttgggtaagtcattaaaattagtcaactatttctgtgtcttcacccacaaaaggagacgtgtgagaagtgaatacttagtgattgttagattccactgaatctcactgctttgttgcagtttaacgagcaggctaggattgcagcgctgtcatttcagttgggccaccaagccttgaatgaggagataaaactggaagataaagtcttagtaggtacaacaaaagaagcttttgagagatcgttggatagatgtcatctatttggttgctaaataataacacacaaagaaatctctctactgtttatcatgtgtacttatcttgagaagcatcagtgattaaaaaaacaactttgaaaacataaaaatggtgaagtgtggcaatggtatcatgtggcaacggtaaaatgtgtttacccatgtaaatataatgtcacaaatgaatcttgtcattatattttgtagtatcttggaggttactggccagaactattataatagtcagattcatttcatatttatttaaaatccgcggtgttttcacatacattgtgtttttaggggaaattttaccaatgattaacatatattgtctagaagcagagccatctgaattgaaactcaaatataattgccacttttattaaatatacaactggcagactttgaaaatgttatctcagcatctagcattggcttcattttggtttctcattttcctattttattttgttcagtttagcaggggacagtggggaacagggttacaaattgcattttttcctgcattattggtttttgtcaagtggtttacaggccaaagtttgtggatctgccagaggctttatcccaaaactataggcaacagctatttcttgaaataattttagatagatttctacattgatttatgttttggggtatatgatgcacaatcccttaagtcttaatatgactattggtttaatatggcagaattaggatcaggttcactcattgtttattataatttacccatgcttgactacccaataaaatgtcttccctttacaatgatctttttctattgccatattcttcttgtccttaaaacaacaataacagatcctcaaacgtcattggggttaataaaagatgtttctttattttcagatctttaacaaagcttctccttaacccagagggttttcagaggagtaaagagtggaagtcatttgtacatgaattggcttttgaaagtggccctcattattttattttattttattttatttttttattatactttaagttttagggtacatgtgcacaatgtgcaggttagttacatatgtatacatgtgccatgctggtgtgctgcacccactaactcatcatctagcattaggtatatctcccgatgctatccctccccccctccccccagcccacaacagtccccagagtgtgatgttccccttcatgtgcatcattttttatgaagtggccctcattattaagccatgtctctgcctgttgattgatgttaactatctgcttatggtctgagatcagtgtgtactgcaaatgtttgggaagatatcttctttctgtggaggtgaaacttaaatatcttctataaaatatgcctcgatttcagaagtagcaattgtagcaatgcctgatgtgaccactttattactgccttagaagtacttttgtggtttgactgtggggagggaacgggtcactggagattttgctatctctccaggtttcatgctttgggaatcaaaggtaggtaacagtttggaaaaactctgtaggggctaaagctttttctaaaggtttttacgtctatatatacctctgtatgttactgcttcaagcccagcaactagcaattttagtttcactgaaattgtgttttctttaaatacacaagataatagaattgtaactggaatttacatgttatatataaagatatattttatttaatcttgtcagaagggttttttttttttttttttggtgcttttaagctaatgtggcatctttctcttttcaaagagtggcatctccaaggaatagctctgcctggaaggtgtttgtggctgtccacttaaaagctgaaattaggtcagtgttattttgtcttgagataacaaaaataagaccccaagggagtagtgacttgggatttcatttaagtacttaatttacaggaaaaaaaatacagtttccgatactgaataattattacactactgaataattatatattttttcttctcccggtgttcttatactttagaggcaattttttttttttttttgtaaagatcacaaaaggtctgattagtcaaagaatgaaagaaatgcactgtggctccaaagtcccttatccaaaacctctgggacagatgtattttggaatttaagatttttgtgctgagaatgatggtttccagcttcatccatgtccctgcaaaggacatgaactcattcttttttatggctgcatagttttccatggtgtatatgtgccacattttctttatccagtctatcattcatgggcatttgggttggttccaagtctttgctattgtaaatagtgctgcaataaacatacgtgtgcatgtgtctttatagcagcatgatttataatccttggggtacatagccagtaatgcgtcattcccagcaaactaacacaggaacagaaaaccaaacactgcatgttctcattcataagtgggagtcgaacaatgagaacacgtggatgcagggaggggaacatcacacaccaaggcctgtcggggaggtggaggacaaggggagagagagcattaggaaatatacctaatgcatgcggggcttaaaacctagataataggttgatgggtgcagcaaaacgccctggcacatgtatacctatgtaacaaacctgcacgttctgcacatgtatcccagaacttaaagtaaaatttaaaaaaagattttttggagtttagaaaaataatacatttggatttagcagggtttagtgcggcactttttaatcacacacactaatatttctgtagtgaaactgaatattcacactgagataaagactatgaataacttcacatcagttcaggtaaggttttgcctcctattaagtcttgataacaaactttaaaaacttaaaaaaataaaataaaataaagtttattttcaaaacttttgaagtttgcgcgtacagctagcttgtaggtctggccttgcttttctttagattatatttcccttattagtcttctaaacacattaaatctgtgtttaccaacgctgtaatattttgccaccgtgaggatggtctagaggccagcaccatccacatcccttgggagctggctagacatgcagaatcacaggtgctaccacgaagctgctgaatcacaatctgcattttaatagaatccccaggtgattcatgtgtgcgttaaagatcaagaagcattgctgtagtattatattggctttaatttagattccaagtcttaaagggaaatgctgatggggggatactttagttgtttaaatcctgggaaagtgagcccagattacactaatatcatttatttaattatgtatgtatgtattttttttttttttgagacaagatctgacggtatcacccaggctggagtgcagtggtacaatcttgactcactgcaacctctgccttgtggggttcaagccatcctcccacctcagcctccagagtagctgggactacaggcatgcaccaccacacctagctaatttttgtattttttgcagagagggggttttgccatgttggccaggctggtcttgaacttgtgagctcaggccatctgtccacctcagccccccaaagtgctgagattacaggcgtgagccactgcatctggccgaatatcagttctttttaattttttattcaatatttcctccgtctctccctcccactcttcctatttttttttttttttttgagacagagtctcgctttgtcgcccaggctggagtgcagtggcgcaatcttggctagctgtaacctctgcgtcccaggttcaagcaattctctgcctcagcctcctgagtagctgggattacaggcgcctgccaccacacccggctaatttttgcatttttaccagagatgggatttcaccatcttggctaggctggtcttgaactccccacctgttgatatatgtgccttggcctcccaaagtgctgggattacaggtgtgagccactgcgcccggcccactcttcctttctctcctccttccttttctttttctttctttttaaaaataagtctcataatacttgactttaaatggatcatttagtctatttatttacatttattatattcttgatatatttggatttcttctcttttatactttctgtttattctacttttgtttctttctcttgttttatttatttttttgagatggagtcttggtctgtcactcaggctggagtgcagtggcgcaatcttggctcactgcaacctctggcctcctggcttcaagtgattctcccacctaagcctccgagtagctgggattacaggtgcatgccaccacgcctggctaatattttgtatttttagtagagatggggtttcaccacgttggccaggctggtcttgaactcctaatatcaaatgatccacctgcctcagcctcccaaagtgctaggattacaggcgtgagccactgcacctggctctttttcttttaggttgatattttttttctcatcctattccttcctctgctagtttgttatataccctatttctctcttttagcagtaatcctagaaattgtagcatgcatactttatttataaaagtctaaattcagtcagtatcttttcttcctcctaaacaatagctcagaatgttttaactcccgttttcctctcttgtgctgtatactattcttgttgtgtgtttattctatttttaaaaattattaatcatagatgattttttaaaacttatttttttcaagacagggtcacattccataagccaggctggagtgcagtggtgcagtcacaatgattgcagcctcgacctccctgggctcagatgatcctcctacctcagcctccagagtaactgggactacaggcacacaccaccatgcccagctaatttttgtatttttagtagagacggggtttcaccatgttggccaggctggtcttgaactcctgggctccagcaatctgcccgccttggcctcccaaagtgctgggattacaggtgtgggccactgcgcccagccaatcacatatgatttggttgtttaatagtggtgtttatctacatttattcacatatttgccacattagttgcttactacgtatttttgcattttagaccttctacttggaatcaccttcttcaacttggattctttagaccttccttaactgagagtctcttcatggcaaactgtcttggattttgtctaaaaatgtctttattttgcccttattctaaactgttactaaactatacattttgttttttgttagtgtatctgatttgctggctgtcattcattgtgctttatttctctctctctctctctgtctctctctgtgtgtgtgtgtaagggagagaatttgctaattagttgattaattttccactgtgagctgttcatttttcttacagctttgttatgaggattcttccaggtctgagttacagaaggattctcctagaaagtatttaaggttgcttctgctatgtgcctgggttattaccaactgtgactcttcacattaaatttttggcttcagggttttgggactctaagagctgtatgaactcgcactgcaaactcatatgagttttcacttattatagtaaattctcaggtttgatttttttcttcttccatccatggccaagatttgagacaggcaagtttccttgcactccaggaatgtagcttgacttactgttcctggtgttggtggtggtgctgctggagatgagatccttttagccatcctatctttggcaggccctgggctttgtttcaccctgaactctgaaccctgaatcctgtgggcagggcttctgctagcccatgtggctccactctaaattgatgcaggcactcagcttgttaaagggagcactggatggatttcagcaagcttcctgttccttatggttctgtctggtaggccttaaacctaggctcaagtactctggagttaaacaagtggcccaaggcaaaagccagcttcagtgcttaacttacttcgcagggattgtatgtatgtatgcatgtgtatgaatatatgttatgtatacatatgtatgttttgtgcgtgtgtatttcaccgttgagtgttaattactcccttgttacaactcattgatgcatttaaataaaacatttaaaatattttattcatctcctctcatggttttcagcaaaaatgtaggtcagggtaaattaccagatatattggaccagctggatgtagtcgcctttgatttttttttagttctaccacctatgtatgtatcaataaacaatgtattctttagtgcttccttatttttaaacattatgtgaattgaataacttatgtaatcttttgcaatttggtttcccgcaacatttctatatggagtatggttcgttcatatttactttataccaatatatgaatttctttagctattcaacacaatttaactattcagattccactgttgatggacttttggattctttccaatttttgctattggagttttccagttttgctgctaagaacactctcgtacatgtcttctggtgcattgtccaggattttctctagaatatattcctgggggtagaattgatgattcattgagtaagcatgtgttgtaccttactaggtaattacaaatggctttccaaagtagttgtaacaaattatgcttccattagcggtacacaagagtttctgtggctccatgtccttaccaattcttagtattgtcaggtttcttaattcttgcctattaggtgggtggacttaatacttcttagtttagttgttataacttgttttttaaaattaacatatctatgtgcatattcgtagtcatacatgtttgtctggtcatttaggtacttatgcaatactctagtagactcagaatagaaattagccatggcaacatatatattacattcttcatattgctacatttgaaaataatcataattatttgcagaaatatgaacagaacatatagaattaaatgttttcacgatgtcttgtattatctttcatgtttcatagcaatctctgtgttataggccacatcaactgcttttgcattgttctgacttacaggaattgcagatttattgttctcagtgccatatttaagttccttctctgtaacaatcaggtgtaatacttgtaaatttttttaaccttagtacaaatttaaaaagcagaaatttctcttgcagcttcctgtgtttcaggcccagtgctaagcacatggcaagcattgtcccatttagttctctccaccatgcttcgggcaggtgctgttgttaagcccctttcatggaggagtgaactaaagcatggagaggttaagggtcttgatcaaggtcccacaatcttattctcaatggaccttctccttctctaatctaaaaccctcattttattttgggaagtggatgtaggtctaggaagcttgtttgtgtgtgtgtagtttgtttgttttttttttttttgagatggagtctcgctctgtcgccaggctggagtgcggtggcgcaatctcggctcactgcaacctctgcctcttgggttcaagcaattctcctgcctcagccttctgagtgctgggactacaggtgtgtgccaccatgcccggctaattttttgtatttttagtacagacggggtatcaccgtgttagccaggatggtgtcgatctcctgacctcaggtgatccacctgccccggcctcccaaagtgctgggattacaggtgtgagccactgttcttggctgtttgtgttttatattaggaggcagagagcacttaggggaagcagaagctctggtctgaggaggcagtggtttacttattagttcacaggccttttaggtaatcactggtccttcacttaattaagcaacttaatatatgtcttacggattaagttaattttaaatcaatgctaatttttatgtcaaaatatattaagcagcatcacattaaagtcaaaggtagtcttgtaattattagagcaataggtatcgtgctgtcgttctccaatgtggctgcacattggacaacctgaggagctttaaaaaatactgctgcctggggatcactcccataagctctgatttatctcgtctggggcaccaggagttttaaaatttctccaggtgatctaatgtgtagccaagcttgaagattactcgatagtcattgattatgtgcgtgccacattcagattggtggggttcaaatcctccttctgccactcactagatgtgtggccttagttaagttttgttaacgtttctttatgtcttcatctgtaaaatggggatgaatgataaaaatactgtctgcatctcagagcattgttatgaggattaaaggggtacagtaagtccttatttaacgttgtctataggttattggaaactgcaacttttaagtgaaacgatgtataacaaaaccggtattaccatagattaattgacataaatgagagttaagttcctgcagcatatttttggtcctaaaagtattatcagacttctacataaagaccaaaacatttctaatattaaacactgagagaaatctaggttatacatacatttaagaaagattaattcaatcatttactcaattattcgactccagaatagtgggtggtccgagcctgtcctggcagctcagggtgcaaggtgggaccagccaaggacaggacaccatcccatcacagggcacactcacgctcatccacactcacactgggaccacttagacatgccagttcacctaatgggcacagctttgggaagtggagaatgtgaagaaaatccatgcagatgtggtgagaacatgcaacctccacacagacaatggccttggctggaataaatttttttttctcacaaattttataatgaaacaatgttactgtaggacctgctgtataatatatacatattaataaaatgcttggaatagtgactggcacaaaatagtcctttactgtgagctattttaagtagactaagaaaaaattattactattattggatattctctcaaaagtatcttgggggctaagattttaaattaaatcaaattttgcctagtactaagcccactttggtgttttcttggctttgtttaatttttttctccatggttttatttaaaagttatttctaatcaccctgtcaacttagcagatatctgttggaatcatttaaggtgtttgtttccaaaagactgcagaaattaaatcaagatatttgcagaggaatgactgacagcttgcaggtagactggagaaagtgcttcctaccataacagacagaaaaaatggtagtacaagagtcagcatttcttatttatttttctatgaggcagggtctcgctctgccgctcagactggaatgcagtggtgtgatcatagcgcactgcagcctcaaacttctagactcaagggatctcctgcctcagcttcctgagtagctgggactataggtgcttgccaccatacctagctgattttttgtaggggtgggtagagacagggtctagctctgttgctcaggctggtcttgaactcctggcctcaagcaattctcttgccttgacctcccaaaatgttgggattacagacatgagccaccatgcctggccaattgagcatttctttaaactggaaactagcacctttataataatttcacacataccattattgttgaaaatagtcagattttcagaggaaatctctattaacctaagttgtataaccttttgaggttgtaccagtgtagagcctgtttttccgagcatctacatgctcaatgctattttttcagttatccagcatccccccacttgtttctatcctatctcatatgcaagagggtgtaaatgtttttgtgcattgcttttacatttttatttatctctcaagtgggcaagtaagacagtcatcaacagaggttgcatttggagatcatattctgttttttctttaaactatttgatcatttcagagaaactttattctcagttctgttttgtcttcagctgtcaatatccctgactccaggccctttatttagcttccattcttactgatgtggaaacatacttttaaatgaactgcctttaaaaagaaatattttagtaaagtgaaggatctttttgtaatgcaaataatgttttgttcaggattttcttgagaaatctgccatgttctctaagcctttgcctccatactggatgtggctttgccttttttgttgtgttgaagggcatgcacagatatagtttctgattatttttctcagtctgatttctccaattaggcatattatcattagaaaactcgcccattttcccatggtgtttaaaagtaaaccaggacttgtgacactatgctactcggcatttatgaaatgtaatttaattactttgtttccattgtgaagactcggtttccttatttcctatattcatttatttattcattattggtatacccaacaagataagtaaatacgatacagccttgcatttgacaattttatggtgtgtatgtatttatcatgcctgaactgtgactagacttaagatgaagatggtacctaaatcaagctcttttatattttgtctttcccataatctagtctgtcttttctttcccacaaaatagaatgggatactttttattataaatatatgacatgttcactataaaagagaggcagtaaaggaccagagaaaatgacctgtgatgccaccacctagaagtaatcactcttgttaacatcttgttatttacttgtacagtttttttctgtgttcataggctgacatttttccttgcagatgttctctctctatattcatacaaagctgcagttgttcaagtcccaccccagcctctggaggtccaggatgaatgcctccctctttctgtcctggtaccttacgtgacctccggacggcagtgtcagtgttggaaatggcaggctgctgcaaatatgctaaaacctcatcagttgtctctattcgtctgaccaaagtccgtgggaagagcaagatgctggtgatatcctggagctcttctgacacaaggctctggctagccttgatacattcctcaaattcttccttccaattctgaaaccttttgttttccagacaataaaaccctcccaaactcctacctagacattctctctaagcagtcctgggagaccacatgtgacttgacttttaactatctttacagcgtttacattttgctccttctttttgtcatgccattactagagggaggatgggccatccagagcagcgtgcgccctccacaggcaccttagcctgttcttcactccgccatgattgaaagaggagaaaatattctatagctgttccttttctgttcttggctttttcactcttactgaccttacaagttttatttttccatttctgaatctcaattattttcatttctcctattcagtatagtttttaatagatagcattgcattacatggatgtcccttatttaatcaactgtttggtatttcttttctgtttttcaaaatctaatgaacactccagtgaatatccttttgttcgggatttatctctagaaggaagattactggctaaaaatatatgtacatttaacattcatatacatatctatacacacttttttttgagacagcgtttcactctgtcacccagactgaaatgcagtggcatgatcattgttcactgcagcctctacctcctgggctcaagcaatcctcccacctaaacctcctgagtagctgggactatagacacgtgccatcatgccagctgagtttaaaatctcgttttgtagagacatggtcttactatgttgcccaggctggtttcagactccttgggctcaagtaatcctcccacctcagcctcccaaagtattgggattataggtgtgaaccactgggcctggcctatgtatacataattaggctatactgtctataaaatttggctatctatagtcaaattattttatatgcatatatccaaatatacctataaatagccaaattatacatatacagccaaattttatatatatatatatataaatgttatatatatatagccaaattatataaagctgtatatatagtcacattatcctacaggaaatgatgtaaatgtaccaatttacattcctgtaacagggcattagaattccctttttccagagccttgccaacactggttatttataaccctttcaaactttgtatgaaagttgtatgtattttaagataaatgaaaacttatattgatttgtaattatttattggtataattgaacacctttccatatctttattgtactaatgtgtatgaattccatcttaatagttttgctaacttgtccattgaggggtttcctactgatttgtaatggctctctatataaaaaggatgttaatttttgcctattttacagtaatagtacaaatattctctcatgttttctattagtcttttaacctttgtttagttttttttcgttccttcataaatgctaaattttatgtcatcatatctttcagtccttttctatattatttctggctttgatggcatgcattgaaagcccttttccaccccagagttatcaactcgttggaaaatgatgttgaaatgtcacttttaatatttactaaacactcttgcctaatttgttctattttgaagccctttaattctgtttctttaatctgcctgtcttttttttgtgcctgttccttactgtcttgactactgcaggcaacatacttacatctaaagaacaagcacacctattctgcccttttgctaaacaaattttcagcctctttttcaatgattattttttcaaatcaatgttaaacatcacgtaaagtttcaagaaaacccctaggggtattagtatttagagtgcattaaatttttagctaattcatgggagaatttgaagtattatatcttctaatttaagttagagtacaggaattgtctgtctttatccctctaagtacattcagattctcaagaatagtaccaaaattctcagatccccctctaccagtatttttctcccactgatggctcttcaaccctaaaatgtcttagtggtatggtttggatctctgtccccaccaaatctcatgtccgatcgtggtccccactgctggcagtagggcctggtgggaggtgattagatcatggggaggcttcttatgaatggcttagcaccctccactttgtgctgttcttatgatagtgagttctcatgggatctggttgttaaaaagtgtgtggcacctccccaaaccccttgctcttgcaccggccatgtaaggtgaggatgcttcccctttgtcttttgccataattctaagtttcctgaggcctctccagaagcagaagccaccatacttcctgtacagcctgcagaaccatgagtcaattaaatcttcctttataaattacccagtctcaggtatttcttttcttttattcttttctttctttcttttttttttaagagatggagtcttgctctgtcgtccaggctagagtgcagtggcgccatctcagctcactgcaacctccgcctcccaggttcaagtgattctcccgcctcagcttcccaagtagctgggattacaggcgcccgtcaccacgcctagctaatttttgtatttttttagtagagacggggtttcactatacgttagccaggctggtctcgaattcctgacctcaggtgatccacctgccttggcctcccaaagtgctgggattacaggcgtgagccactgcgcccggccaggtatttctttatagcagtgtgagaatagcctaatacacctagcctgatgttacacttaggatcctcttcattattcttctgaatccaagcctccaactttatctacccatcacggttttagcttatattttgattttatttcttacatcttcccttatatttattattttaatattttgtttctcttttctccttctatacttgtactagatttatcagaatctgtaaatctcttttaaccctattaatttgttaactcagttaaatatatctattttgccaatgctcatcttcctatttttaacagtcatatatcaaactgtatttctcaactgatgtaccaaaattaaaggacacctagatgccctccctcagctaaagtgtttactactgcatccaaacccatgaattctccctaactgagagaggatatttagagggcctttgtgccttttttttttccccctatttcttccttgaaaattctggagctttttgaaataatttagaattttacttttaagatattattaaatttttttctacagcatgcctctgtttaaagaatcaaagctttttaaacatatcactagtcacatatattatctgtgtagacttagctatattatcatatatttatttttataaagatattgctcagcactattcttttacagttttatttatcttaactgacaaatgaaaattgtatatatttatgtatacaacatgatgctttgatatatgtaggcattgtgcactggctaaggtaagctaattaacacatgcctcacctcacagacttatcatttttttgtgagaacacctagtgagaacacctagaagtcacccacccagcaactttcaaatacattgttattaactgtagtcaccatggtgtataacggatcttttaactcattcttcatacctcactgaaattttttgtcctttacccaacatctcctcagtccccttacctcctctagactctggtaaccactgtttgaactctgttcctatgagttcaactttttttattctacatgagtgagatcatgtgatatttatctttctatgcctggttcctttttcacttaacattaatgtcctccaggttgaccatgttgtcataaatgacagatatccttcttttttaaggctgagtagtattctgttgtatacacataccacatttcctttacccatttgtttgtttttgaacacttaggtggatcccatactttgattattgtgactaatgctacaatgaacacgggagtgcaggcaactcttcagcacactgatttcaattcctttgggtatatactcagggattggattgctgtatcatatggtggttctgtttctcattttttgaaggaccttcagaccatttccataatagctgtactaatgtgcatttacatgagcagtgtacaaagattcccttttctctatatcctagccacacattatctttcgtctttttgataacagccattcgaacaggtgtgaagtgatatctcattgtggtcttaatttgcattttcctgattagtgttgttatttttttttcatatacctgttggccattcatatgtcttcttttgagaaatgtctattgaggtcctttgcccattttaaaaattgttatttactttcttgctattaagttgttcgcattccttatacattttgggtattaatccctatcagattatgatttgcaaatatattctcccattctatagattgtctactttgttgtttcctttgctgtgcagaagctttttagtttgatgtaatcccacttatctattttttgcttttgttgcctgtgcttttagaacctgatcaaaaaattattgcccagactagtgtcttggagcttttcccctgtgttttcttctagtaattttacagtttcgaatcttaggtttaagtctttaatccactttgagttagttcttgtatatggtatgagatgagggtccaattcatttttctgtatgtggatatccagttttcccaacaccatttatttaagagacagtcttttccccatgtgtgttcttggtacctttgtaaaaaaatctattgaccattgactatgtggatttatttctgggctttctaccttgttccattggcctaagtgtctgtttttatggcagtaccatgcattttgattactgtagctttgtagtagtttttgaaatcaggtagtgtgatgtctccacctttgttctttttgctcaagattgcttggctctttggggtcttttgtggttccatatgaattttaggattgctttttctatttctgtgaaaatatcattggaattttgataaagactttgaatctgtagattgctttaggtagtatggacattttaccaatgttaattattccagtccatgagtacaggatatctttccatacatgtgtgtcttcaagttcattcatcactgtcatatagttttcagtgtacagatttttcaattcctggttaaatttacccctaagtactttatttatttatttttttgctattgcgaatgggattgttttattaatttctttttcagatagtttgttgtatgtggaaatgctgcatcagcactaattcttacatattttatcttcttgagatcttttctgtttactttttatttgattgagatgctttcttagataccagtattggtatactttcttgagtttgtttctaaattatcttttcctcctcaaatatgtatttctgctgttctggtcttggattgcagttctctttattcagatgtgtgtgaacactgttctattgttatctgtggtcaagcattgcagacgagaagtctgatggtagactaattattttccctttttaacttacttctcttgtctgaatggaaggctgtagaatttttctctttgtctttgaagaaatttctctagaatatgtccagatgtcttttttatttagcctgactagaatgtctgagcctttttatgctaaaaatgcaagtctatcttcaactcagcaaaaacttcaaactgaaaaccgaagttttaaaaccagtgaagctttcttccacttttaaatattattaccacacctacttcttctcgtaattttttactttttttttcctaaaaaatgtagaaagtacagaaaataatgcggaaagttctcatttagcccaagcagagagttaaaaagataatcttttgtcatatttgttttagatctttttttaacagtatggttatattttaaaatgcctagaagactggagttaaagtcattcagttatttcttaatagtacttagagagttgctcatgaattggaggataatgaaatatgagacatgccagagcaggagaaggaaattctaggggctatttggggtcttttgtggttccatatgaattttaggatttaaaaaaaaatttctgtgaagcatgtcattggtattgtgataaagattaattgcatctttagatccctttgggtagtatggacattttgacaatattcttctaatttgtgaatatgggatatcttttcatttcttgtatcttcaattaatttcatccatgttttatagttttcattgtagagttcttttacctctttggttatattcattcttaggtattttttatttgtagctattgaaaaaagattgctttcttgatttctttttcaggtaattcattactggtgtatagaaacacctctgagttttgtatgttgattttgtatcctgcaactttactgaatttgtttattaaactattagatgatagtttaatgataaatgtttaaggtggcagatatactaattaccctaatttgataattacacaatttataaaagtattgaatcatcatgttgtaccccatacatatatatagttagttattatatgtcaattataaataaaaaattatatactacgttggttttcaaaattaaagtaataattaaaattcgcaaatgatgggaaaaaaaccggaagttcttgggggaaataagcatatttcacagtgtcatggaaattgagtcctgaatgtcaatattgtttcataaatacttgtaacatacaatgcaatagggatactacatcaggatgcttttggctccaagttacaaaaaaccccaactcaaattggcttaaagagggaagacatttgctcatctcacacaaaaggctactcagctttgcctcaatccaagccatcatgtaatcacatggtgggtatagaaatttgaggtgtacttacacctgtgtacatacctctagatgtaccagtgtcctcaagaataagaaatgccatttgccttttgtgtttcttatttagaagtgagaaagtcttttccagaatctccctagaaaacttgcctataaggtctcagccacaattcactcatacgctcattcttgtaccaactggtggaaagaaagaatagaattcacgggaattctattgaatctgacacagattgatctgacatagatcaacggttcccaaccaggtggagttttacctccagaagacatttagccaagtctggaaacatctttgtgctcgctggggtcccctactactggtatctagtgggtagaggccacagacactgctaagccttctacagtgcatgggatgcttcccacaatacagaatgatctgattcaaatgttaatagtgtcaaggttgagaagccttaacatagaccagttaggatctcacccttcagggccaaggaaagggctgtttttcactgaagcacagggctaaggaggggctatgtggatgttgtgtagcccactgggaatgcccactgccatgacgtccctcggatggagctggtcttctgagctgctcagaaagggaagctcggatttgtgggttttaggctactaaaaattaaccaaccacattgaatttcatgtttttctaattcattcctagtcttcttgcctgttaaactttctgctaaagataattctaatgaatttgagaaggtatttataaaagaatatctgtgaggctgtgtgttgcttgactggcagccaaaagaaatgttgcttggggaaaatggcacgaattaaacattgattgcccatcagtcttgtacttggggtctggggtagtctggaatacaggtagggagatcattcaagcttcacagagaggttcactagtacttataaatccaagcattgggagttgagaattgccagaaatagtcatgtaatgatattccatgttgtataggtgtttgcatttcttcctttctaaaaacacagtggttttggaaataataatatcctagaacagtggtcctcagctttttttggcactaaggacaagttttgtggaagacaatttttccctggatcttgaggggaggggaggatggtttcaggatgaaactgttcccctcggatcatcaggcattagattctcataaggagtgggcaacctagatcccttgcatgtgcagttcacaatatggtttgcgtttctatgagaatccaatgcccccactgatctgacaggaggtgaggctcaggtggtaatgctcactcacccaccgcccacctcctgctatgcagcccagttcctaacaggccacagactggtagcagtacatgacctggaggtttgggacacctgtcctagaacatcctggattaagcaattaaggatctctgcaaatcctagctccattgctcaactttgaaaagttgttggactgttttcagctttgggtacctcatttgtaaaataaagaaattgaattacaggcacttacaggtcctgcaattccccgtaactcagataaaaaatagatccctttctcccttcaggagaactcatgactttggtagcagctagagttagcatttgctcatgcttttattgtgtttagcaatcaatgggaagtgcatcaggtgaaatctctcaggcctgcatatgtctggtcaaagctcattcattgattttttttttttcctgctgaaacttgcacatatataaaaaacgaagacactaaatttaattttcaccagctcagtgtatagtattgtggctgctcatgttcctgaagagcgagttgttctcaaataataaactaagctgtataatctttaaaatatttgaccaggtgggaagcctttctgtgaggacaatgtgtttgtgcgtttggtgcttaagcttcaatcccctggccacagcttggatttatttgcaggggaaatctgctacgtaagaagacaaccactttgggcaacattatcttcatcatcagcatgcacgtgtggtaatgacctgttatgagcctgacttggaataactttcttcctcacagaatggtggatactccatatgtgtagaattactgagagtaattatctttgcaacagtaaggcgtgagggtaagaaatcaataaagcagaagggaaagatattaacatttatcgaccactttctgcatgacagcagaaggcggtcaataaatggcatactttattttaatcgtattaggtgattattgcagtattatcttaatttatgtgtgaagaaattgtggtccagcgaggttaagtcacttgctcagtgtccctcagtattaagtgataaagcagaggtatcaacctaggataccctacaaggtttggcttccatctggaagcactgagtacctgggcccagatatgagacagggtcccagcccagagatttgttggtttatcattccttcagcaaacacagcttacttccaagagtgtagaaattggggctgtgcttcatagcaagataataagcatcagaagggctgggtgtggtggcttatgcctgtaatcccagcactttgggaggccaaggcggttggatcatttgaggtcaggagttcaagaccagcctggccaacatggcgaaacctcatctctactaaaaatacaaaaattagctgggtgtggtggtgcacacttgtaatcccagctacttaggaggctgaggcaggagaatcgcttgaacccaggaggcggaggctgcagtgagcccagattgccccactgtactccagccagggagacagagtgagacaccatctcaaaaaaaaaaaaaaaaaaaaaaagccatcagaggagctacagtgatgctggtgaggcagacatttcctgactcatagcaggttacctttgtttcctcgttataatgagaaaaagttgccttccctggacttcctcctattcatcttttttttcctgtcctcttcttgcttaggatgccaaggctgtgacatttatttctgctctcttccctttgagatatgctgaagtcatttaaaaaaatgtcaggaataaaatgcactaaatgatgactgtcttagaaaagactccagttaagctgtgtgcatccagaaatgcaactgtgctgaccagtttctgcctcccttgccctactgataacatgatgggagatgaagtcgtttttcaaaagtgttctgggtccagagacgtttgctcgacacctgtgccctccattggtctaaaggcattagagtttttctcccacaatatttgtctttgttattttgaatttatgacaccctggttgttggtgtttttctttgcattcatacctgactcttgacctccaaaagaaccagtacatacattttactttaagctgggcatttttgtaatactatgcaaccttgaaaataatcgcagtgatattttgcttttttataaggccttctatccttctttgctcttgcatctctctttcccctttatgacagtatagcagaacatatttcattcttccctgagccctctgcagagcaattttgtaactgatttgagccatgtttttgatggagtatctgctctctggacctttccatctcctggttgcaactgtgaaccaccctgcctccaataatctacatccaaaatgctgagcaggagatttatggaatttgtttgaagatattccctgaactctctgaagctaactagttcctttgcaagtaagtggctggaaacctaaagatcttgtgaactgggttctagaagcatgggataacaaatgtaagatttcagactggaagttaaaagcgagttttcctcttgattcagtttctaaccagtcagctaaatggtctctgaatagttgtagctaatgagcaccatcccccaaacagtcaattgtcttgactattaaatacttaaatccatgtattttcgctggagtgtttattactatgtgttcttaggaccataattataaaatgttaagttaggacgacacagaatatttttctctgagtatttttgcctctttcatcagataagatgaaattcatttttattttattttacattattatgattattattttgagatggagtctcactctgttgctcaagctggagtgcagtgccacgatcttagctcactgcaacttctgcctcctgggttcaagtgattctcttgcctcagcctcccaagtagctaggattacaggtgcatgctaccatgcccggctaatttttgtatttttagtagagacagggttttgccatattggccaggctggttttgaactccttacctcaagtgatctgcccgccttggcctcccaaagtgctggaattacaggtatgagccaccgcacctggccgaaatgcatatatatatatacttttttaatggaatgcaatggaatattgtgaagtagtaaaacatgaataaactatagatacatacaacatgggtcagtcttactaatgactgtgagtgaaaaaggaagctccagagaaatacgcgtattatagcttggttataaaatttggaaacttgcaaacttcaacaatatactttttttttttttaaggaagaaaacagacaaaattcagaatagtggttatagttggggtgaggtgagcccatgagtaaatactggtaatgttgtaatttttggactaaatcatggattcgcaattcttcattatattattaaaactaagttttaaaagacccacaaatgggccagtgatgatagtttttccagaattgatagccatcaattctgatcatccaggatccttggaaataaattgcatggatgagctcattcatcacaaatctggggtctttaaagtttctgctgttcccagttctttggattcatagctatgatccttagagggcaacagatctctcccttctcatggcagaaataaaggtcagatgagaatgggagagccatcagatagagaccactgtggaggagtttgcgctttgggctgagcaaagagaagaccagaatcttttggtaccatctccttctgcatttgagatgaaacttagtcttttaaaatacatgcagccccagtcctctgtgttgccagtcacctgagctacctttgggggtagggttttgattaaatggcacgctttgctcatgagtaaccttcggggcacattttgttggtaagaaataaatgcatcactcatttgaatcagagctgcaagtgccatctgtgatgcactcctccttcccattatcacacaaatgtgtttctgtgtgactggttcctggattttgcaggctctcttgccttgcgccgattgctggctgagaggtctcagctcagcgttcaccacgtatcactatatttctattaatacttctgctcttcttggcaaaacagaagtggggcttcatttgaaatgatgggctggggagaggggaagggaaccatctcactcatagttattgacatcaagctaccatcatctcttgttcggataactatgagatttttctgctccctttatgcccccgccccaccccttcccagccactttctgtcctctgccagagtgatcttgtgaaggcttcaatcagaccagatcattctcctgcttaaaaatccccccgtcgtttcccgttgctcttagaacaacatccacactttttatcctgcagtagggggctctccatgctctagcccctgcctatgttcccctcctcatcatgcctttctgccctttgttcactatattctagtcaccctggccttctttctgctcctcagtcactccaagctcattccctctgcaagaccttggcatatgccatttcccctgtcaagaacgttcctgctctaggtcttcgcaaagcttacatgttctcattgttcaccgaacagtcttccctggccacccaatctaaagtagtccagccccacctcgaaggacactgtctcattgcaccttttattatcatcactgcatttaccattctctgaaattattctattcacttgtgtgtttatggctgtcctgattagaattaattttcataaagagaacaagaatcttgactggttcacccttcaattccttgtgcccacaacagtgactggcacatggaaagcattcagggaataaaagcacaatggaaaattaaaacatactcactgcatgcctgccacctatagaaccaaattaaatcactgccaatatgcatggggaaaaccttcccatttttctggaataatgttacaaaggatggaaaataagtgcacatcacctggatggcatttaataaacgctgtgacccagtagtgtacatttcagtgaatattgccaaaggaagtaggccaacatcaggtaatctgagttaactttcctgtacattgtgtattcgtttcctgatgatcaaaactggattaattagtctacaatgtatctttcctgttagatacgaagattatctgctctatccaatttgtgttttcttagctgagaaatcactgttgaattttaaaagcagcttgcctggtcctcatttcctggtcttctgatggaaatggtttatggaaaaaaaaatatttactagagtcagataattagaacattttatgtattttgcatatgctaatgcgtttgagttcctttgagggagagccgcatggcataaagcagaatgaaaaggatgattcaaatttcttcacccagcctcctcccctggccagatttagcacttcctatataccaccacctcacagcttagcttggctgggagctcctcaggtttccaaaggacggtccttccttctccctcccccaattgccatccctacaccagggtgccaactcccaagtgggctgacaggaagggagattggaaacagctttatagtagatttgatgctgttataagacacgttgtaagacatcaggtaaatatagcacatcagattttattaatcataagaattctttaaaagccttcagcagagccgagatcatgccactgcactccagcccgggtgacagagcaagactccatctcaaaaaaaaaaaaaaaaataaagccttcaacagtggctaaacacaaaaccagaatccctttagatttcttaaaatgcctttgtagttcttttgtaatatgggtccttgttggacaaagttagtaatttgttttttatatcctttacattaggggtttctaacccccaggccatggaccagtaccggtccctggcctgttagaagccgagtggcacagccggaggtgagcagcagttgagcgagcgttactgcctgagctccgtccacctcctgtcagatcagcagcagcattggagtctcacaggagcgtgaaccctattgtgaactgcacatgcgagggatctaggttacctgctccttatgagaatctaatgcctggtggtctgtccctgtctcccatcacccccagaaataaagtttctatgattacaataaatgtaacacacttgaattattcatcccaaaatggtctctcccgactccccactatccatggacaaatcgtattccataaaaccagtccctggtgccaaaaaggttggagactgcttcttttaatgatcatgttcacatacggacagtgaaaaggtgggtcttcttagaggttaaagggaaagtaggacagttgccacaaagctccctttttggagagtgcccagccagggagtgttactagggcccaccttggccttgctgatgtcttcagtggtgtccttgaagtcagcatgggattggcgcaggctcctgttggggcactcggtgaaggtcctccctcctccccagtagctctcatttccagggcccttattttcttttggccatctgggactgaagtcttgctcctggtgggctatctctgttgccctatcacctttagtgatttccactaaataaccctcttttaagcatttaggggaagagggagtagcatgaacgtttattgtgcagtggggtgagaaagtcagtaccagtttcaacacgccctccagctgccttcctccagggaggggacttcacactggctgtctccacagatctgcagtgcccttgccatagctccaactcctggccttctcccactccccgctgcctgctggcacatagagcccttgggccattctctgtgtggtattggcccctgcctttgcttatgctctctgctgtaagcagctaggcttagacttccctaagaggagtcccggacaccactgaggatgcattttcccttcctcacgtgaagagagcattaggtgcccttagctttggagggagtggagctttggagcctggagacaggggaccaggaccagattacccagcctccctagattctgctgaactcatctttcagtaaagaggccagatgagctgagctccacttctctctggctccatgttcctgtgacttttgactcatctgaggttgactttgagaaggcaatcccttttaaatatattggaatccatgtagtatgaccctatccactgtggaatcttactccattttactttaaagagaatgtaaatggtttggctgcacatcactatgaaaatggcctaagtaagcagaacggagaagctgccaggagagcagaggtggagagtggaaggggccaagccggttctaaatcgttttctgcaggctcctgtcctcagatgtactcacttcatgggaaccaaatcacatttaactgctctccagctcttaaaacaggataacttgagccatctgatatttgagaagaatacagcaacccagaagatgtattaatactctattctctaattttccagaataagtcagatcattgacaaatgacatacttgggctgtattaccttcctacagaaagactttcactaggtttagtaattagctatagcttcagccttttgttttgttttgttttgttttgttttgttttgtttttgagacagtctctctctctctgctgcccaggctggagtgtgaaggtgccatctcggctcactgtaacctccgcctcctgaattcaatcaattctcctgcctcagcctcccaggtagctgggattacaggtgcacgccaccacacccagctaagttttgtatttttagtaggtatggggtttcaccatgttggccagtctggtctcaactcctgacctcaagtgatccacccacttcggcctcccaaagtgagcttatgtctttttgaaggatggctatgggaaaagtccacttgaaggatgttttgtcatttatttacttactgattaattaagatgggaaagtcttgctatgttgcccaggctggtctctcgctctgtcatccaggctggagtgcaatggcacaatctcagctcactgcaacctccgcctcccgggttcaagtgatgctcatgcctcagcctcccaagtagctggaattacaggcacctgccaccacgcccagctaatttttgtatttttagtagaaatggggtttcaccaggttggccaggctggtctcgaactcctgacctcaggtgatccacctgcctcagccccccaaattgctgggattacaggcgtgaaccattgcgcctggcctcagctccctttagtttttaaagatagacttcctatcttataacagttttagatttacagagcagttgcaaagatagttcaaggagttcctgtattctctgcatccagtttcccctattattagcaccttaaaatagaatagtacattggttacaatgaacaaaccaatgttgataaagtatgtcaactgaagtccatacgtttttcatttttcctagtttttacctagtttcctttttctattccaagatcccataccatattacttatagttgttgggtctctggatcctccacagcaatttcttagacttgccttgtttccattatgaaacacttcagacataccaaaagtgtgtgtgtgtgtgtgtgtgtgtgtgtataaagaataccaatataaccagcattcagccctggaagcagaacatgaccaacatgattgaagcctcatgtatatccctcttgatctctttctccttccctcttcaaggacgaccaatatcttaaatttggtgcttttgtcccaggcatgttttgaaacgactatatgtagtgttgctttgcatattttattttatcgagacaggatctcactctgtcacccaggctggaatgcagtggtgtgatcatggctcactgcagcctctacctccccgggctcaagtgatcctcctacctcagcctcttgagtagctgggactaaaggtgcatgccaccacgcccacctaattttgaaaaaaattttctacatatgaggtttcacatgtcgaccagggtggtcttgaactcctgggttcaagtggtcctccctccttggcctcctaaagtgctggcactacagcagtgagccactgcccccagcctgctttgcacattttaaaacaatataagtattataagcattgctctacagtttgcttttttccccccacataacatgttttaatctgcattgctctaatgtatctagtttctaagtcagactctgttgtatgaatcccctctcttgttgatggatatctaggtgttttcctttctgttgctgtcatggtcattgcaaacagtgctgaacagacacctttacaagtcaccttatgcacgtgagcaagcattctacttggggagaggaattttggggtttcaaattttatccttaacaaagcagtttattcattcattcagtaaatattgattgactatgtaaaaactgagccaggttctagaggtaaacagaacagaaataatccttcatttatcatgagtttacaatctaattgggaaaatgaacattaaagaagtaattaaagatatgtatgtactatacagctgtatcataaaaataaagaacaatgtattgtgtgccatgaaaaaaatataaggcttattaagggatgtttcttaatgtttcttgtatcataaattacctaaagaatttctggacaggaaaatgctactctcctactgaatttatgtgctttctttatcgaacaatggaagcaatgtaaagcaaagtgtttcttttttgccttagctactaggagtagctctcatgtagatgctgtgcccagctgcagtgcctggaacagcccagctacatttagtatgtttatattttggctttttaaataaatggttttcatattgttctatgtcttgttttgcatgctgaatcattttgaatgtaaatgaggtatagctcttggagagaggacaagatatcattgataagtggttggtgacccccacttttcttttcagagacaaatgaccttgcttttacttggtcttgctgtatttatatagggatcttactgtatttgcatgcttgcttaatttcaatataaatttatgaaatttattatccatcaagagtcaatttgtcctctaaatatttcacttagatgatgattttttttaatcaccaccaacacatacacaaacagaactccttagcaattccatttggctgtactgctatctttaggaacatttatcttgctttaactcctctcttttttacagacatttagttttctgtgacattgtttactttcgttataccttaattatgggattctgataaccatggaggagtaggagagacaataaatggggttttgtgggtgattaaatgctaaagcaaagctgagatctttgataagcacaacagttgtttctgccagtatattccaaaggcaagactattcttgcaattacacaacaagcaaggggggagaaacacctcccacaaatcactctgatatgtttcttaaccactgtgcttttgaaagcctaatgctctttcttctgatgtttttttgactgtcagcctgagtagttggctcttccttggtacgaggctatttaaatgacaggtcctttctcagtgtgaatgtgtcagctatctaaatgagtggttgaaaatgtacctccgcatcagccatgtggaccacggcatggtctgaagaaaattatgtttgagcagctatgattgagctcaattttgcaaaagcttactgagttttaacaaataatttagccctatcaagcagaagtgcatttggctgcaggtaatagaaaactgaatcattggtggttttagcaagtaggttttctttttctcacatgacacagattggcaatactgtcagagacccagtttcttttgtgctttctgctctattttttgtagtctttcagcctttatcgttgggcttattgtctcagggttgcaaaatgactggtctgactgcagattttctaggagggaagtgcaaagtggtggtgctggccacagctttccttctttgtcaggacagcaaaagtttcatcggaactccccagtggacttgctctcttaattcaaaatggctgtaacagtgtcacgttggctgcacctgtttcaaagaaagttcagaaaattgggtatttcacagacacattaagatttcaaacaaagacgagagcattcacaaggaacagagagggaacgtatgtggatggggcaagtaactgccagtcatcagcctgttatgtactgtacacatagagttttgctgtgcagcagcaaatataaaaatgaatgtcatcaccatgaaagtggaaaaccgtatttcaatgtcatgcaaatgccataattgaaatgaaaagataggaaatgctggtgcattgtctacattaatgtatttggttgttgactttattgcataaaaagtatcagtggggacgagatagttttgctttgtttcagaagattttgcttttgtttttcccagctaagaagggaaccttaaaaataatgaggagggccgggtgcagtggctcacgcctgtaatcccagcacttttggaggccgaggcaggtggatcacttgagattaggagttcaagaccagcctggccaacatggtgaaaccccatctctactaaaaaatacaaaaaaaattagctgagtgcggtggcacgcacctgtaatcctagctacttgggaggctgagggagggagaattgcttgaacctgggaggtggaggttgcagtgagctgagattgcaccactgcactctgcactccagcctgggttacagagtgagactctgtcttaaaaaaaaaaaaagaaaagaaaaacacacagatgtatgaaatagagcttattaattctgtatatattcacagaaaacgcatacttttatgccttgattatctttaggtgatcatggggaacaggagcccaaagataattaacaactgtgctaaaacaacaaaacctcaattgggctacaaatgtcaatatcatgtacacaggtggaaaagactcttctttgatttcatatttttcttttatttccttggcatccctgttctggttatgtcttgctgtgtactctagacataggttttgtgggttgactgagctcagccgggtggttctcactggggtctcttatgccctggctcttaaatggcagctggggctcctacacatggcatctccatatggcttaggcttgtcacagtctggtggctgggttctgaggctgaagtttccaagagaccaggggggctgctgcaaagcttttaacctgagcttgcaagtcatgaagcatccactttccgttggttgtgctggacagcccagatgaaggggcaagttcccaaggacgtggatacctagaggcatggttcattagggaccaactttggagacaaacaaccacagtctccttccttctcttcccttggggattgaaagggttatcaaaagctggccagaaagagaagcaaagggtgaggataccgctgctgcagcacgtctgtagtagggaatgaacccagaatgtgaagagttgccattctagtaccctcgagtgtccttttcatgccattggaaacttgacaatagtaattgggagtgagttgaaatcttcagctttctacctttgtattgtcctttcagagcaaaaagaagtaaacattaacttaaaaaatgcttttgatattaatagttacaaacaaaaaacaaaacatgcaacaattccaagctcaaatcaaaaccaacactgagctttgaggtgcaatttctattctatgtgtgtggccatctcctcttgtgttagtggctgagcagagaatgctccattccaaaataaatagaattaattttcttaacagcatctttctttgtgccaagaacacagggttacaggaagcacatctgaatgtaccattggcaggttaaatcattctctttactttggtctttggtgggtttttatgtttgttgcttttcatctgaatgaatggcaatagagcaagttttaaaaatccttagggatctccagagattcctgtcttgctaagaaacaggaaggccgcaattagcagagaccaagaatgaagaggaggagaagggggcgggtgtctttgttgctgtaaactactagttttcaccattctgcaccttgggctgtgttgctgctgctacctggaacacccttcctccccctcctctgccgggaagactcccacttagcccagatgcagcccagctgctggcttctgcatgcagcccacctcttcttgctggacagggtggcgtcttgtcccccacacccacaattcctgtgcctatcactttgtctctgtattccttcctcagattgtagctccttagtggcagggaccagctcttagcctgatatcatcagccaagcaacgtgtaggatgcagaggtttggcaaaactttgaaagcgggaatgtatagtcaactatgtcgatgtctgggtcatttttccaatgtctggtagcaattgtgttaggtggcttatacctctcctggacccacacatagcaaattctaaaaataacaaactggaccatataagcttttccaaaagcctggggtgggggagatgttataatatcctgacatagctgtgctgttgttcatttcacctctgtcacctagagcaaccccctccatgttttccaaaaccgcccccatcctcggggtctggtttgggacccctgtcctcctggaggtcctctttgaaccctctggacccttctctcagagccctctggtaccttgatgtcacagcatttcctgtaatttcatttccctggcctcttggctaagataataggctcctgtccttgctttttctctgtcccctgaaaggggtgaagtcgtgtggacatgtggcaggtgccactattgtttatctgctgaacactagcactccccgtgccttcatgccatcaggcagggggcatttgttcttttgacggtgtggacaggggcagagtttagtggcattgttcttttttagcttaatgagcacgaactgtcagagcttggaccaaatttttcttgcagatatattttgattgacaggcacaggatttttggagataattgaaagagttgccaacatttatcaggagactgtacataaaaatacagagttccagtttccctcaaaaatttggaagttttggcaaaattgagtcccaattaccaaaaattgcttctaaccaagcagtaactattcccttcacacagaatgagcctcccttccctcatttcctgtaaaatggtactgcatgttctcctctttcatttgtgtcacctgcctcattggtgggtaagttgttctagaaaatgtctatcatatgtgctgctgtactgctaagtgcgtagagccctagtacccacagggcacacacaaacaaacctggtatacaaagaacttctgtgcggatttctttcttattgtgcacattttaaggggcatcagtctctgtccatgcatccttagaattgtatggctttttcatgatttgatttattcaacaaggatcgaacagtctgtttgtattgagtatttactatatattagttactgttctaagtataaactcattgatctcacaactctgagatgggtgcttttactatctccatcttacagatgagcagcagtttttttgttgttttttgaaatggagtctctctgtcacccaggctggagtgcagtggtgcgatctcggctccctgcaagctctgcctcctgggttcatgccattctcctgcctcagcctcccgagtagctgggactacaggtaccagcctccatgcccggctaattttttatatttttagtagagacggggtttcaccgtgttagccaggatggtctcgacctcctgacctggtgatctgcctgcctcggcctcccaaagtactgagatgacaggcatgagccaccgcaccctgcctagaagcagctttaataccaggtcacacagccaggaagtagactagctaatgtttcaccttaggcacaggtggagggagtcacacatctgtaagatttgttcccaggacaatatcattttctttaaatgtctgttttgggaggacttcaatgagctctcagatagaaacacccatttccagggagcattcttaccctagaaaaagcttgggacagttgtattcagacagctctgctgttgaccatgtaaggaactctctgccactcttcctcatagctttggcggggattatttgtctttagacttgttcctttttgtgaaagtgacagtagtgatagtcattagtagttagtagtcatggttacttttgttgagcacttacagtgccaaatgtagtaagcactttcaaactgtattactctccccgtttctacttgggaaactgagtattactgtgtgagtgatggggacttcttgaaagatcctaaacatgggaatgtcgtaatcaggttgctgtttcatggatttggttccgaaagccaagcagagagcgggtcaccagcacagtagtaagagtcaggaaaattggttgagactgttgtgtacaggggagagttgcttggggcttgaactaaagggacggtgaagagaggggtaggtttgagagagacttagaagatagtaatggcaaggcctggtaaaagacgggagtgatttccagttttacagtttggacggcagcatggataagaaagaatataaggggctgggtgtggtggctcaggcctgtaatcccagcacattgggaggcttaggtggccagatcacttgaggttaggagttcaagaccagcctggccaacatggtgaaacctcctctctcctaaattagctaggcgtggtggtgcacacctgtaatcccagctactcgggaggctgaggcaggagaatcgcttgaacctgggaggcagaggttacagtgagccaagattgcacgactgcactccagcctgggcaatagagcaagactctcaaaaacaaaaccaaaaaaaggtagaaagaaagactgtaagaaggctaagaaggcatcgtgcggacaggggagtgaagtgtcacaaactgtcagtttgatgtactctgtgactttcagttgaagatgtcacaagattacgacaaggagctcccagtgtcttcacgtagttttcccagcttactcagtaaatatttgttccctaaatgaattcatgatttccatagttactcagtaaatatttgttttctaaatgaatctatctgtaagcaactcaagtaatatcccctcctaccatttatcttaatgtttgaatttcatctccaaccacttaaatcatagtctctgggagatgggagctaggcattgacatttaaaaatgtatgttcggccaggcacagtgactcatgcctgtaatcccaatactttgggatgccaaggcaggtggattgtttgagttcaggagttcaagaccagcctgggcaacatgacaaaaccctgtctctaccaaaaatacaaacattagctgggcttagtggcatgcatctgtaatcccagctacttgggaggctgaggtgggaggatcacctgagcctgggaggatcatctgagcccaggaggttgaggctgcagtgagccgtgattatgctactgcactctaacttgggcagcagagtgagaccctgtctcaaaaacaaacaaacaaaaacctttgtgtccacagatattctaatttgtggccaggtctgacagccactgcttcagttttaatgaaacaacagatgaaacaggtctactgagatgttcttttactcatccatcaatttcatttttgagtgtctaccactgttttgagctccatgaaactcaaaagtaagcattgatgtgttcacctctgtgttcctagtaccagaactgtgcctggcacagaataggtgctcaatagatagttgtagaataaatgaatgttttatgattctgagcacttagagaatactgcgctctagtaacatacaaccatcagtgtctgtagctgtggcaggaggctttctgcttctgaggtctctctgtctggactgttgtgctattatcctctcatgtttcttcaaggcagaggggttgctgcctgggaaaggtgtacactttggagagtgaagtcagactttgctaagtgaacgcttggatacgtgttgtgcatctctgttcccaagtaccttctctgctatggactgaattgtgtatctccaaaacttgcatgttgaatctctacccccagtgtgatgttatttggaaatggggcctttggaagataatcaggcttagatgggtccacaaggctaaggccctcataggggaattactgcttttaaaagactaggacattctctgatcctttggaagtatatttcctttccatcctcttctctattacctgccttccacctgcatcattggagttggcttcttggtgttgacaaaccttacaatactcaggttgaagacaagagcagccgagaaggagcttttgtagggagtggttgtcagtgtctggtgctttaatatttccttccgttgggatttggaaaaggcagtcccacatagaaaattgttccagccgaggaacagcaagtctgtctgtcaatctctgggtatattgaagacatctctctgagtatattccaaatgtactcatcagtgacgtactgcttctccagaaggtccccttaggaagttgaaaaagattctaattcctaacacagtagctcctgctattttcctatgtatgtttttttctcgcttttatcttctgctttaccaaaatacatttacataaacaatattagtatgtgtacagaaaatatgaataaagaaataaagattaaaaaccttagaagaaatgaaaataaaaacttaagaattggaaaagaattctaaaatctcaaggttgaccaagctggagggtttttttgtgcatatttattgcagttctaccttgtgccaggttttagatactttcttttaatcacagaactttacaagatacgtattatctctattttatggattagaacatttaggctctgaaactcaagggcatgtagctgctacatggtagagtcaagattttaatttagcatgcctaactgtaaagcacctttccttggtctaaaggccagtgacagttcctaatgaaagttttcacacgtacacaatgaaacaagaaaatgaagacagtgtagaagatttttgataaagcaaaatacaattaactttaagaaacctgttcattattttaaaatacctatattggctaaagtttggcaatctaacgtcagacccctaatcattatatatatatttttttcttaaaagtctactcgttcgtgaaatcacaagttcacactcagggttcgtgatttaatggtggaacaaaacagaatatttaaagttgggaatgttccagaaaagctagatttacaagattgtcttaaggccccaaagaggaaacaaagatttggcttgctgatcagagttaaacattgtgtacaaaataccttaggaggaatttgagacctccgttatttcagacttaggaaatagccctttcttatctctcatataatggtacctgtctctcaggaagctaggcctcccttgcagtggtaatagctggcctgtggagccccttcacattgcattacggcaattccagtgcctccctttcccgttaggaatctaagcttgtactaccttttaaaatatcttcaagagtcaatatgtggatatctgagtgtcaaatctggcatgcactgtatttaagtatcacttaggaagaaaagcaaaaccctcagccccttgaaatgatttttaaattaactttttggtggaaaagtcccattttatctgtgcaacttaataccctttgtgcaattttagccaacttcttgaaaacacaggaggaaaacaacaactttcattatctcttttgctctgaatagcagcaatcatcaaaccaacatccaccaccttcttgttctcctgaacttacgtatttttgtatatgcaacaacttagggaaaaacataatggcaggaaagaaaaccttttcccctaagtaagaaaaatcacagaaaatcattagtgtgctaattaaggaacaaaaatcaaattgtgaaaggtttcttacccagattgaaatgaataggcctgggcttgttcccacagtggagacagggctcccggaagtatgctggaagcatgcaaggccacttgccgcctagactcagaaatgacacatcgtcacttccaccatgttccattgattaaagaaagccattcaggccagcccagattcaaagggtggaggaaacagaggttgcctataaaagaaggattttgaccatttttacaatttaccaaaggagtgacttggtcgaggatattaactaatttaaaggagttaatgtaggtgaagctcttagaatgcctagtgcatgacaattgttgttttgctattttttattattattactgtattctctctaggcgtttcccccaggagcttattgaacgtcctttaatcttttgttttgtttttaaaaatgatgttggaggaacaacggtgacttttcaggccctggaaatgctacatatgggatggtatcgtagaggtgtttctttgcctcccatgggcgcccccggttttgctctctccccctctaggtggcgctgtcggggatccccagctgtcccacgttgtcttgcttttcctttcctctctgtcaaaacgaattctcattcttgattcttaccactgcagtgtttaccaactttgagtgatatatttcccttttaaagaaaagcagtcttgtgaatttagttgttgttttatatttttattatgttacttaaatatgtacaaacataaagctatgtataaactaattatgcttgctcataacttttatgcatttataaaataaaggaaatgaaacttgaacagaacagatttaaaaattaaaacttcagaatttcaaaatagcagcattaacctaacatgacagatgatattatttttactaaaactacatccagacgcaaagccaccgtggcctttgatgcctcagttaccccacaccttctctgtttggactcctgcaagctcttcgaatacagtgtgctgtgaaattattatcaagttgattataaacacaaatatgagaactgaagttacctgacagtgcttggttataagatggctgtttaacttagtgctctcaaattttactgtgcaggtaactcaccagggatcttgttaaattgctcactttggtacagaggggcaggggtagggtacagaattctgtgttttaaataagctctcaggttatgcctgttggctgatctgggaatgacactttgagtacaaggatctgactatggttccatcatttgtttagattattaaacacacaaatatttaagaatcagtcgaaaacatgtttctggataggtccttggtctctagtctagtcactgcactaaaacatacaagcagttaggttgttagagcattatactagccctatgggaatcagatccagacaccaagcatgaagttgcatgtattgagtatcaggcatcagccagtaatatagggagggaatgatgattgtacaaagacctccctggacattccagatgcaactcacagatgatgactccttgaccagtgggacaggcctgatgtggttttgcctctaataaatcaaatctttccatttttacccaagtaaaattttatttgtactttccttatgatcaccactcacattttgcctggtcttacagtttaaaatgtggtacagctttctttttctatgttaatattctgagggcaaggatcatgttctattcctttttgtacttttcatacagcaggcatacagacatttgtggaattgaatgtattagctagataaatcttgagggtgccctctgctatttgcataaccaagtttttttctgaaaattccaggaattttgctctttctgttatatttcagactcgttattttatttactactgctgcttttttttcttcctaggaaagattcctaagatttaaatgactaaagcttagtctctgatatttgaacataaaccacatttttattgctcttggctctcaggtgcgctttgcttttaatttttatctgagaataaatgttgagaagattagaaacgcttatttagttgataatctgtgtgaccagaatttatcctttctaaatagttccatagcagtcttcgagagagaagttctggtagaagaggaggtagagtgagttgttctttaaaaaggaaatgcaagtttgtagagagatacccaggtgtgggctttatgcatgaaatatttttcctatgagaaaaaggaaaacagtgcctgaccttatcaataaaccattgtaagacgtcttcagcgtaggtcccaaggacattccaactgttcttttggactgagaaactctcaggtagtggttgggagaaaaagatccagaggtcgcagtgggatatttaacaaacatatgaatcagctgtatagcacatcagagaacagagagaccagacataaatgcataataaggcaatattctcatgatattgataagaactttttttctaagttctgttgatctgtctttctacccattcaatcattaatttaacattgtattgagaaattaaacacagactcaaactacacaaaataagcatagtttaatgcaaagattcccaaaatatggtctccagatcagcattgccttggaagttgtgaaaaaagcaaatgtttgcactccagtggagatttactaaatcagaaactatggaggtggggtgtttattttaacaggctcttccgaagcttcccatgcatgcttgagtttgagaaccagtggcttagcatgaactagtatgaggtggacactttgaaaccagcacctagctaaagaaatagacctgccagtcacttcagaagcccctccatgtgtcccttcccagccataattcctttctccttccaaattacccactctcttgagttttccagtaattactcccttgcctttttatagttgtgtcactgaattgcatatccctagccgcaatcatttagtcttttccatggatattaacttatctttcagtctatgcattcccccattgtcccctccttttccatacagtgtatctgatgaagaacttggactgttagacctgttggaggttctcagagtggattttgctggttgtgtactcatggtgcagtgtaacatgttcctctgaacttcctgagtatcagcagctggatataggggtttcatcaaatcttagtcctgtccttttgctaagactataggtgggactgcgttttttgtttttttcttttctttttttcatcaggaggcgcaggaagtctagttctcactgtattttgatgttaacagccatagatactcaatacttagatcgattgagagaagcataatggtgacagtctgtcatttcattttcatttattagctggaaagtcttagatggaataaatttagatcactatatggctaccttgtggtagatttcacacttgaaaagccggttgaatgctcagttttccttttatttacctaattttcaagatactgaattgcttccctgtcatgttcagaaggggaccaattaaagaaaaaaacaaaaaaaaaacatgaactactaggtttaaacgtagtggaagagtaatcaaaccgtagcaaatcatccctattgaagctcaaattgtcccatttttggccagtgggagcctcttcaacttggctcttgattccttttggtataactctagcactatttgattccttccttttttattacaggctcatcttgtgtatttcctgccccagaccaagagtcagccatttctctgagaatgcaccctgctcccccagttctttttgataggaaaaaaatgtcaaaaccacaaaccagattctcataactactgacttgattcttttttactgagtcttttcaatgggcaaaactgggaaatatccacttctatatctatatagctttttctatacctatacatagatgttatatgtatttaaatatatttaaagttaaaatacctcatgagtttatactgatatttccaattcaggactacagggttttaacgtcttctgtatggcatctatatcttctttttcctgcccaaacaatcttgattctcaaggacatagagtatgctagattagaatatgtcataattactcatttgcatgcttccacattacacacacaatattaatactaccaccaccaattatgattactaaaaagaattaaaacatttttgtgcatatgctattctcattttcctctattattttatagttatacctaatctgtttttatcaggtaatagttattaatgctatactctcttccatttaacccccatttaatgttcttagtttcatatatttgatggtcatcaccattttcacgtcaatgacatgacacttggttgtccaaagctcattctgtagtagtcgccttaggaagaagttatgggaacagaataccttgtgttcttacatgttgaaagaatgttttctctacttaatgttcatttttgcttggatataaaatccttggcttatattttctttcattgagtaccctagatacattagatcatatccttctggcataaaaccctgtcaaattctagtgataatccagtttttattttttcttacaagtcacattctctttttgcaagaagcccatagagattttttttctttaaagtcttgtcattttactagcatatgtcttgatgctgatagttatgggttgttattctcacataagtagtttctttttttgtatcttaggacagtttttcttgatttatagtttttaaaatttgttatgttttcttgttttactgtttctgccttctttagagactcctgttgtccttatgttgcatcttacttgtctgtcttcaaaatttatcaattcttgaaggcttcttatctttcttaagttcttttgatttttttaaaaaaatttaatttcccccttctacttttgaagttatttggttttattattcactcttaagtttcttctagttaagcctttttaagaacatttctaattcttttctaagctctgtcaccttatttctgaactttttctagttccaatttatattgttccttcatgtctagcgtgttttcttagtgtcttttggcaaatctggaaattgtatgttagaattgtgatctgattttggagccagttttcttggtgtgctttcattatctgtggaaatgttgttttattcgttttcctcttttatccttaagcaataatgtgtggaattttctctccatgcttttctgttgctcattttcctcacgttttagaaagagactttgttcagatggatttttctaacttcatagagctctgtcttctattgtttttatgtaattttttttaaaaaacttgctttgtaaatttttatgttgttttttccttttccactgttacctgaatcttctctttttttttctttctgttttgctcaattttatttttttcccagcagcttctctccagtgtggtaccttgttttgagagcaggtgctggctaattgtgtaacaatttgtgatttatccttacctatttgtatcttgatgtttgtgaggataccttgtctcccagttttgttgtaaatgtccattaatttttgaacattctgtttgatttcattgctctgtctttcgacatgtagggattctaggagttccaaaaactgtgtcactgctaccactgccatctcctcaggaattcctcagtttttcaaatgatgatttttgaaattttagagtctataacttgagagatatagcatttttggagctgggacaaaaaagtttttaacttaattatgggaagtaatgaaaagaattggcttctaaaatgcaatgcagagatgcataaatgtattctctttatcttgcccaattacagagcaaaatagatgacaatacagaaataaacatggtctggagtagaagtaggttaatccgcatgctttagattgacttacagtatatacactttatttcttcattcagtgaataaatttatatagtgccttacaatggacagatactgtacaacataaaaaatatgttgacccttgcctgtctggcctaccttgaaatgctgtgtataacaaaattacacacagaagacctcagatgtggcaaagtgaagtgagagggaagtgactttcccaataccacacagtactttgagaattagaccacaagcctggatatctgtaactcccaatccaagacttcttccaccccaatattcaatctcattactaagtgtcaagaaagtggatttgttaccaccaaaaaaagaaaactttctgacattgagtgtgtgctgttttttgaagaatgttgtgaattctctgttcttaaaaagtcagtagtgcagctttcaatgtagagttcttttgttcaggcttacacaactatcaccattcaccagataacttgctgtattccagacatcattggctgctttgtatacatattcttatttaaccctcaccacctggcaaagcattgtcctcatctctagtttacagaggaagagacttattttaactcagagtatgttgtccaaaattaccctgctaatagactggtgattctgtggaaacagacactttcttcttttatatgtaaagtgttctgggtaacaaataatacactctcttctcatcactgtgggcaccatggtctgggtgcctcattggcctctctatcccctcccaacacatacacagaagagaggagaggagagaagcatcctaaatgcttgactctctcggcagaaagtctactgtgtctaatggtcttgtaggagggaggcagcgacatctctctccctgccttcttcctttccattcccctctctactaaattagctccctgagcatcagagtgtaaatccagtttctcttacttgtgcaaacatggacattcttatgccactttgtgtgtaaaatttttacatgaagtctataacctgttgctttggtatgtaaggctgtagaatgagcaataacgaaaaccagaaatgtttgggggaaagaagtttttgtctgatcttctatattcattgacccagacaagtgtcacaaggaccatgagagtctggggagcctgggacattgcccacactctgctaatgaagaaactgaaccacacctacatctttgtctagtcacacctagcagcctctgaccttgctctccttgcctcactctgatccctctagaatccattgcacataccaaccaactcaggccctaaaactcttcttttgtgaggttactttccagtctttaacctattggctttttctcattgttcctcaaatcaaatctgaactccactgtctgcaagactctcccgttcttttcctgaccaccttggctgacagctcttggagaagagggcttagattgataataatctgtgatcctttccttccaccttgcctagctctgccagttcatggagtaacattttcttttccacagttactgtaaaaagaaatcgattctttttagctaaagtaaatgacatccaactctccttacatggaaaaaaggcactaaagtgctgacagataccatctcaggaatggatggatattcttgctgtttctcttccaggacaatcagaaacaaatttaactggtgaatggccattccatgtggaagggaagtggtaacatagggcactagattaacctagtgcacttctcagtaggattcatggtatttctatgtaatttccacttacaaattacacatctaatagaatcttaaatgggaagacaaggatgagtcatatgcccaatccacatttatgtcttcaaaatacgctttgaacaacaaagccacatatacatgttaaaaggcctagtaaacttctagaacactagaaaatcctgattgccaggatctgttagtcactccactccagacagggttttgacaaaatgccttttcccaacagaggttaccatcttcacaagaagaccacatttgtatatatgtggccagcagcattcgccagggtacgtacctcaaggaagcttcaaatggccattcagtgcgcactcaaaagggatcctcagaggagcattcagaccatttgcttaaatgattgtgtgctcattaaggtgggcagatctgcagtctcaactagagatctggtagttaatctgggtccaggatgtttcttaactaaacatgttaaaggagccggataggttgctctctactgccaatttatcggttttacttttctccttggctacagtgcaatttggctctttggtttaatccccttgagaagccagaatccattggcatgcggagctctgggtcttagagcaatatggctctaaaatgtacgaggtttattctgatggtccctgtcacattagcagatggtggcatttaccatgttgatgggagaggagtccttgtgctctcagccacagatggcccgggaggctgtcccagcagcagcacctcaccctctccaacacatgccatgtagttagttgttccctctctttgttcctataccacttacgtttgcatttctttcatgcagttcgttggtggtggttatagtcatctgttttgatgcgtgctccccatattaggctgctaaggttttaggggcaggtacctggcttctcctccagggattaagagatgcaacgctatgctcaaggtcacaaaggtgctgagtggcagcagggtaggattctaagcctcattcatcagtctccaaagttcaggcttttaattagaaggcctgtcatatcatagaaatcacaatggtcctcttagggcaaaataatgggtgtgaaatcgtggatggtccaacgataattacaataagaatcgtttatttgtttcttagaaactgaactaatcattttacaggcatcatttcagttagtcctcctaatagtcctatgcatgaggaatgtcatcaccattttcagatgagaaaattgagtgtcatagaggctaaatgacttgccaaccaggtcacacagctagtaagtagctccaagtctaacccagattgatgtgattccaaaaccctggtcttgggcatctgactgagaccccccaatgtatgggtgccttgctttatctaggctcagatcctggaggtcatttgttgttaccttgaatataagaaacacacagggggacaggcagactctgaaaatataaagttcattcccctgaatcaaatgcagaaaacagttctcttatgggttgtcccacttttcatttgaacttagtggggaccacgggaggggctgttgaaaatgaccagctctttcctctgccaggcttcctacacttacacacacacacacgcatgcacgcatgcatgcacacacatgcacacacacaccccacttcatgcttagacagtgataaagtgagtagctggggcaagccccccgacatgtggatgactatggtggtggtgatggtaggaatggtgccttatattagtgtaccttgtacgtttacacatatttatttgatctacctcaaggtaggtgaccaagtattatcagtccctttttcctcatgtaggaagaaactgagtgtcagagtaattgagatggagcagattcagactcaggactcctgtttcctgatggagtgcactttctgctaaagtaatagctttcaaactgtggtgggttgaggagccccagaagccatcataataagtgagggccaggggactcaaagacctacatcctgcttcaactggagcatctctgcttttatttgacgggtatagagggttctgcatgtggttttattttatagaagggtctgatgttctaacagtttgctactgctatgtaacaaaccactaccaaaagttagttaattattattgcccatgcctgtgtggcttggcagggctctgccagactgctctgctgcaggtggtggctgtggggcagctgggatggctctgttcctcaggcctgtcactctccttggacgggggatagatggtgcatgtcctgcacatctttcaggcttagacttggaactggtatactgtcacttccaaagcaagtcgcatggctgtgcccaaagtcaaggggtagggaagaacattgctcataatgaggctatggcaagggaatggacgcagagaggggtgaagaactggggacaataatgcaatctgcaagtccatgaaaaaattgtattatcactgctctgtttaaattaggctattaaagtccttcaagacttatttatccataaaatcaagaggaaatggctgttgtattgtaaaagacaaaggacttctacccagagataatcaggtctgaggactgttgcttctgaatggctgccagtttggattgtggtcagtgttctcatcttttcacagctttactcaggtagggtggatgtataagtgtgtgtgtcagacagagagagaggtgcaaaatagaagcacgcctctgtctatcagccttgtcagcttcgatccttgtttagtctgtgctttatcttctcccgtctgtcaatgatgtcccccaccatttactgcaggcgggtctatagatccagtctctcccctgccagtctctctttgtttgttgccctggtgtcactgcacctctgagctctaagtctttaccttctgaaagccattcctaggacaatcattaaaacctatggtagttgataatttctgaccctaggctggctaatttgccttcataaactgtcagattctgctaaggtcattgaatgctgtcatcttcataatgtggttcaagcaaaatggataagagaccaaacaaggagaaatctccctagaacacagtatgccagcattgctgtatctcaacaattaaaaaatggtgcgggagttacccagtagaatatttagtgaggtgtactctatgtggagttcataaatacaaatgcaaaatatttaatgcacagaatcagagttgcaaaataagatttaattctagaggattagggagacagaactgacttaaggctgtttttcccagtaagcttaattacttggatgacaatcattaaacattgcaagtcacctatcccaagtgatcgaagggcttttcaccaaatgtctgagtgagaaagtgattatcttatagaacaaacaagtatgataaagggaaacaatcagacaagtaattatgataaagaaaaacaagaaaaacggcacatccagcctgttttgtgggaagaatcacagaggcactatgtaagtacggctcctttatctaacagatcatttactaactatctggagtcaaagtcaagtttatctacatgctgaaatctatttccttctaataagattccatccacttggatctcagttatgtggcaatcttgacatggaacgtgtctcggaatatggaagggcatgagaaggcaccaaatcttcaaccctagcgctcgctcagggtttgattagagaagcagaatcacaggattattttacaggatttcttctctggatttgacttacgcagctgtgggctctaattaagcagacaatggaaagttgctgtgtctctctctgatgctgggacctgaggccagcagggtaggcagttgggaagggaaaatggacacgaagctggggaagcaaagacaaattagaacccatggggataagctggaatccatcaagatggactgaaacccacattggtctcttgctgcctttcaaggaacttccatgatggaggcgacttccaggagaagccgactgcccttctccatggaactcagcctgcatctgcccaggagtcagaggaggtgagggaggagatctgggaagggctggacaggcccatctgcttcctgccccctcagcctgctggtgagccagcagataacccacaaaagcctcaacagcccctggccccccatcaactttcaaaggcaccaatgcaaaagactatagctactgcttcagttccttcttccaaatgtcatatgaaatgcctcttaggggtctatactaacccagaactgtgcaggagagagaaatctgggaaacacagttccagcttagctaggttgacttgctataagtcaaccacacctagtctcactaagcccatttgtcatgtgtggcccactcagactgaaagaatctttgttggttcactgttttataagggccagcctttaccagtttgtccagctagggcactaagttcttagatgcagacatcagttctgtattccctgttaaggatctgcttccttaataggaatctttaaactcctgaatttgtaatgacacattcaaaagcattatttgagactaagcagtaatagtgtatggcaagctggacttacagtcctgtgtgatgtagagatacctaaacataaatgggcatggatattgtacacacatatgtgatgcaaataatatacaaatattgacataggatgatctagagttgataccagacagtcctcatcagtgcactgatgaaaccccagaagaaaagaggtttagccagcaagttaacccatgctgatgagcatctaccatgtggcaggtagcttctagaggtgcaggggatacaacagttaatggtacagtgtcagccgtgaggctcttacattgttttccaggttttctcaaccatgacatcattggcattttctgttgggtaattctctgttgtatgcatctgtcctgggcattttaggatgtttaacagtgttcctggcctttgcctactagatgctggtattcctccctctcttcatccccatccccgctgcagttgagatcataaaaaatgtcattaatcattgccaagtgtcacatggggcaaaatcatcctcagttgagaacctgtgtttcagaagagacagaaaaataccactgagatactttcagatgctaataggtgctcttaagaatataaagtaggctgggtgcagtggctcatgcctgtaaccctagcactttgggaggccgaggcaggcagatcacttgaggttaggagttcgaaaccagcctggccatcatggtgaaaccctgtctctactaaaaatacaaaaattaaccaggcttcatggtgggcacctgtcatcccagctacttgggaggctgaggcaggagaatcacttgaacctgggaggcggaggttgcagtgagctgagatcatgccactacactccagcctgggtgataaagcgagactccatctcaaaaaaaaaaaaaaaaaaaaaaaagagagtttaaagtagagtgatatggttacatgactaccaaggtggttgaggaagcccttgccgaggaagggcctttgatttgacatgcaggcagcccctcagagatctggggacaaaatgcatcaagcaaaatgaagagccagtgcccaggtcctggaggggaacaaatgtggcatgttgaaatagcaaaaaggctgggagacttgcagcatgggtgatatggtttgggtgtttgtcccctccaaatctcatattgaaatgtgattcccaacgttggaggtgggggctggtgggaggtgtttggatcatgagaggagatccctcatgaatgtcttggtgtcctccctgaggtcatgagttcacacagcatctggttgtttaaaagacctgggatctcccgttctctctcttgctccagctctccccatgtgatgcattggctcccccccacccttcacctttcaccatgattgtagcttcctgaggcctcaacagaagcagatattggcaccgtgctttgtgtacagcctgcagaactgtgagccaattaaacctcttttctttatagatgacccggtctcaggaattcctttataacaatgcaaaaggactaacacagcaggtgaggaagggaagagaggagggcatggggtagggaaggacagccacaacatgggggaccttgtgcatgggtcatggtgcacgatctacatttaactctggctactcagggcagtcatgggagagatgtgatcggggagtgatgcaatctgatttatgccttaaaaggaccacgctggctactatgtggtggatgcacaaacagctcttccccttctgcctcctttgccttgtgacccacaaggacccatgatacccacctgcagctggctgttgccatctattcggagttgtcaactaataacagacaatctcctctgccctgtgacccacagggacccatgatactcacctgcagctagctctttccatctatccaaagttatcaactaatagtagtctctgtgcctacaaatgattaaaattgggcttgaaaatatggcaccattatcatcagcatttcttgagcgctggccacttgtttctggtgctcgtgtgtgtacatgaacatccttgctgtgagtgctgggccccaccctcactgccatttaaaaaaaaaaacaacaaaaaacaggtgtctgcagcctctggtgaacatcagcttctccgtaaggctataatgggagacaccttcatagattttgagttcggctaaaataccctcctgtccagttactacctataatgctcttttcccttggatcagaaagccttttctctgtggattatttccctccatctataccccacattactaccccatgccttcataaggttttactctttactggcgttatgtccatttatatttgaattacacaagcatgaccattcatgctctttactcatagaagggcaccctgcccttcctggaaaaatgatttactttcatattggataccatttgaatatacccagctgtctgcgtggaaatagagaagtagacagaaagaagcctcctgctacagcctaggagcagaacagtaaacccaggtttccaaaatatctttctgaggtcattacagggtcatagccctggacagcactattcctaagtcatcctgaggcattctttgtgtgacaggcccaatggcatggcaatggatttcataatgaaaataatgaaacattgagataaaaagttaatttcttcctggaagagtctatttaataatgcaggaaaatgttacactttttagttatacttaattataaaatgctagaaaaataggagtggttttggtgttgaaagagttatttatctgagagaactatgaattatccagaatgcttctctaaagtttcctttttcccaaaattttattatttggcataatttcagtggaatcttccaaaagacattagtccattcttttgcttcagtgcatgtttttttggatagatattatctatttttgtgtagtgttgtaaggtttccaggatacgtaaaagttggaggatatatggttggtgcaaaataattccgtagagtaatgagattgaattgggggaggtggtttaaggaatacaaattcagtttgcctaaatagatgtaaaaaggaagggaaggaataacatctgaagctaaggaaggaaacttttgggctggagcatgactagataggagtcgggtagagctttttaacacagttgaagatagctgtggacgtagatcatgggcaaaactggtaatgtgaggatttaggaagcacgtttttaagctactgttgagtttcataggaaaccataccccactggtcataagagacattcaccaatagttttccatgggccttttgtgctagtggtagttttgttgggggcaggatttacaaaaatgaccatgcatttgaaaggtcaatgatgaaggtaagtttgagaatgaattttccatgaatgtcctgcaagttttattctttctgtgaacagcttgaattttcatttggtttgaagattaggaaaataacagtcatatatactcacagatcaaattcaagtactgattttagccatctatgagcaaaggccattcttggtgttagacatgaaacaaacgagagagaaagaaggaaagagagagagaaagatgtgatggactgccttggttctcataatttagaagtgagactataggtatatgcacaaggagctctgatgtgaaacatggatatcatatatgtcctaatggaaatgcacaaatatcctaatgggcttaggaagatttctagaaggatagggattccaatctggtttaaaagaaaagcctgaaaccttggcaaatgaagtcagcaaggatattccggtagcagaatgagcctgggcaaaggtgaggagtggagtgttgcctattttgttttgtgaggatgatagattcctgtaactggagctgcggaggaagtagatgtattggagattgtccttgaaagtatccagactgactcagacagcaattgtgaagttcttgctgatagatttgtactgtattttccatgcaatgcaagatccattagagggatttgagtaggagattgtcatggaatatttagaggatataattcagatttaaaccatggaatattttccttgatactattaaggaatgatagattctttgagctaaaaggagcactagagattatctattgaggtagtttccaaatattgttttagcacagtggaaaccttctttcaaatgacatcttacacaaatgccccagctacaaaacagatagaagagcagttcttgtggaatcatgatgggaagagtcttgatttgctgctttctgtttcttcattcctgtagcaatccctgaggtacctctgtagaaagcacaaaatcatggaacaacctgccgttttaaagatgagtaactcaaaagaaatgaaaacatattatgaaaccacacataccataacatcaccagcagccttattcataataactgaaaagcaggataccacccaaatgtttaacaggagaacggataaactgcgttgtgttcatacagtggaatagttctcagatgtgcaaagaacaacttactgattcatgcaatggcatacatgaatctcagaaatattaagtaaaagaagcatgacccttggatttcatttatatgatacacaagaacatgtaaaacgaatctagggggaaagaaattaggaagtgatggcctgggtggcagggaggagaactgattcaaaaggagcacaagagaactttctgggatgttggaaatcttctctatcttattttgcgggatggttacatttgtgtattccgttgtcaaaactcatcacgtggaacacctaaggtgtgtattttattgtatgttaattgtatcttaatgaataaaagttgagtttgaagattcttggagggagatttgctcagttcccatagctaggcatgagaaagactagcagctagaacttaggtttacaggattcctggtccagctcttttaaccgcatctctctccctcagagtcatcctcctcttcaccaacacagcatcaaggctggcttctccctccctggacatcctcttccctgctcaaaccccaccgtggctgtgaagtattaacttgacgacactgtgctctttgactcagcttttaaactttcctccagtgaaaccagaactggcaaacacagctacacttttcttgtaccatgctttacctgtattgccaacctgctgataaatggctccattccatagccttgagggtcttgaatagcttaaacattttatagttccatgggaatgagacaggggagaagacaccagtggcttccattgtaggcctgtctacactgaaggaatgccaactgcccacacacacttgttgttagatggcctggaggctcatctgcacagacgtgcagtttaactccattagggatcacagagtgatcacacactgtgctgtgctctttggtatatatatgaaaagcatcgctaagagaatgggagaggtggtgagagtttattgctgccttctttctcatggaagcattggacagcagggcagccctagtgaattgttgactgctccataagaatatcttgctcatttaacctcttctgtactaggtcttctgcctggagagtcctgggctacactgcccatccccagtatcccatgtattcatgtcagattcttgcagtctcctgaggatctttcaaggactggaactgcatcttcaccatctttgtgttcccagtgtctgcaacggtgccttattctagaaaagaacatcttaactgggagctgttttgccaggaccatcatcaaaaatgtctgaagatgtttttggttgtcaaaactggggacagggtgctactggcatctggtggataggggccagggatattgcttatcttcctacagtgtacaagacagttccccataacaaaaaattaccccacccaaaatgtcagtagtgccaagatcgagaagcccttctctagattatactttattgtatagaagataatagatcaaccacatcctcaaggctgggaccaatgctttgcattatgatgggtgtcttggtttcttttatttccactcttgattctctaagcatcatattcaagctctgagatgaggtgtatctgactgggtcaggtagccactgagcaaactggaataggcctttctgcagagtttgaacccaagtcaatgttgcctcgactcaagctcagatacctcatctaatcatcagtagccatagtaatagtagcccttagcacagaccactgatatctactgcttagaaggggtttgtgggggtagaaaatgaggttatattaagtttacttgcccaaagtcacacagccagtatgttttggagccagattcaaacccaggttgtctgaaggctccaaaagtcatcatttatcactgtatattttcttcttagctttcttgcatttcctttaatgttcccatctctccctagtgaaactgatttccctcaccaggaggttctctaggaattttggtccagggcttagattcttaaataagagcagggacatcaccatgtttgttatacgctgtcatttcacctcctctgttctgaatcagaatgaggccagcactctgggttctaagttatcgttttttttttttttttccattctatatactccctaagaatcttttttatgcttaaggtacaagtttaaatatggaaaaaaaaatctagattgaaatgaaaagccagacatttcctagttatatcactaattaactgtgttactagtgataagctgcttataaatctttcatcattaagataagattaccttctagatcttaacatttatgatcacagggataagttttttgttttgttttgtttgagacagagtctcactctaccacccaggctggagtgcagtgtcacaatctcagctcacttcaacctctgcctcctgggtttgagcgattctcatgcctcagcctcccaggtagctgggattataggtatgcaccaccacacctggctaattttgtattttttagtagagacacggttttgccatgctggccaggctggtctcgaattcctcctgcatcacctcccaaagtgctgggattacaggtgtgagtcacagtgtccagccaggatagttcctttttattgtaacatatccattttttcttcatttatacctccagtatccaacaagttaggatgcaggaattaagaaagaatcgtcctaaagtaggaaaggcaagatttgatgaagttggtagaaatcaagaagcacagttttgtaagctttgcttgggtgtggattgggaagctatttcttatttctccaagagtgtttagcttctcagacaatttctgcctcagtttccccatattttaatggggggaccaaacacagcatggtcatgcatgacatgtgaccgtaatgaaagtgtgactagcacattggaaacctggtgtggcagaaatcacacttagaatcaggtcaattaggagtcaccttagttttcttattgaaaattatgtgtaatgctgaaaaattaataagagagttccttaaaataacagactgaatttcgaagtttaggtgataattattttccgaagtctgacctgcccaagaccttatataagcacgttatggaaagcaagagtggtatatctttactaataaataagtatttctccaaactttgaaaaacattctgaagcttcaggttaaaaatatgtaaatggaaatgccctccacttgactgtatcacagctgttccctgtccctcatttgctgaaggactgagtacaccccaaactggtcagagcatgatgactttcagtaatgacctaaatgaccttaaaatatcagtaagtgacagagtattcgaagtcacagtctataacattcgcttagaatttccccttaagctgctggctgaagcactaattaagatctgaaatggaaggtaggtgacagatgctttgtgtcctgcagcagaggcacagaatgctgttctttcacttactgtttaataataataataacagccatttaatctgtttgctgatacagtctcctttgctttattatgttgtttattttgtgtgagctttcgatattagttataaaaatgtcactgtgtctgcagctgcatttttcattttagaaactcccagagatctcatcaatttaacctgccttgtacagttcgcaggaaaccactacaggcaaagataggcttaatcaaggttttttcttaataacgaacacaatacacaggaaagcagggcaacgaatgagcctttgattctaggtaaagacttattatgtgaaaatctatatttaaattaggggctttttgctaggattcttaactgcacaagacaaattactgtaggatgtctctaaacagcaagtgtgtcttaggcatttgaaatataatttaatctattaacagtttaccctagattttaagccattcattgttggcgaacacaatctagattctttaaaataaaaatagaaaagcatttgcagtaactggccattattatagctatagaaatcaaaggtatttcttgtataaattttgaattatatattgtttatctctccttaataactttcactatagaaagagctctctttcttgctcaatttacataaaagtatctggaacagttcagtgacaacagtgttggaaattaaggactgacttgagactgaagctccctccataactcccatgcccttctccagtactaagtagtataaaggccaaaagtcagataaacaacataagagaaggtggcagtgctagagatggggatgaggctgtttcatataatggaaggacaccagttgacattttccaaagattttccattataatcttttgcaaaggttctctttcactagttaacaaatataaaagatgccaactcccaccagactccagatgcttgtaatagaattagaaggccctccaacctttctttccaggggtcctgagggggacgtctttgttggcaccccaagcctgagtcactcctagcacctcaggaaagcatgtgttgtgtggcttcaaggataggcatcctaggagattttaccacctatccaggtgccctggctgggtgaaaactgtgcatcttatgcttcctcaatagtgctgtgagaatgctccactgccagtttgaggtatcaggtttgggttttcaggattgcaagactgctgtgctgtgcgtgtactggtgagttggctccctgcctttcccagcacccccatgcctccttcttcacatcccctttcaagtagaatagggaactgataacccaaccaggccccttattcccatcagatagcaagctaatcactgagacaacaagctttgcagtagagaaaagattttattcaccaggcagccaagcaaggagacaggagaatagatctcaaatctgcctcctcaaagatgaggtttaggaatatttatggaataaagaagcagtgtggtctattgtggggggaaaggtgattggaggtgggggaaaggtgattggaggtaagaaaaagggaggtaattggtgatctgcacagacatagtcaaaattcatggctcttcataggatgtatgttcatgaaatggcattgttagcatgatctgagggtggagtttttgtcctctgatgtcaaaagtcaaccaacagacattcatacaggcctagttgatgggttggtggtctcagccagtttgaactgggtaagaactgacctcaagttcctataaaacaatgtaagcaactgttaccatgatgacctatacattagagatgttacctatgaggaagctagtgagagtttagatacttttaggtatataggttttaagatcaactagaagtaagcaactaaaagcaagtgaggcaggttaagtttgtcaggcctaatcaggttagccctcgctttcagagtcatctgcccaagtacagtaaacagatccagctactacttagatactttgagaagtttagggttgggctctttcttcttagctttccccttcatagaggaaagtccacatttacttcacatgctaacttgtttgctgttagtagaaatctgcgggaagtttgccagagaagggtagcctttggggattggccaaccagctagcagggacctctgctgtgagtggcccatgctgtctgggcagctctgttaggtaaaggagaaagccatttggcttgtgtagactgcagctctgcaggaacctctccccaccatctctagccaccacctccagagtacagtaaattgtagacttagatttgctgtttccagcatagatgtcttacactttctagagggttccctctgctcacatagagccgttggttaagtggtggtgctcattttccatgccctgctggctagtccttggacattgtgagcatttttgtctccaatgccactgaattccttaaggccttttgggtgggtgctaaatatttaggcaactcttactaagaaaatagaaaacacttgagttctctgttttgcatgtggctatctttacatcagagccttggaagtggtcaactgtatgtagccaatttcatgaggctgttttaactgggaggacattgtcacctggctgggcttatacagctgagtcaataaggaaaacgcagcttttgttggcttgcttaccttttaaatcagtaagtaatgcacaaaatgggtccctcaccaccactacttcctttaaacctcatccccaactccacatcccatcatcatctctcatctcatctcgcagctttagctgatcccatggtggggaactggggaggcatgaggttgggggtatatgtgtgtatcatatattacttgggagaaaaaaaattgttttaggttttattacaaagcacccaagttaaaagagcagtgttaaaattgtcttatcaaaatatcccgtaccattgcattttcctgtttaaagagactgccataaactctaggggctacccaagtgaggagacgagattatgattaacaatcaaagtgatggggaaagttataaaaataggaaaaaaatatttagatataaagtcactgacctatgaaaccaccttgcaaatggtaggcaaaagaagtagtattactgaaaaagtatgaattgttacctttactctgaaattagtatgtaaaggagcactttgtttactgcactaaatctttgtctccagtttttaaattatgagatttatattgcctaagtatagactgaatacattttaatatttaattgttttttctcaaactatggtttgaaaaacaagataattcttaagctgggtttcattactttgaaaactaacagtgttttctaagagaacacgttactgatttaaaaatgtaaagtaataaaaatagtattcacataaagtttcagtagagttttagcacagaacacaattaaccagggcttaaaaaaaaccatttaattttgaggcaattgtagttatttcttgcagttgcaagaaataacacagagttctagcgttagcatttaccctgttccctcaatggtactatcttgtaaagctatagtacaatatcccaaccagaatattgacattttatagttaagatacaggacagttccattaacacaaagatcctctgttacccctttataactacaacccctcattcccatccctgacccctggcaactcctaatttgttctctgtttctataacttatcacttaaagaatgccacataaatgggatcatataatatgtaacctttgagatttttttttccctcagcataattgcccaagattcatccaagttgttgcacgtatcaagggcttgttcctttttattactgagtagcgttctgtggtatggatagaccacagtttaaacatttgaatgacatctgtgctgtttccaaatttttgcttattataaaaaagcaagcaggacttttaaaaaacacacttatagaaatgcttatggctgtgtcttattacagaatatttataaggagagtaagattaaagagttagagtcacttaggattaaaacaaatgttataaactatgacagtccagctcaaagtagcttgatttcataaatatattctctttatggtatttcataaatgccataaatcaaagtagcttgatttcataaatgtattctcttttgattaaataatcaaacttaagtaaattattggccagtgtccacaatagaatttgtaaatagttacattgtgttcatgtttgcatttctgttctcaacctgaatgactgctcaatatagtacactatattcacttttattaagcactgctctcacatctcattgtgtttgttgaacctggaaatgtgatagcatttgattgtgttgattttttttttttagctgccaagacgaattgttagatgtttttaaaacattatatacccttatgcccttggtgtctctgatgaagcagattcattaaataaacactcacttatgaatagcagagccagcacagtcatagtggatgaagtttataggttattgacggacggtaggaaatcagttgaaagatgcccggaaacatgtggttatgttggtaggaagtagaaaacgcctgcctggagtccttcagatcccacaacgtatgcgtgtgcatcttctcaggctccgtattagccctggtacgcacagagacacacagcgaccagcctattagttgcctggcagatgccgtcagtactggtcattttgtgaatgcttttaatatgattcacagaatgtctgtagtcagtcacgttttagcactgacagtaaaatgtcacctcttcagcagttttcttttaaaaaaggtgtaaagcctcttaaaaatttttgctttaaactcctatcgatcgtttagaaatcttattagcttgctttgggctttcttttagagttggagaaattaaaatttagagaccaggttgggctgagaaaactgcgtggagaaggggaacttgagttgaatcttacttacaccagacagtagggacactaaagaaggcaatactgctggaagataaaagttgacagctttatgaaagaaggaaacaagtgaatgagataattcggctgagagctcccggaaagcaagaattctttttcatctgtgccctcagtccctagttggagtacagcccaaagtaaggttcaataaatatttgtttaatgaataaacaaatggatgaacaaactgaaataagtgttgatatttgttatgaaatatgcctttctcagactgttccacacacctcaccctggctgtgccaagtttctatggctgcacaacaaactactccaacacttagtggcttataacagcagatggaggttcacaggcttccactggacagttctccttgacatctgttctgcagtcagaaggcaactggaactgaggtttccggtggctccgcttgactacagggatgttgggctgtctccttctcagggcctctgctctttgtgtggcttttccagcagagccgctgaacttctaacatagtgtggctcagggcttccaaaaagcacaaagggagaagcttccaggcctcccaaaggctaagacctggaactgtcactgtgttgctccctcttttagttaagcagacaagggggccagaccagattcaaagggagggaaaagaaaccccacctcatgatgaggcaccactgttttcccatcgataactggtatcaacccagcatcctacagctcaattcagttctgacactcaccatcccgacttagtacagaccctacaggttaagggctcagtccccttagactgcccccacttcagatgccagctgaaagtggaatatgcccaagttacccacacttcttcctggctgactacaaatgtgggggttgggagaacccccaggtttggcaattcactagaatgactcacagaactaaggaaagtgctatacttacaattacagtttattataaatgatacaattgaacaaccagctgagaatttatgtagggtgagggccagaagggtcttgagtgcaggaacttctgtccccatgaatgggacatatcactgtcctggtacatcatattttcaccaaccagaaagttcctgaaccccattgttcaagagtgaacaatgcaggcttcattgcacaggcatgattgaggaaataattggccattgatggttaactcaatctccagtccctgtcatttccccagaggtcagggacaaggttgaaagttcctctaattatgtatccatgtggctggcaccttcctggaaactatctaagggcacaccttgagtcaccttgatagcataaagatacagctcaaaggggttcattatgaacaacaaaagatgttcctgtcactcaggaatttcaaatggtttttgaagctctgtgcctcgggaactagggacaaagacaaaatagattttgctgttctatcacagggttgatgacaaagaatgtgtggccatctttaatctgtgacactggtcctctgcagactcaagcaaaatagatgaaattttacaaaggactgttttcctatcatttgcttagaaaattaccctacatgtttatcccactttcccctagagcaggtttctggaaagctaatgctatgtcttacgtatacataaacggatgaatgagacaaagtttgttgcattggtatgtgtgttggggggataggagggtgatgggagagcctcctggaatagtcttagagttggacactgtttccccttgtgactccttttgcagctactgccttgatcccctcttgtgcctgctaggctctgccttggggaaagctcaactcttctgtttccctacacttgaccgactgtctccatcgttgccttgcccatcttgtgttgtgtccacccaaacctgactcagatctactagttttcatctttcgctcacggactattctcttgagccagattcctagtcccctaactcaatcatcttattctggcttctccagtgttctttcaacccaatcttgctaaaaagctattttaatgcccgactgtggatttttggcatcgttatctcagcaggcctagcttggaggttcctctgggatttcctgctggagtcttctttttaggatttcccagtctacttgggatacttaaggaaaattatcaccttgtcttaggaagaatcttattatctcaaatcaaatatttaaaattgcaatgctcccttatctggaattttattttgtaagggacattttctgataagctgccaatgacagcctatgatatgaaattctgtatgtccctttgggttcaacagtaaccttaatgggatagttttgtctccctgtctcacctcaggtaacagaaattgtcaagtgcaaagaaacttttgtatccttcccacatccagagctagcttggagtttgaccttaggcaacaaccaactaactgtgccttgaagataactctctggggagttaattaggatagactgaataattcaaggggcagttttggtgaattaaattgggaaaagattttcgagtgttaaaggttgaagcattcccttcctattatttcagctcttacctctactttctcaatatacattaaagaaaagcaaatctgttcaatagatttgagataatctattaatttagaatgcttactagaagcccaccatggggctaggctccacaaagtttgaattgtggttatactgtcggttgttttttaaaaatgtacagcaaaatcctaggcgatcttcatgaactactccagaggccaccatcctagaaatctaaactcagctctcctttaagattagtcattttcttatccaaacaccacagagctttttacatagctttattacagtgcttcagatattgtcttgtaattatttgtttctcaacctgtcttacctattggacctgattaatttagaggtgggaggctgctggcttcatttccttatccaatcatttaaattaagcatctgacaggtaccaggcactatatttggttctagtgttccaaaggaagtagacaatcctcattttgtatgtattcttcttcttcttcttttttttttttttttaggtggagtctcactctgttgcccaggctggagcgcagtgacatgatctcggctcactgaaacctccacctcctgggttcaggtgattctccttgaactcggcctcccacgtagctgggactacaggcatacgccaccatgcccggctagcttttctatttttagtagagacagggtttcaccatgttggccaggccagtctcaaactcctgacctcaagtgatccacccaccttggcctcccaaagtgctgggattacacacatgagccaccacgcctggccccattttatatacatgctgtatgtttgttgcatgtgtcaatcattttgaagttgcatttccacttcacacactctttttttttaaacggataattaggaaattcagccattttgaagttacttgactctggttatggttgttttctaagctctgttaacacacctggtcaaaagtttggaagtcagacatgttttgtttgtcgtttttttttttttttctctgtcagacatggcctgcaccataagcttctgaaaaactctttgaggccagagacttggcttcattgatcttagtatctttggcaatgttttgttcgtagggaagattcagtaaaaggacatttggcatcagactaaaggaaatgtgttccattagatgtttaaatcacggtggtttattttcaaagccatagttttgtagtgtttctttacaacgtgattgaatttaaatgcactgggatgacttcctccaagaagaaggaaactggggggccgagaagatgtggcaaaagcagaaacatgtccatctctcattgggtagggacatcattcatttatttgttcccgtatcattttgcagattccttttcaacctgtacactggctgtctttctctcatccccaagtttcaagatctctggtggtatttcttttccatatcctttacctaccttgccttgctcctccacattcccaattccttcaatttttttttcctctctaatctgctgttttatggatgtcaagatatactctagttactcagctcttaccttagaattgagacttcagagtttcccactaagttccctttgcgatacacaggaaagggaacattaagaggagcacactgagactttaagcaggaaaatcggtaaacgctgaccatactgaacaattaagtctactattacttactggttttcttcttcagagcataaaccgggcttccctttccccagacttggctactgtcccctggcttgcaataacccctggctcctcaaaactctatgccttatacatatgcctttccaagtactcttgccatttggaggatgggaagatactatgtcagagaatcccaggatctgattggatggatataattgtgactgcctcttcctccactgtcaggtaagtctctgaatgtgcctggctgctctgctttctctgagtgccttctgccatgagccaagcttttctgtcaccataagcaatccactcatctcttcaagcagggacacgcatctacgtgattggtggccagatcaaatttctgccttctagaaggcatctttcatatccagtctttcacccttaccagtaatgttatggtctagacttcattgacatggttcctccatggaagatcataatactgtttcccaacccagacatagcatctttctcaacacagaactctaggcaactgctttcattgattggagttgtcattcaaattcaaaatgaagcctacttggcatccctagcagctagtcttctcttgcctagatcattcctcttcatttatttctagccacttgcctcaaccccctcgagtttaaccattgccagttttgattggaaaacctatttattgaacatctctggtgatttttctgctgtacccagttacctctgaatgtgttgcccatctctggaagaagaggtattcctatatacacaccccacattcactgagggcttctctgtggttagttcataactctctttcatatgtggtagccaatgctccattaattaggaatgatgttgaccattctttcttctaaagtctgcacatattccttctggagttgtctgtcatgatagtgtcacacttcaacaatgttgaggctcctggtaaattctacagaaacatttccattttcctttgttttatgtacagaaatatagttattaattaggtccttgggcacaaaaatggaggcaggcatgtgccatttaacatgtgtgttagggttctccagagaaacagagctaataggagagagaaagagagatagacagataagaggagacttattatgggaattggctcatgtgatgatgaaagctgagaaactccataatctgcagtctgcaagctggagaaccagaagagctggtggtttaactcagtctgaaggcctgagaaccaggggagttgatggtgtaactaactcccaagaaccaggagctccaatatcccaggggaggaggaggtggatgtccttgctcaagaagagagagagtgaattccccctttccccatctttttgtcatattcaccttttcattgtattcaggcaggccctcaacagattgggtggtgtccgcccacattggtgagggcagatgtacttgactcagtctaccaattcaaatgccagtttcttctgaatacaccctgaaagactcatccagaaataaagttttaatagacatttgggtatcccttaacccagttcaactgacacataaaattaaccatcacaatatgcttcacatatgtttttaaaatagcttaattttttgtctataagtcttgtacatgggtagtggttgagttagtatcttatcccttgagtttgccaaccccttggatagggtcagtgtcttgggttctctgaatggcatttaacacatggtcacaaaaaccttggtctgaagaactttataatgataaagttcaaggtactttggtgtcttgaggaactccctggactgtgaggcagagactcgcttggctctagtcctggtgctggatctaactggctgccattgtggggctcccctaaagataaaggaactcagtttcctcatctgtgaaatgtgaggatggaattcatcaccatgtcccctcccagctctaaacttctctgagtcttgtttttccctgctctgtatcctccactttctggcatgttttttatatttactattataaatgtgtccctattttataagttgttacagcacgagagagaggtaaggaatagttaacaaaattgtattctgagtagcctaatattcttttttttttcctgctaaacttctttttcctcaccttctcctaacatttttgtgggggtgggtggactggtgggtgactgtagtgatattgatattcagagaggagtgaaaaatgcaaaattgcaaggttaacaacagatggttatatggtgccattttaggagtgttattaaaagaacaaatctattttcctgaatagtaggatgtcttaagtgtttaggcttaaatctactgttgaaatagaaaaagaggaggaagaggaggaggagaggaggaggggaaggaggaggagggggaggaaaagtcaaggaaacacttagaacatttttgcatgatctcaattttcttcttgttccaaggtttttaatttggacagtggtatgtgcttcagattgaatgcaaggaaatttgttgcaccatttgcctgacagttatcattttccttgacgaaaagtttttctgaatcttgctttgctggagctacctcttcccttgccctgaataacctcacttgcttaagtcatcgatgcagtggactgacaccacctttctcttaaggaattaccctgttctctgggtaggtctaatttacactcccactatcacccaaagaagagacactctctatattgataactagaaagaaggaactgagactgttgtccaaggacatcttatctttagcatagagcgaatatgtggtttatggtaggtgttcaacaaacttaaaaaaaaaaacttgtattagtctgctctcatgctgctgaataaagacatatcgaagactgggtaatttaaaaggaaagaggtttaatggattcacagttccacatggctggggaggcctcacagtcatgacagaaggcaaaagtcacgtcttatatggcagcaggcaagagagaatgagagccaagtaaaaggagaaaccccttataaaaccgtaagatttcacgagacttactcatttccatgagaacagtattggggaaatcactccccatgactcagttacctcccactgggtccctcccacaagacgtgggaattatgagagctacaattcaagatgagatttgggtagggacacagccaaaccatatcaaaacttaatcaaaaataattgaaatgtcaggaaatagagaaacttattgagcttttttagggaagtggtctttgaacctgttttgctctgcccactggagtatgctgtccatcaaattgttagttcagtgaattatggtacaaacactcagttacattaatatgactattttcttgtatgctaatttgagaacctactccctggagatatgttatcccatgtaatttccaagtgaaatggagagaggatgccttagactgttacttctcatgtttttcattccaatcttcctcagtgcccctctctataatcccaatcctatacatttttaaacaaaggaaagccactcagatcacagtagctcatggacattggtgagaaacgtgaggaaatgtagaggatccccaaattctcacacataaactaaggtgcagccactgggtatcaagcaaggtttcctcactggtttaatgactccagttttccacattgacatttgtgctgggagccttacatatatgattttgtaaaaccctttctgcagcccttcatggtaggtagcagaatatttaaccctattgtaagagacaggagaaaccaaactgctttttctattctcacccgccattctacacagttctccagcagaatcccactggatgtcctatagtttggcccggttctaacactgtctacctggagatagcctcagatctcacaggtaaagggctcagccccacaagactgcccttcacttaaaatgccaatcgcaagtcccagattgtggtctgtacttctgagcaactggccataaattgggggttcccccaggccctttgtcatgtttgattaatttgctagagtggctcacagaactcagggaaatgctttacttgctactgcccatttatcacaaaggattttttaaagatacaagtggacagccagatgaagagatagatgcatagaacatggtttggaagcatcctgagtgcaggagcttctgtccccatggaattggggaacactaccctttgggcacatggatgacatgcatgtgtttttgttcacaaactgagaagctctctgaacccagtccttttgggtttttatggaggcttcatcacataggcacaattgtttaaatcatttacataaatatgattgatcaactcttccctctcagatgttgaaggtgggactgagagtcccagccctctaatcatatggttggttcccctggcaaccaacccccatcctgaggctatccaggagcccccagccacaagtcaccctaatactatacaaaaggacgcttattttggagattccaagggttttaggagttgtgtgccagggatgaagaccaaatatatcttattataaatcacaatatcacacctattataaagcactacatataaagtttacactccaagaataaaagatacaaatatggaatcttcaaatgccaagggcctactggatactgtgaatgacaatataagctacatcacctgttattgaaaaccagaatgcaagtgtaaacttgaccagggaacctgcggagatggagaagtttgacacctctccagcagcatcatagaaatgaacatcatgagcgcattgagggggagggttaatgtcttcatcgttcttcctctggtagaattatatttgcatccttcctggtggaaacttgatacttcactgtagtgcacctgtacctgtttttttttttttttttttttttttactttcttggagggagagttcttctatctcagaagatagaagaaatagctggaaactctatattcctgtgccctagcacaggagaccaggggtctccaactggtctgtggccttttaggaactggaccacacagcaggaggtgagcagtgggcgagtaagcaaagcttcatctgtatttacagtgactccccatcactcatatttccacctgagttctgcgtcctatcagatcagcagcagcattagattctcattggagcacaagccctgttgtgaactgcatatgtgaggaatctaggatgtgtgctccttatgagaatctaatgcctgatgatctgtcactgtctcccatcacccccagatgggactgtctacagatgggactgtctagttgcagaaaaacaagctcagggctaccaccgatttgatactatggtgagtatgtaatgataataaagcgtacaataaatgtaatgtatttgaatcagcccaaagtcacccccaccgacccacccagtccatggaaaaattgtcttccatgaaaccagtccctgctgccaaaaaagttggggactgttgccctagcaggtagagcaagggtatttcacttaggcttgaccaatcgaatgccttcattctggattttggatctgggagaagtcttgcagagacgaagcaacatttgagaagggttttaaggctagtttgagtttagtgtgctggtcctggctgccatgcattgagcagatagttcctgtggtaagacctgctgcccaagccacccttggtttctgcctagttttctaacacttctgtcaattctccattcttgaatagtcttctaatataggccttttctgctttaggtagccagacagaactgttccttgcaaccagtgactgtctaattcagtcacttaatgttttgtagctttgttcagttactgggcacaacccactttctgctcaggcggcttggagacagccatgggccatatgaatcgctattattttaactttcatagtaagaacttgctccatgtgggaaagcataattattttggtttctgagtttaataagcagaaagcaaagaagaaaaaaaatactgtttgcactgagcattaaaatataaggaagtaaagttgtttatagatagagtttcagctaagcaccaaaggtttatttatattttttgccatttatattttctgcctagttctgcctaggaaccagggaaatccatggcaaggagaaaataaagcatcaaagaggatgaaaatgttgaataaagtattagaacccagaacacttaaatctttaacatccatagtaagagtccttcacattactcaggcagactttttttttttccacctcttggtattctgtgcctacacttgcatgtttaaataacgatttaaaaatcacatgagaaatgatcaggctttctttttcccacttgactctcagttatttcaattctttgagacttgttaaagaaaccgtttagtgttgtaaatgccaccaagtctctacctagtagagattagaaatcctctcaccaattccaagttaaaaaggtcctgacatattttgatggaattggcccatgttctcatttaccagtgaccagctcatctccatgctatgatgctccccaggaaatgtgcatggtttttgtagaaggtggcgagaagcttcatgggcaccagcatccacaacccacttcttgaaaaacaaaatcagatttatatttagctgaccacctggcaagatctcctgtaggaagagaaggaactatacccctattactatttcagcttttattcacaaagtctttatatttgaaaaatgctttataatcattttaattagtggtttctcaccaaagccctggatgtggtattattggcaccattttctgagaagaccgtgtgccattgagatggaattgacacaagatgttaatgggttagaagctggtactagaatcagaatgataggccataggactcagcaagccatgctatttactgtcatcttagagggctaggtagggtggagggaaggagttgatgactgattgttataagtgaaaagggcagcagtgacccaaaacaccattgcaaatgttaacagaggcctgttacagagttaaagctgggttttccaaaacaacacatctgagtaaaagcgcccttggtacattagccagtatggagccagcacctgagatcacactgtgtttgcccctttctgcaatggctattggtgctggttgcttgtcttggcctaagagttttcagctgggcttttgagcaagctgcatcttgaatctgaggatgcgggcaagccaggcacagaactgtgagggtccttgcaatgggctgctggtgttcctgtcattcataagcttggacttggtccccactgtgtttgatttgggagaggttctttgaccatacaactcttaccgtgtaaatgtgctacaatccttgtcaagacatagcaaactatatttgaacattgttttaccatttactgttgtgtgcatgtgggccatattttcctagtcagatggtgagttctgtgagggcaaaggctgagtcattctctatttacattttaagtaggcatccagagacttggttatattctgagtctgtattattgatcaaagccctcacctggagtttctggggccattcactgacccagaatctggtgacattgacacagggagggaataacatccagctacagatggttaacacaggtctttagtgccccaatccccattttgctgactcatctatgcctcaagaactccaatcttcatgcagattctgttgcccttgagtactcagttctgtctcttctgcatacctctgtggagccttggatcctgtcagactcttcgtgttgctgaagttctcagtcctctctctcagccgagtgtaatagtgccccagtgggcactgtagggacagaactgagtttcttcttttcttttaggagttgattctctccgggtaatatctggagctctctaaagtttcagagagaaatacgttccttataaaccttgtggttgtcatgctggtgactccttgagcctgtcctgtgctggaccgtgaggaaggacacaaggccatccagactcctggactcacagtgatttcttgtcctccccaaagatgcctttgcctggtgcactctttaatagcccatcacttcttgctggctgtgtccccagctgagttcctccaggatatggcatcaactctgaacacatctctgtatattccctcttaggaccataagattcatgttaaacttagtgccagaaataaccttgggtagccatgttccttatggttccttagattacattcctagattacacattttacattaaaaaaaaaaaaacaaaacccaaagcacctagaaccgtgctggattcttgataaatgcttgtatccattaaatacatattgaagtaacttctactccagtgacccctctcttgaggcttactgtttacctcctcactttggggagctacccagccaggaccttctgagagagaaaagtggtatatttagtagtcaccagatagttactgttaacggtgctgagttcttaaaaaaacctgttaattgtactagcttaagactaaagtatatgttcctctcctcgtagagtgatgatgatggttttataaatactggttggatagcactgtaattaatgggcacaccagcttttattttggtaacaatgtattcttataccacatttaagaggtttctctttcctgtggtcataaagtgattaaaaaaaaaaaagagaggagagagatgacatcctttttaataaggcatcccaagcagtctaagtacctatgaattataaatgaaaacttttcagtgattaaaataaatataccaatgcagtccccttctctgcgtcattgcttcgccaggcctgcatgaaaatcactcagaggaagtcccaaggggccctgagatcatttgcatctgttccatgtgtttctctgatttatatcagagtgcatcaagggcagtggccttccagctggtttgggaagagggattcttttatccagaggaggcatcagctgatggtcagttagggctctggagtgcagctccatgtaaacaactagcctttgtagtaatggccatataatataacctagtccatgttttgttccctcaagaaccaatttacaacatttaatgttcaaggatggttccattcctttctttgtttacacaggtgaggctttatttagtagtgggaagtgaagggcagatggtttaaggggttcttaatgctgcaggagaggcccataaactgaagtatccaagaaaatccattctaaataagaggcaaacagagtctcagatggatataaattagtattattcttaggaatccttccttcccatttctcagacttatagcaaagctcttactgatatcagtggccattgtgcaagtgggtagcagggaaatcaccctcaatgaccaaatggaagtacatgaggaaaaagatggagaatcctggataaagaagacaactggctgggctccatggctcacatctataatcccagcgctttgggaggctgatgcgggtggatcacttgatgttaggtgtttgagaccagcctgaccaacatgacaaaaccccatctctactaaaaataaaatacgtaaattagtcaggcgtggtggtgggcgtctgtaatcccagctgctcgggaggctgatgcaggagaatcgcttgaacccaagaggcagaggttgcagtgagccaagattgcaccactgcactccagcctgggcaacagagtgagactccatctcaaaaaaaaacacaaaaaactgtctttttctagccctatttatttcaccctacactccatttaccttttatttgttgttaattaaataacattaatttttgttgtaggattatacgtaagaaactattggccttttgctgattgtgctggaatttaaaagttgtagggattgtgggccattgttctaaaatggctcattttgccaaacatgattaatggcttttggggtgcagtttatgtcaaggcaaaattagtggacacttcagcaaactggaatgtggttctgagctaaggggatattcacttagccattcctagacctttcttctatcagaacacgtctttaaggttgaatatccaacattttcaaacattttagtcttaaattctacctttagagtattattgatggtctgattagataatgaaataaattttctctcagcaatgtctgtaataaaacataatgcaggaaagatagcatttaataaaatatttgtttaatgttaataatatttattaccatcagattagaatcaagttaacatcaaattagtaagagatatgtcagtcacaggacttgtagggatgcgagaaaaagaccaccagagaaactgaagaaacaactggaatcatctttgaagaatttcaaactcatcattgagacattggcgagactgggaaaattatttctgaatcttgaaagaatgatgccccaagaccagatcatttaaccattatgtgtctggagagccatcatgcttcctggtatatttactgtggaaaaccctgactctcaaaaattaaaggaaaattacaactgtaataaattggcctgaattgcatggattcataagaccactctctttccatttcttcctacttaatgttgttttcacatagtgatcacttagcagagtttgggaataataactggcaaaaaagctaaaattcttagtccctaaaggaaaagtttgcaaacttattatttaatgttttaaaacccctttcccccgatgaatgttaccctgtccctaggagaagcttctctttcatgagttcatagatcaacagtggaaagatgattgtatttttgagccttgaggttcaactttttctcttctaagtcttttattctgcaagagcccttttgaatgatttaaaatggcattctccatttattcgtatttatcgaaaatctatttggagcaaggtattacatttaaagacagagaagaaatggttcatccactcagctaatatttattgtgtgtacactatgtagctacaagctgggaacagagtggagagcaaaagaagacaccattcctgctcttctacagttgagtctggtagaggagacattcatgattcattttttttttttttttgaagcggtataaccacccagtgggttcacattgcctgctgccttcacagagccaatgtatcgagacaggggaattgcagtgaagaaagagtaattcacacagagccagctgtgcaggaatgagagttttattattactgaaatcagtctcctgaagcattcagggatcagagtttttaaagataatttggcaggtaggggctcaggaagcgaggagtgatgattggtcaggttggagatggaatcatagaggggtcgaagtgagtttttcttgctgtctatgttcctgggtggaatggcagaattggttgagccacattactggtctgggtggtgtcagctgatccatggagtgcagagtctgcaaaatatctcaagaactgatgttaggttttacaatagtgatgttatccccaggagcaatttggggaggttcagactcttggagccagaggctgcatgacccctaaactgtaatttctaatcttgtagctaatttgttagtactgcaaaggcagactggtccctaggcaagaagggggtctacgtgggaaagggctgctagcaattttgcttcagagtcaaaccatggacagaattccttcccaaagttagttcagcctacgcccaagaatgaacaaggacagcttaaaggatagaaacaagatggagtaggttaggtctgatttctttcaccatcataatttcctcagttaaaattttgtaaaggtggtttcaatggagcctcactctgttgcccaggttggagcgtactggttccatctcagcttactgcaacctctacctcctgggttcaagcgattcttgtgtctcagcctcccaagtaggtaggattacaggcatctgccaccacactgggctaatttttttgtggatttttagtagagatggggtttcaccatgttggccaggctgatctcaaacttctgacctcaagtgatccacctgccttggcctcccaaaatgctgggattacaggtgtgaaccaccacgcccagccatgaatctttagattactcaagtaaatgtaaaattataagtgtggtaaatgacaggagatgtatagtagaggaatctcatctgtctagggataaagggctcccctgtggaagtgatatttaagggaagattaaaggattaagaacaattaatttgggaagggatggtgtcttagtctgttctctgttacctgagactgagtaatttattttaaaaactcagaaatttattttttacggttccagaggctaagaagtccaaagttaatgggctgtcatttggcaagaaccttcttgctctatcatctcatggtggagggcaggaaagcaagagagcacacatgccacagagagcaacagagggccaaactcacttttataacaagcccagtcttatgatacaaacctactctcacaataatgacatcaatccattcatgagggctctgccctcatgacctaaccacctctaagttctacctctcaacactcttgcattgggggttaagtttccaactcatgaacttcagaggacacattcaaatcatagcattctgcctctggtattcaaaattcacattcttctcacatgtaaaatatatttatttcataccaattgctctaaaaatcttaactcattccaacatcagcttaaaagtccaaagtccatagtctcatctaaatcagatatgtgtgagactcaaggcatgattcaccctgaggcaaattcccctccagctgtgagcctgtgaaattaaacaatttatctatttttgatacaatggtgagacaggcataggatagccattcttattccaaaatggagaaataggcaagaaaaaaagagtaactagtcccaagtgagttcaaaacccaacaggaaaaacaacataaagtcgtaaatctggagaataatctccacacccttaatattgtctcccaaacatgcttttttcattctttacatggccaggctgaaaattttcaaaacttttactttcttcttcccttttagttacaaatttgtctttaaatcatttccttcttattttactgtaagtggctgaaagaagccatgcagcaccttcaactttgctacttaggcatttgctacttagcctagttcatcactcttaagttctgccttccataaagtcctaggacatagacacaattccaccaagtttgtaactgtatcacaaggatggcctttactccagtttccaatacactgttcctcagatccatctgagacttcatcaggatggccattactgtccatgtttctaccaacatactgatcatgacgtcttaagtaacctctaggaaatcccagtttctctgcagttcttttcttcctctgagttctcaccagaatcacccttaatgccccattcatgacaatctatgcttcttaaaatcttgctcctccaaattcttccagcctctacctattactaaattccaaagcttcttccgtgttttcaggtatttgttactgtaataaaccctcttctcgataccaattttttgtcttagtttattttgtgctgtttataacagaataccagagactgggtaatttataaagaaaagaaagccagcgtctggcaagaaccttcttgctgcatgatcctgtggcagaaggcagaagggcaagagaacatgtgcacaagagagaacaaaagagggccgaactcacttttataacaaaccactcttgcaataatgacattaatctattcatgagccctcatgacctaattgcctgttaaaggtcccacttcccaacactgttgcatggggattaggtttccagcacataaactttggagaacacattcaaatcgtagcacatggggtacagaattatattgcagatacagacagcagctcatgccaatgctgtgtggtaagagaaagcacagggctattgaaagaatgaacaagggtaagggcactggcacccagagggcaaggaagagtacaggtgggatgaatccagagtgggaggtggagactaccaccaggctatgcaggaccttataaccactttaaaaatttgagaagtctgggtgcagtggctcatgcctgtaatcccagcactttgggaggccaaggcgggcagatcacgaagtcaggagattgagaccatcctggctaacatggtgaaaccccatctctactaaaaatacaaaaaattagctgggcatggtggcaggcgtctgtagtcccagctattcaggagactaaggcaggagaatggcatgaacctgggaggcagagcttgcagtgagccgagattgcaccactgcactccagcctgggtgacagagcaagactccatctaaaaaaaaaaaaaaaaaaaaaaaaaattgagagataggagggtcacttgaggccaggagttcaagaccagcctgggcaacatagcaagaacccatctctacaaaaaaatagaaaaaaattatttgggtatggtgatgcaaacctgtagtctcagctactcaggaggctgagggtgggaagatcacttgtgtccatgagttcgaggctgcagtaagctggtattgtgccactgcactccagcctgggcaacagagtgagaccctgtcttttaaaaaaatgagggttttattcaaagaacaatggaaaatcattgatgggttttaagcagtaaacatgaagggaacacatttgtggtttgcaaagattgctttagtgcctttggagaggagtggtagtaagatcatccagggtgctattgttcccaggtgaaagatgcaataattcaggtggaccccttaaagaaagagatatggatgagttctagagatgtggaagaggcagaatcaatagaacttggtattgattgaatatggtgtgggggcagggttattagcatggcccctagatttctagcctgctgagtaggatgaatggtcacaccattcactgagatagaaagctgagataaaacaagatttaggaggaaagttgacttttactttggacaggttgaattcaaagtatagtatggtgtcataaagtaagctgttgttacatagcctaaaaatgagtggatttttaaaaggtcaagatgggcagaagtagagcattccagttatctaacattgcatgataaagtcccaacagttatggcttaaaacaacatttactgtgctcattaatctgaattttggcaaggcttggtggatagcttatctccgcaccacttggtgtcagctgggggagcctgaggctggggttggaatcataagacagcttgctcactcaaatgtatggcagttgatgctggctgttggccgaacttgagcaggggttgtggctggagcacctactcgtgtcctttacatgtggctgcttagcttcttcagagcttggtctgctgggtttcaaggtgagtgtcacaagaataaagtgagagccagacagagactatcacctttcatgacctcgcctcagaagtcatctagcatcacttccatggcattctgttcattagacatggcccagccatattcagggtaaggggaattagagttcactcttcaatggggggagtgttgaagaatttgacaacatgttttaaaaccaccacatggcggggcagagaagaaatcagttatcattccagctggaaggaacaggttgaaacgggaaggtagaaattatattcaatagaagtggagtggttgctgttggctggcctggagcatgtatgaagggttatgaacagtgtgaaatataggttaaaggaacgtttgggaccaaattatggtggagcccaaatttcctgaaacccattattttgaatctggaaacaaattgtcagagaggaatacaaatcagatttattaaataaagataaaaagtagaagcaaacagtgactggcatgggataggaataattctacttgctgataaaataattcatgccaattttggggtgtctagtctacagatttggggtcatatatctccaaatttaaattgtagacatattcaaatgtctttagttgggctttgtaccttatgccagtcaaaaacatgagtcaaaaaaatcatgcctgtatggttcccttcggaggtatctctcctttatcctttagcagattaagataagaatcttggtctttttgatcctggctgtggcttcaaatttttcccatcttactattgggctacccaaaaggactgcatcagacaagactggtgagttgaatagtgttcctcccaaattcacgtctacctggaacctcagaatgttactttatatggaaataggaactttgtagatgtaattagttaaggttcttgagatgaaatcatcctggatttagggtgggccctgaatccaattattgttgtcattaagaaattgagaaggcacagagacaaagcaaagaagcccatggggagatgcagaagctgaccttggagttatgcatctagaaccaaggaatgccaggagcaccagaagctggaagaggcaagaaaggattcttccctagagccttcagagggagcgtgaccctgtcaacaccttgattccagacttcgggcctctaaaactcagagagaataaatttctgttttaagccacgtagtttgtggcaacttcttatggcagtcctaggaaattatacacgaagttagagccaggcatgatgtattagtccattctcacactgctataaaaaattacctgagactgggtaatttgtaaagaaaagaggatccccaggctctatggaaagcatgcctggggagacttcaggaaacttacaatcatggcagaaggttaaggggaagcaggcacgtcttacatagcccaagcagaaggaagagaaattgctgcgaggtgctacatacttctaaacaaccagatctcgtaagaactcactcactgccaagagaacagcaagggggaaatccacccctaccacccagtcacctcccaccaggccctcctccacattgatccaatcacctcctaccaggcccctctttcaaccttggggattacaatttgacatgagatttgggtagggacgcaaatccaatccatgtcacgtggaaaatatgggtgttggtttgccagatgccaaacagaaacaacatttgatctgttgataattgtgtatcctctttatcaggtctatcttaaggaaatcagagagtagagcatattttcttcatggaatggtgagacacatattagcctgagacaggagctaaggagagtgagtggtgggctccaccaaagtgccttcatacaactacactggtaggtgatcagaacaaagggacacgtagaacgaagacccgggtgtgtaacccaaatgcctaacaaagtccattcaatgtatgaggtgttgctgctgtgtgctgaaggaggaaacctgggtcttagtctctgttatggtaaatagagaagaaatcaagccttcctacgacaataggggatttttaatgaagtaaaggagacagaagaaatgtcccaaaggagaatgaagtatgtcaaaaacagattgcgcatgtaattactttctcaggccttcctgacattatcagcaggacttgtgttttgatgaaaaaacttaattaaaacttaatttttttaagtggaaaatattcagcatggttacaggaagactgaaatcagggcactgtgtaattttaattgccttcgagagatgcacttcacgtgaagactagcatgggggaaaaaagctagaggcacaaagtctgaggggagtggccacgctgaatctctagctgtgtgcttgggcgccattttccccactcttacagttgacgggatggcatctcaggtttcacgtgtaggggaggagagtgggtctgttctggagtgtgccggtcaggccatacttggcatacacattgtagaaagtgtcttgatttttattctcctaaaaagggtaaaaagagattgaggagattacatatcccatgaggcagcagtttttaaatgccactctctggatcagttctatcagaaccatctggttctgattcatttaatctgttttaggacctgtgcacagtgtttctattttaaaaataaacctgtcctactcattcttggagtcaggtgtgggaactacaggtttttaatggaagaaacatgaacttgaaaatgagtaaatatgggctacgtcctttacttcccaaggagatttgggttgactgcttagtttcctccatcaaatggggataatatgcttatttgatggggttttgtgaaaataaaagataacacaggtaaagtgactgacacatacagttaagtggtctaaaaatgataaaactgtagaagaagagttggatcaggctgcttgctaaattgggaagggataaggtagtgttcttcagatatttcaagggcagctgcatgagagagagagagagagagagagagtgtgtgtgtgtgtgtgtgtgtgtgtgcgcatgcagcctttagaggtcagactcaagtccagcaggtagaagttatagggagataaatttcaacgcaacagaaagtggaactgtctagtgaatggtccagggatgtcatcagtttgctccagagggtagtacgttccaaatcactggagcaattaaagcagctgccatattttgaggatgtacagggctgtggggcagcaattgaatgagaccacttggttcagctctgtaatagggtttctggcttcctgtggggctgtggctgacatacagttgttttgtaaactaacaacacttgaagaaggttttagcagaaaacgtttaccagtaagatatgtcaggtcaagtacactgttttaggtattctttactggggacattcttgtgaccttcatcccaggcctttcagaaaagggatggggcatatttagaagttattaatgactgagaagctcctctggcacttcaggggagggaactagagctataaaatgtcctgtgattgttctaggactttctccttagtttagctaacatctgggtccttgtcacacggctatgaaatattaggcttacagacactttgaagggtgagaaaaatggaatttattgggtaaaaaggaaaaaaagggaaacagggatgctctgcagagccagattcctgctagtgtgcttcctgcctcacagactgaatcccaggtaccacccaggaagaggaggggccaggctcctccccactgcaaatggcatgaacttcccaagacccctcccccagtgtgcaggccacttggaggttctctggtgacccctttatatttggctgtctcattatgaatgggacaggagtgcgaaattatcccacttcaaatgtcacttgctctctgttgggaaaccctatacctcactgaagcccagatgatctccctgaaccagcctttgagggtcctttttggagccctttggaaacctggtattggatgggttgggttacagggctgctcagcctgacagcctcgcattatctggtgaccacagagtttaaagcagaacattgggaagaaggtagactgggccagttgcacaaagcagagtgtgaagagtgatgggagatgaaggctgtttgcctgcttttcactggggaccagatttggatggatgctggtccaatatgagtgacacagttaacttatcagtgagatccctcattcttctcatcagtgagatagctgggtattgggggaacctgcccccagtatttcaatgtaggttctttctattttccataatatcagctggctgagaaataaagagaaagagtacaaagagaggaattttacacctgggccgccgggggtgacatcacatatcggtaggaccttgatgcctgcccaagccttgaaaccagcaagtttttattaaggatttcaaaaggggagggggtgtacgaccagggagtaggtacaaagatcacatgcttcaaagggcaaaaggtagaacaaagatcatatgcttctggggaaacagaacaaagggcaaaaggcagaactcctgataagggtctatgttcagtggtgcacgtattatcttgataaacatcttaaacaacagaaaacagagttcgagagcagagaactggtctgaccaaaaatttaccagggtggagtttcccaatcctagtaagcctgaagttactgcaggagaccagggcgtatctcagtccttatctcaaccgcataggacagacattcccagagcggccgtttatagacctcgccccaggaatgcattcgtttcctagcgtattaatattaatattccttgctaggaaaataatttagtgatatctctcctacttgcacaaccgtttataggctctcggcaagaagaaaaatatgtctctttttgcctgaccccgcaggcagtcagaccttatggttgtcttcccttgttccctaaaagtcgctgttattctgttctttttcaaggtacactgatttcatattgttcaaacacacgttttacaatcaatttgtgcagttaacacaattatcacagtgatcctgaggtgatgtacctcctcagcttatgaagataacggtattaagagattaaagtaaagacaggtatgaattataaaagtattaatttgggaactgatacatgtccatattaaaatgaaatcttcacaatttatgttcctctgctgtggctccagccagtccctctgtttggggggggtccctgacttccaacagctggggaccacttaatcagggtaagggcagtagtttgtgttcacagtttgatctccctgcatggtgctaaccaggctgcatggggatctaatgtctgactttggccacggcatcaggctccagccaactgacgtgaaagcaagtttccaaatcgtctctttctaaatagataaatgatactcagtgttcctttagccttccttattttttgcaaatgcctgtccccagtggttctgttgtttgctctgattgccgttttccccagtaagtgggaaaaccccacatcttttccccatcagtattccctaatgaggcttgttccctcaaggggaccttgatgagttacaacagcatgaccatgttcccaagcagcatgctaagaaaaacaatccccagtgatgccctgcaggcaccatttaggagcgggcggtaatgaatccctgagagaattcagtcctccgtatgaaggtgatccagagtgaagtaaacaatttcaccgttaggtggttcaccctgcatgcctcattgctggctttctggaaagccagtaaataaggcagaaaaaatgtatcattccctccagagtgcagggtcccctgtcacccacacaggactcctgcctgtcactttgagtcacagctgggctttctggaacccggattcttgtctctggttagctcaggtcttgcagccatgccaaatccaaactgtgacattgtctgaacagtagggcatcctgttccctggtttggctgagctctgcggagcagaacagtggccgaggttaacatcagataatttcctccaccattcctgagtaccctgagggcttgttacctggaatcaaagacttgtcagaactcaagatgaccttaaaggccagcttattcaacctcccacccaggatatgacttccagaactaaccacccacaatgcagattagtaatatcatacgtggttactcaatgcaattgtgtcatttcaggagaaatgacctgttaccaaagtgtcatgaaacccacattaatgagctgggctgtagtggaggtttactttgatttctgaccttaattattagtggtttggattctttacgtttatgatggattttctgattaccaattatgattcactgtaagccatttttaaaaatatgacatgaagctctgacccacttttaacaacacagtggcaaatgccaaacaattggcaatttccccttctaatatcagctgtttgaatcatcacatctactgtggtggctggggaccactttatcttcattctctggcttcagtattcttttctggtattgtcattactgacctaggtgcatatctgtactaggctgggacctcagctctatgccagtgagaaaatgaggttcaactgggaaaacggcctggagcagttgctctcaggcttgtctgcagattagaatcacctgtagacttttaaaaaatactgacacttgggttccgctcttggaaattctaatggatctggggtgcagcctgggcatctggaattttacagtctacctgagtaattccaatgagcaggtgggtggccttgcaaaccggggtctgaaggggctggtcagcaaggagtatgggcaaaatagtgctggctggctgggcgcagtggcttacgcctgtgatcccagcatttgggaggctgaggcaggaggatcatgaggtcaagagttcgagaacagcctggccaacatggtgaaaccttgtctctactaaagatacaaaaaattagctgggcgtggtggcacgggcctgtaatcccagctacttgggaagctgaggcaggagaatcacttgaacccaggaggcagaggttgcagtgagccaagatcccacttggctgccactgcactccagcctgggtgacagggtgagactccatctcaaaaaaaaaaaaaaaaaaaaaaaaatagtggtggccaaggggtgtttataaaacagagttgtgatacatgttcatacattcacctttgaggtctgatttggtggtagcaggagtttcaggggaaatgtttactgatcaggttgatgagtgtccagggacaagatgtgtctgctaagagttagattgatggcaaagattgggcagattgatagttctctagcaaataagatgagatctgctatttcagcaggaaacaagtaaggaagttgaacaaaaagctagtggtatgggccatgtccacaagctgtggttaaaggcaaaggctgaagcctgattggcgtgcccacactgggctgggcactgtcagggacagccaggctgactccagagcctgccttctggttggcttctcccggcttaagtctggccctgcaggaaaaccgacaggagttttcatgccaaccaagactgagacaatcagagactggcaggtttggaaccaggaggtctggatggggaggttggctctgaatctgttgtcattatcaggtgagtcattaggaccacctggaaaagtgaagctgttcttcaccttctcttcttgtgaaagtgattcaatctcccaaacccaggttgatcataccctttaggtctaatataggaagtgttgaattaggtgatgtctctaaagaactctctctgggttccttagagaaaaatagcatttgaacattgtgcctcagcaggaaagaagatgcaatttaagtcctgcaccaaggcattcagggctcacctcaaagtggactcctaggaacaagaagcaaatgattccgtggagagggttagatgtctggccaatggaaacggggatgtagttcaggttttctagccccagaagttcagaacctttgggttcctcggtggacatgtctgttactcgcttgaaactagggaaagtctcttgtgtagaaaacctgttgcatgtcccttgactaccagtagcagcagaggtgctatgtgtggctgaagaattttcctcctttttctgagagatgatttcccaggtttccttctccacaattctgtgggcgtgtactgctgtgataagatgtttgttctctggcttataaattacaagatattttcaggaccacttggaagaaattggaacattttcctggaggcagtgggggagctgctggaggttttcggacaggcgggccacatgctgagagaggtattttgggaaaatgcacttggcagtcatgtgtgggtgaggataataatattaatacttaaccactggcttgttgggaagagtaaggggaacaatgtaagtgagtgtaaagatgcaggaccaccattcctttgttcattctttttttttctttttctttttttatactttacattctgggatacatgtgcagaacgtgcaggtttgttacataggtatacatgtgccatggtggtttgctgcacccatcaacctgccatctacattaggtatttctcctaatgctatccctcccttagccccgcactttgtccattcttttagtttctctgagacctggtgccccaaggataccatcttctcctgaccagtgtatcagtttgcgagagttgccataaaaaaatagcacagactgggtggcttcaacaacagaaatatattttctcatagttctgtaggtgggaagcctgagaatgaaaggcatcggtagggctggtccctcctcagggccgcgagggcagggtctattccaggccttcctccttggcttgtagatggtcaccctcttccctgtctcttcatgtcatcatctctctttgtgtccgaatttcttcttctcgtgaggacaccagtcatattggattagggcccaccctaatgactgcattttaacttaattacctctgaaaagatcctgtctccaaagatggtcatatgtgagatactggggttaggacttccacatataattttttgaggggatacaattcagtccataacagccagtctttttgaagactttctcttttgggggctttacacttaggtaattacaggatattttaaggggtatttcaagacccagcaacccccttctccacccaccatctcccccaaattatgttcgtcacctcctggtacctgttatatcatcactagaattgcttggttgaatcaagtaatgtttcaagataatttccgtaaacatgcactctttttatgtaagaggggtaataatagagccagtgaaatactggatgaattcatttaccaaactacgtaaaagtactgatatatgacaactacttagggaacctaagatttgggacatagagcagcctatttagaatatccggtataacattgcagggaatagcaagggctctagagctttccgcctgggttgaaatctcagctccacccttttctttctgtgtggcattcagcaagttacttaacccacctgtgattcttccttcatctgaacaagcagcataacaatagcatttacctcatgattctttagaaggtgaatgagctaatacctaatatagtgcttagagtagtgtcttgtctgtggttggctttcaataaatgttagctgctattgttgttgttaaactatttaacaaactacgaagcacattcctatctgctttcttctttgcccttgtaacagccctgtggagtagaaggagttagttacattttacagatgaagagactgaggctctaagacattatgcgaaccatctcagggcatatggcagtgttattcagaacatctatcggtaaagaacaagaattccaaaaatataggattttccccaggaaggagggccagagtgtgggctactgtgggatggcctccgggcagagtgtgagggtaggcgctccaaagagtaaggcatctggagaagagaaacaatgaaagaggcaaacgctggatgagaaggacctcaaagcagaactttgcctctcggcctctcagtcaattgtgatctgactgacatccagattgtgatcttgttcaggtggctgaactttgaacccttcttggccatttgatgctaaaggcagtctttgaatgtgatgttttcctagatcgtactggtggaatttagttgcctcagatttcccagtcatgtgccagcactgccaagtgatctccatgtgtgggttttatgatgtgtttccagtgctccacatatggcctgtgatttttttttcctatggctcctaatgaaacactcagaacactgcactgaatagaagtttctccctattctccagagtggggatccttattgcatcgtcaagcatggacaccaaaaataaatggggagaaatctctattctcttagtgatgaggcactcttggaggaagatattattaacatgactacgtcttgccaatttgaaactttgcaaatatctgtaaggttgaccagtttttataatttcaagattttaagttcaacttaaggtactttacaaaattatttttatcataataaattacagttctttacacctgtgtcttttaccgattagattgtgagctactttatgggtgagcaccagtatctacttaactttgtactaaatggctcaatattgcctggaaaatagtaggtgcccaataaatagtaaatgttgttcgatcaaatcataaatgtagatataagctaaacctcttccctgggcaactggaaatgcccatgttatgtcttaaaacacattgaattcaggtgggagaataaaaatgattttaacaaatccagtgtgctttttgaaggcagaactacaattacttcttttttccctcataatcaaatcaacctgtgaaattggaagccaataaatatgtaaaaaagtcatcaaatgtcataggagaggactactatttgattcacacgtgatctttgtcgtttaattgcgtgtggcaagaatgaatggaagtgatattaagtggagaaaaactcagtcccattggtgagttatttaccttgaccactgtgatgggctgaattgtgttcccctaaaattcctatgttgaagtcctaacccccagtatctcagaatgtgactgtatttggagatacagtctttcaaaaggtgattaagttaaagtgaaaatgaggcctttgggatgggtcctaatccaatatggttgttgtctttacaagaagaaaacatttggccacatggagagatacaagggatgcacatgcatggaggaaagaacatgtgaagacatttacaagccataaaaagagccctttcagagactaaccgtgctgacaccttgactttgaacttccagccctccaggactgtgagaaaataaatttctgttgcttaagtcacacagtctgtggtattttattatgatagccctaccaaactaatacaaccacctactttttagaatttgtagaatccaagcacttaagattacaaaaatgcatgtttattgtggcactattcacaatagtgaagacttggaaccaatccaaatgcacatcaatgatagactggataaagaaaatgtggcacatatacaccatggaatgctatgcagccataaaagaggatgagttcgtgtcctttgcagagacttggatgaagctggaaaccatcattctcagcaaactaacacgagaacagaaaaccaaacaccgcatgttctcactcataagttgaacaatgagaacacatgagcacaaggaggggaacatcacataccagggcctgttgggggctggggagctacaggagggatagcattagaagaaatacctaatgtagatgacgggttgatgggtgcaccaaaccaccatggcacgtgtatacctatgtaagaaacctgcatgttctgcacatgtatcccagaactttaaagtataataataaaaaaaagcaataaagaggaggtgatggtaataggcacagacttttgcttgcgttgaggaaatattctaagtttcacaatggggtgtggaagaatctgtgcgaatctccttctgacctctcgtggtaccatttcctcattactcagtgatgaccccagagccagtcttggatgaggcggggtggaattttccacacaggtgccatgagctagggggctcaaaacagacactgtggtgaggttattactgaaatattctgtttctatgaagtttctaacgtaattctgggccctctttctacaaccttagcaagttgctgaactacaggagtgcggagtaacaatgcctttcatgtcaattctgtttacagccaggcttgcttgcattaaactggacacatccatcaactagagtgctggataacagatgagaaaaagctaagtttgagttgtcttttatattgtataatggtgcttctattttctttgttttcttcttgttcttaagttctgtgggaaacccacgggaagaggagtctatccagggtatttgacttcaaatcatttcatctcttctgttcttcctctcatctagtcctctgtgttcttgtaatatacgcaagggcaagattaatagtagaacagaattctgctatgaaatttaagtgatgtgaattctttctcaaaattccaagaatgaaaactttgactatgatatagccaataatttgcacttgtttgcatttgacattgctcatttacattaactagcgtaaaatacctaattagtacagcagaaaaaaaaaaactatatgaggaaaaaaagaaatgattgctcttttactcactggagggaaaggttggatttatttcagctctgtgtttagaaaaatacctttgctgggcttcttggagtgtgaaaagagtggaccctgacccacctctattccctgctgggccatctggaaggattttcacaacaaagataaggctaaaccactctgcaaaatgaaaccagaggaatttcatgagttctggggagtagaaagaagtagggtgagctctgacaaggatgatggggttgggcatgtgatgtctggagttggggctaaggaggccagtccaggagatggtccctgaggtaggatgggagtggggccaggcaactgtaagacagcgatgtctcatgttattgagctttgctatttcgtaacctctatctgccacactttctaaaacctttgcataactactgggtatctaccgagaggaaaagaagtcattatacgaaaaagatacttgtatatgcatatttatggcagcacaattcgcaattgcaaaaatatgtaaccagtccaaatgcccatcaatcaatgagtggataaagacactgtgagatacacatatatatatacacacacacacatatatatacatatacatatgtgtgtatatatatatgatggaacaccacacagccataaaaaggaatgaataatggcatttgcagcaacctggatggaactggagaccattattctaagtgaagtaactcaggaatggaaacccaaacatcatatgttctcactcataagtgggagctaagctatgaggatgcaaaggcataagaataatacaatgaacttcggggacttgggagaaagaatgggaggtgggtgaggaataaaagactacaaattgggttcagtgtatactgctcaggtgatggatgcaccacggtctcacaaatcaccactaaaatacttactcatgtaaccaaataccacctgtttcccaaaaaccaatggaaataaaaaattaaaaaataataaaaataaaataaaatctttataagactactgtacctgttagagcctcctttctgggaaattaaaactctaattgtttccacattagcttatgaggtggttggtaaaagagaatgactacaggaaatgaaatgccaatgaggttgataattcagtgggaccaacaagtcacagtcaaccagtgatggagatggtaaacctactaggaatccacagaaattttgaggcaggtaccggactctcaagagtgtgtgagattggtgaggctttggcctgagccattgaaaataaatgcataaatagcaacacttagcagaccggaaaacatgggggaaaacccagacaagagacacttgggatttgtcagtaaaaaatggagttgtgaggctgggtgcagtggctcacgcctgtaatcccagtactttgggaggctgaggtgggcggatcacgaggtcaggcgttcgagaccagcctggccaacgtggtgaaaccccatctccactaaaaatacaaaaattagccaggtgtggtggcactcacctgtaatcgcaactactcaggaggctgaggtaggagaatcacttgaatctgggaggcaatggttgcagtgagccaagattgcaccactgcactccagcctgggcaacagagtgagactccatctcaaaaaaaaaaaaaaaaatgcagttgtggaagctttgaaatccctgctgtgaggttatggaaggagaatgtttctgttcaagtatgaatcttttttgggaggggtggcaagaggaaggtatgcaaagggaatggtgaataaaatgaaaaggttcgactttttggtggttagtcacctaagaaggttttgtgggggaaataatgtgttttagccagcaaggggattgtttaacctgccctctaccagtctgccgtgcctcacccacttgtctacagctgtcctgttagttgtagcattttgttttcttttatgcaaagggattttcttatgacactcaaggagaacccaggagagggaaggcatctctgccttccagggacaaagtttcagaactgtactgctctacagtggtaaaaagacaacaaagtctttgatttgcaggttgcttgtttcacttaccctgtgaagtggagctcagttggaatatttcatctggccactctttagatgttcacggcagccctgcctggccagccatgaggtcgggcggagaaaggaagcaaggatgagtgaggagggagagaaatggccctggagtttgttgttggagatcttctctgtgtcaaacatcttaagggaatcacctcatggaatcttcgccacaacccattgatatggggattattttccattttataatgaggaaatgaaaccttagaataacagcaagaagctcagacaactatgaagtggcagggtgcagttatgtgactcaaaaccagtgttattttcagaagtgggaaatgtcatgactttgccctcccctccccttctctctcttccttcctttttgttggctatcttgagctgaatggtgataacgcttaactagtggaggtacattttgaataaacagcgactgacttaaatttataatcataattttattctagagttttaacaaatggtaaaacatttagagttatttttccgcagacttgacaaaggtgatgcctgactgtgcctgccgtcatttttttctatttataaaatcagggtaaatttgcaaacttctaaagaagcagacatggcttcagcaaccagtcagggtggaggtgagaccaggaaggttggagctcatgaaaggtcctcctcttctgtctaaggggcacttacttcattggtagctcagctgatactttgggaattccaagaaagagccaggaaccctgctaggaatagagaagcaaagaatccagggctctcactttgaattgctcaccacgtctagaacatgagtcaggcacagacacagaaaagtcagcataatgcgtatgtgcagtgattatgagatgcccatgcagcgtctttacaccagccagggatgcaaggaagaatctccggagaacatctacccaacaggtggatttgcttgtggggaacagaatctgtcaaggagaaacaaagcagtgcagtagttgcatcatcatgaggaaggatgatgtgcagagttagtttcctaagtggcatcgcctataatgagcagcgtgttctcctaccaccttagctgcaagcagttatgctgtatagccaacatctttctcctagctcacaattcaaaagcacattgctgggattccttgggggctttgcgtttatttgttgtggtctagtggtttattctggcaaaatacactgcatggatttttacagtttgctttgtgcttggacatctttccacccaagcaaaatgtttacaaatgccagcacgtcgttttctgaaaatattgctgaaaagaacaaatgtgttgtgatgtgccatgtgtttgaagagaccaggcaaccaaacactaagattgcctcttcctgtcagtgtttttgctcggaatcattctttattgtgcctgtttctccagaactctgtaatccaaaatggtcctgttctctgtggacatgtgtttattctgcaagttaaaaccctttcaagcaattcttgctgtgttaaatataacaatgcactgataaaattctgtcatacattctagaaaatacctttgtataaagtactcatattactgaatttaccaaaacagcataggtaacagattctaagatatcttagagttaattgataatatgtatctgaatgttgtaaaatttatctttcctatgcaaatcccttcaaaccatcccttctagtcccatttttgagacacacacacacacacacacacacacacacacacacacacacacagactgactttgttattccttactggtttttactgatggtcatagacgtctttcttctctgctacttccattatcttcctgccttcaaaatctccactttagttgcagttttgttttactatatttcttatttttaaaaatatataggtaaatagaaattgaaaagctcccattttttgttagattcatgaattcctttatgtaattatttttccaaaattaatcctgaatacagactagtaaatttatatgacaaagaaaatttctatgacaaagcaaaattaatgctgaatacagactagaacatttatatgacaaagaaaatagggaactgtgttgtttcacatactcaggagcttctgaattcaggaattttctagatggagaagatctcattatatggtgacaccagctagccaggtgtactactgaggtctgtctgtgttagactttagaaatagaccaaggatggagggaggtttgagaaatctaagtaaggaagcataggagaccttcttgtttgaggtcaaagaataattggaaggagtggttccatctcacaatttgaaaatgttctaaggaacaaaacgtacttttttatagacctattgatctcagaagatataacacagctggtggagggtaatgatcaatcgccagactaccaccattctattttcttctctgtcaaacgtactcactatattgtgagtgttttcactgcctaatttttcatggcaatttttgaggactggtagctgaactaatttaattctcattctctcacttgttcaccaaatcatttcatgtgtgtttttgccaggtattgttttaaatattgggcactattttcggttcagtaattcaacctattttaatcccttactagcccagttgtaaatttcaaataagtcattttttttcataccagttccctgctttcgagtctctgatgaggctacgctcaagtattacccaggattaggtcctatctgaaagctcaactggggaaggatccacatttgagcttgtttatgcagttgttggtagaattcagttcccttaggacggttggactggggggcctcagctcctagctgactgtgggccagagatcacccttggttccttgacagatgggcctgcccattagggcaaattgaagcatctaagtcagtgagggagagactctactggcaagacagaagtcacaattatatataatggaatcactgaagtgacatctcattatctttgtcatattccattggttagaagcaagttacagcacccacccacatacattcaggagggtgtgtattacacaagcacgtaaacaccaagagatgggatctttggagaccatcatagactctttcctccataccatctgaacatttaatattaatgtagtctgtatttctacataacagttctctgaaaggaaactttgctgtgtgccagataatactttttgatcttcttattttacctttccttaccccacccatgattattactatcaaagctttagggcataacatagtgctaaaatagaacacttactccaaaaatttaattaacaagcaacatgaaataaaaggccatttgcatattgtaggcaaataaaaacattatcaccaggagaagtgagtcagaatatatcaaatataatagctaatattaaatagctgggggtgagagttggaataatgagcagcctctgtacagagggcatgtcaatcaattactctggccctattggagcacctgcctagaagtccttgctgtgcctggttaacccatcagttgctgaatagtggggaggtctctggtggggattctgggaagaggggctgagcagtaattgcggagaaccctaggggatcccagcagtcactatttactaagacatttttattacctaatactctatggctaaatagttaaaagaattaaaaattctcaaatgctttcaaggttggagccagttcatggggtcaggagagctatctccaggcctgcattctactccccttctttttccatccctgccccatccctttcaggcagcacctggtgcacactcaggtgacccagcctacatgtcgaggatccacgtaaacacccctcaaacagatggtcccccgcaggcctcggaatgtggcaaggtctaccattaggaatgtaggctcaggaaaggctccttcaggccctgagagtggacgtggaatcctgatggcggggaatcccagggtcctgtgacccagagcatggtctagaactgtgctgggcagcacagcagccgcacattggctccagagcactggtcgagatgttccttaaatgtaaagtacacaaccaatttcgaagacttaatacaaaaaataaagggcgtaagatatctcatcaataatttttatgttgattatgtgctgacacggtagtgttttggatatactattgggttaaataaaatatataattaaattagttctaactgtttttttctaatatagctactaacaagtttaaagttctatgtgtagcttccatttgtggctcccataacatttctgtggaacagcactgctctagaagggagaagtacggctctgctaggacacatctcctgctaccttggaccccttgccctgtgaggaggaggagctagagcagagccctctaaagcgtggagtcccaggcaggagcctttcttgccccagggtggttttgctttaaggtgatatttatagtctatttggtctcactctgtcatggctaaatgactccaaatctctctcctttgcctacttctgggttttgcccaaggcaagaaaatagtcttcctcaccttccacctgcccacccccactgccactgccaccaccaccgcttttgaatcaatataaccaggcacagaaagtaaaattgttctgtattgacatgtatctttcaagaagctgttattctttgggtgaaacagaatctaatcactaagcaatttttctacagagagagggagacttttcactccccttccccttggtttgtagagtacattcatctttgataattgattcttcgggtggagtaatgatgtaggctcaggaatacgttttttgattcaaagggtataaaaagtgctatgtgtgttaggggttaatgtaagctctgtggaattacaatacggatgtcttctaaagaaaattcactaatctaatctctagagaaggaaacttttagagagtcccttatgactcccttaagaaattattgtggatagtatgttgctgtatgatggctttaagaatttatggtgaatgcttcagaccatggctttagtgtttcaacagaaacagtggcttacttagggtggtggtgcatcttgctcttgaataaatctgatctgagcttacaagtaggaaggagtaatgatttagatgtctgaaatctctttagtttattgtttcttttcttatcgtggcagagagtgactgttaaaactttttcctcctgggcacgtagctggcctacatttcccagcatcccttacagatggctgtggccatgtgactgagactggccaatgggatgctagtggaggtgatatattcttgtccaatcatctactctttctccttttcttctgcctatgagatgcagagtataggggcacatgggcaccacctgagaactctttaggaatgcagaatctttaaccttctcctaggtgtagggaatcagaatctgcattttaccaagattcccaggtaatacctatgctcattaacatttgagaaatattgccctttgagatgacagagccagtagatggaaagatcttgggtccctgccttgtggcttagaggagagccacccaggagtgtggcttcttgaagcagcctgtttagattggtacataaacaggaagtccaattttatcatgatgaggtcactgagattttggagttgtttgttatagcagttagtcttccctggataatatactcacaaagtatttaaacaatgccatgtacctacaatgtatccccttcttaccaataaattctgccaaccaaaatgatcatattgtacctacaatgtccaaaatgtttaatacagactgaggtagaccttataaatggtattggtgaagcctagtggacaattttaagaaatcaccaacattacaaaacgttgactggcaaacttgcgttcaccctatatatgctctgtaaatgttcctagctccctcacttttttgtctttttcttcttcaacggcctccttcacttttcagtagcagcaagattaagaggtgaaaactgccattactccagtgaatgggtgaggtcactgatttgcacaattcctatgagagcccaattaaaagaagatacagagataagcatgtacgttttcatctctcttaactccattatcttattgtcatttggctatgatttatttaggtcaacattgatttctgtagcttatttagatagctagaatgataaaaatatctttttgttatcacaaggagtacaattatttacatatttacctattcatccattcattcttagtatacagaacagtccaatcaggaacaatctgtagtacctatgacaggtacagaaaagcccttaaagattagcctctaaggtgttaatgggagagatttactgatttatatttttccctatggatctggagatacagggtattaacaagatggatgagttattgggggtgcatttgtatgtctcagggtgcatgctgtctctgataattgctgtctgtgtttgattgggcagagccagtatcttaaaaccttcactagaatttcctatattgagacatctaaagttaagaaatctaggtaatttttgcttatcggtttaaattgtgcatagaactaaattattaaataaccagcatgtctaagccttacccttttctttaattacacacatatccatgcatgcacacacatacatgcacacacatacatgcacacgtgctgaggaggaaaaaaaagctgaagggattttgtctgtgcatacatgcgtacatatgcacagacacacacaagaggcacatgtacacatgtatggacctgtgcatgaacacacaaatcccatcaacttctttttttcagccagtcattatagagaggaatgacagcttttatttgctgcaaaaattcaagtggaagaacgtcatatacaagaactaccagcctagtggtagagaaaagaggattctttgaagctctttttagtcagtctgtactagcaatagtccagtgtttcccaacttgagggtgccctcaaggcgttgaaaacataaggtaccactgtgatcgaggttttaccaaattttaactttccttcacttctcacctaaaatatcttgagggtgatctgtgctcagatttgttttaagggttggggggagtattcaccttctgaagtaaaagaaggaacaatttgtcctctgtctggcttctatcatgaaacttcataacccaagagcacatcttgacttcagctttgttatttttagtggtagaggagaggaaacagtaatctgcaaagtgtgagttcaattaccctgacctttcatattgaaatctgaattcttaataagtgttttatgtgcattttatcatttaacccttacaacaaccctatgagataggtagtgttattataccactttgctgaggaggcaactgagacacagaaattaagtaacttgcccagcatttcttgggattctaacctaggccatctggctccagaagctgaactcttaaccacactgctctcctgcagggtcgatgagcttgccatgcctcttggtcattccctaaggtgtggcattttgtgattcgggatctggctaactcatttaaatatggaagtttcacaaagattcaggctgctcagggatacaaaatggctcattggcagggtggggcttccaaggaaatcgatttcattcctttcctaatgggctgcgctagtttgcaaaaatcaagaactgtgacgatttaagatgcatctgaactcttttagatttccatagaacctcactcagcagtcctttcgagatgatgtcatagttcttttgtgtaatctagtaatgccttttaggggaggaagccggtgtattttacaaatgttatcttatccttacaacacccttgaagcttagtaagtgatattagttactgtttgggggattacaaaaattaggttgtggtttttaatgtttatttttatagcaatgagaagtggtacacacacacccatacttatatgcatatttgtaaacatgtgttatgtatattattatatacacgtatgcatcctccccccagcattgatgtgtgtaattcaggtggtatttggttgactccctcctaatattttgcaactgccactaattgtgatggttgttgcactttaaaatgttaaacttttagaatatgtgagaagtgagcaatttggcattggatctagcactgtgtcctcaagtccctttcatgtgctcagtggatttttattgagtgccaattgtgtgccaggcagtggcattacaacagtgaccgaaacaaagtcactccacttgaggacctgaatgtctagtcaaggagctagagagaaaacaaatatatcctctgtcaggtgggggtaaagcgcttctgatgacaaataatgttggctgagctatggtgacatttcagcagaggactgcacgagctctcccaggcttttcttgctctaaagcagtagttctgaaccaggggtgagtttgcagtaactggagatatttttctgccctacctggggcagggctgctgccaggatttcccattcagagtgatttgagaggatctcagtccacctgtaaagaggaaaataccctcttagatttgtagggccacagcctcttttgctgtgcctggaacatactggcagacacctttcctgctggggattttgcaaaatctggggacgtttttggtggttatgcttcggggaagggtgctgctagcatctagtgtgtgaggctggaagtgctgctaacatcctgcagtgtacagggcagctgcccacaacagaatgatctggctcagaatgtcagtagtgccaaagtggataaacctctagaaccacactccccaggggttcagtagactttcccgagtgggcatggaaaggtaaactcaactccctttctgcacgacccctttttctggcccatgagagcctatgctgtggccagtcgctgtgacagaatggttttctgcagggcatccatgctcacagcaggatcagatgccatcttcatgctttgacttgccaaggacattcaccaataaaatgcgcgttcagggagacagctgtcatgacacaacacgtttttcccatgacacacatttcttccgtccctctccaataacctcgactcttgaatgggtgagggacatttcctcaagagctgtttatctgggctttggggctgtcttgtgaattctatttaaaaatactcaaagtccctgagatctttggatctaaataacatactggaaccttcccgtcccctcctctccttggggctatggtaccaacagaagatgaaagctttatttcattttcaaaagtattttatatttctttattttgtaccctcttgataattgatcctcagctgccaggatttcccattcagagtgattcgagaggatgcccaggccacctgtaaagaggataatacactcttagatgtgtagggacacagcctcttatgctgtgcctggaacacactggcagacccctttcctgctccgagtatgcggtaagggggcaagaagctgtatggtggcttctccctggagaagcagcttcagccccttgtgctcctgcactcctgtgctttaagggcgagaacacattggattctttttttttgaggtggggtttcactcttgttgcccaggctcaagtgcaaggcacgatctcagctcactgcgacctctgcctcccaggttcaagcaattctcctgcctcagcctcctgagtagctgggattacaggcataggccaccatgcccagctaattttgtagagatggggtttctccatgttggtcaggctggtctcgaactcctgacctcaggtgatctgcccgccttggccacccaaagtgctgggattacagttatgagccactgcgcccggtgaccacatctgatgctgaaccaaaggcagctcttgggaggtggctctgagcctcccagccgcaaggtaggggagctcaaagatgttttaggagtaagcttgacaagagggtatcaggaaaaattgtttttctttgaatctccccggaatatatcatgtaattcacctcttgaggggtcctagaaagaccacttgccatcccaatatctagccagtcctggagtggacccagtcagagtgcatgaactgtgatacaaggcctatgtcttggtttttttcacctcctgcaagctaggagcctcccaactacccacagattggaagggacttggtgcagggatatggcttcgggtgacaacccacctatcagagctattcaaccattgaacagcatggctgtcagtctgaggtcgcagtgatgtcaggaggtggcagttttggcagctgacagccctcacagatgcccttgtgcagaatgaacctatcaagcattttctctactggctatgaaatggaaagtgaggcaagacattcagttgctgcacaggaaggaaagcagtcagggtggttgcctgagcgtccaggtcccagacaggtctgttctccatggaatacattaagggattgatttacctgtcttggagctgcttcacattgcagtagagggactgtgccgagtgtcatgcaatggccagttatcttgcagaacttgtttgtttctgcaattattaaaagttttcctggcagtttttttgttttgaccgagagtctttcctccaaaaatcattctctccatcctctcagaaccctggataattctctcctgtttgtcgtttgcataccatgtacctggaactcttatgttctggttaagtattctagcataagagagaggaagcaaaataagtcagcagaggatactttcagcatactgtgacttttagaatgttcagttagtgatactaacgtttcatagcctgtaccaataatcaacttttctttcccctgaagacaaagtagcatggttgtgacctatctatactgacttgttttcttcatgcatgcattcaacaaatcttaattgagtgcatgttatgttctaggcgtggggctgggctgaccctctgggaaatgacaagatgaaatgagacacattcctcctttcaagaaagtttgtgtggaatgtagaagatcattcattggttgaggagattgtaaactatcctggaacacagtggtttaggatgaaacaaagcagtgcacaaatgaacgctctagtcagtgaggctccattagaggttcctcaagggtggggactgcgttgagtgtcacgagactcctagggtcagcacagtgcccagcggctggtacgtgctttctaagtatcagctgaaatgctacagcagcacggcctagtggggagggagagagaaagggaggaagagaggggaagggattgaggaaactgacctagattatgggcagtgctggtcccccactctcagcccatgtggcttgggagaatgagcctgtctcttgatgctgtgaactatcaccaagagatcccctaccttgctccccaagttcaccaccaggcttctctccatctcagagcttattgaaaggacatggaatcctctggagggagttctccattgaaaacaaagacaataaattccaagtggcaaatctcataggtggccctgagtccctgtgatttttccagtccaccccttagttgaagtaaggcaaaatttgttttggggtttcataacagtgatgtaagtgcattgctttgaagcagtttttgagggagaggggaaaagcctgagttttggagaactacatttgtggaacccaagaaagtgatacatcttccctcctcccacccctcattgggggagatgacatggggcatacttccctatgtgctttagggggtctctacagaaagggggaaatgggattttgctccttgagtttgctgagggtaggacctgcagacttgctgtggtgccttcagagcaagagggaaagaacacagaaatagataccaccaaaagggatgaggatttcagatggcacacagagcctgctgagcgcatagccatgcaccgctgtgctgtgccttttcctctgacatccctttgcccacatataggagacaatccccttacaaagagccaagagcaagcctgaaggcttctgggagtccagtcggcttggaagtgagggaggaagctgggaaagagtgagcttaggtccgtgaacagtgatgagttcatgaaaatatttgaatctacctgaatagaaagattattttaaactagggaaaatttattttaaactggaagaggctgaaaatataaagtccactaatcttgtctgtctccatgagcttttacacatacgcacatgtgcacacacacgctcgcccatgtaatgttcacttaggtcaagatacagaccaacccaccaccccagaaggagctcttgtgcccctttccaatctctccccaagataaccattattctgacttccatcaattaatcaattttgcctattctttaacttaacataaatgaaatgatatgtgtacttttttgtgtctgactttcttctcctcaatataacgtttatgaaatttatccaagattttgcatgtatcatttttttaatgctgtgtataattccacagcatgaataaaccacaatttgtttatccattcacctgttgatggaaatttgagttatttctaatttttgtttttttcaaatgaaactgccgtgaacatcttgtgcatatcttttggtggacataggcacccatgtctctcagatggataagattcgaattataggttccataggccacatataggtaggcctatttgtatctttatatttgatttgttctattcttctgcccatgacaaaggtagtaaacagggtgtctttgagcagggaggctgaaaatgctctcttgtgagcagggtaagtagatggcttgtgctggtgcagaaaggcaggatgctggagaaatcccaggggaagcatggcaccagtccaaccagagactagggaagactcattaagaataactttttactacatgtaggtccagggaaagctgacatgggaataatgattaaaaggaatcaagtaaaggggcagagaggtagatttaagtaatggaaagatttttggtctgctttctagttttgtcctctagcacaatacgaaataattggctgtgggtatattacaggatcccttagatcttattgtctcatttataaaatataaaggctgtacagggtagttcctaaatggcctttgagctttcatcttctcataattgcatcaataatggcttagttgtaaatgaccaattctagtaataggagaaaatcgcatggaaattactgagaaaagcccagtttacttcatgctgttatcttaacatccacaactacatgtcgagagaatacgaaaatgtgttcttaggcttttccttgttcaaccagtctagccatgtgccattggtccttcaagggcagtggctgagcctcttttcttcctcccccactttttgctccctaccagacaaccttctcccataggtgctagtctgtttcctccctgactcgcattcctgcagccaatgcacctgctggtctgctggctgttgtttctcactcactgaaaaccagatctcaggatggacataggttggtggaccattttcttccagtcattcattcattcacttacagattaactccagttacagtcactgtagctagcatcacatacactaagctatctctcatactcttccagacattgcctaaggctgtggccacccagcccctgccctactgggtggagcccacacttgtgatatctcagagtgcttcctccaaccaaagaacccagccttctgcaggagggacacccctttccccctcagacagtcctgattctggcatattaccagaggccagtctttcctgatctcctcctatcctgagacgttctaggcctccttgagttccagttcgctctttcaagagctgcaccaaaacatctttacaacttgtgtttattatttgctgaagtttagctatcttaataaagaattatacttgtgatgaagtcagggccaggtcagtttgtctttctattcttggttcttagcttgttatctggtatatacaaaatgtttcatgaaaattcttcgtattgaagaaagggaagggttttgccaaaagccctactcaaggctgggaggtactgacgcattactgacacctagggataggctacctaaattgcagggtcatggactatgacaaaacagagtgttagtagtgaacatctcaggtaataccacataactttttaaaggggaaaggtcttcctaatttctataaatagttcaaactttcagacttagaatagtcctgcacttgtggcagtgccctcatagatccagaaagaactgatgttatctgatcttggggaaagtccccgccttgggtttgtaaatatccttactgacggtttctagacatttatgcacgacgttttgtcatgtgggatccagcacatatttctgacctggcgaaaactaagaatatctcaatcataaaaataaccagaaaatcataaaacagaaatctggcccaagattttctctggaaaagtaagaagctgctttgaaaggtgaaaatagaccagtgagcccccgcattggaacagattattccaaaaattgtgagcaaaggtctttttctgtattgtgcaagttaatctcctttgcccctttttgtggctgaaatgcatgcctaatctgcatatgagtgcctgccccaggtgggatggggcatgctgggattcctaaaattcagctggcttgcttgaagagggctatcaggctagatttcatgtctcaacaatttctagccggtctccctgagctggcaagcaccgctcagtttataatagtgcctggcacatggtaggtccagtgtttattaaactaacagatattcccaacaggtgtgggcagcagtgctgctaattagcagtaacatagccgcatggcagggacaggaaaggggagccttctgtgtgtccctactatatgcaatgtatgactccaatctcaaaagaagcagagaatactcagccaaatatttgcattgattcctgccaacaccatttttttgtgatttgtatgttcccttccccaccccccaccccctgtactgttaacttcatatttgaagggggttatacttttaggttatttgtgaattgagtcagctcatgtaacagtgattctcaaagtgtggtcccaaaaccagtgggatgggcatcacctgggaacttgttacaaatgcagattattgggtcccaccccagacctactgaatcaaaaatcctggaggtgggtccagcaatcagtgttataatgagcctaccagatgattctaatgcacattgaagtttgaaaaccaccattgtttaaggatcacaacaaatccaacagcactgtcagaagaacaactccttattctaatgggtcaggtgctttctgtgttggctgtcctgcagagcatctctagtgatagttgtattttcaggattagaggtgcaaaactaatgggagtttaagaaggaagtttgagcctttactgctgggagaatcacaagccaagtttatttctcttccattatttgtatggtagctaaaactgccaaggactactgtgatccattgaaacatcagtgtatcacatctcttcttacatctgagctggcattttgggtgtagtgcttcagtaacagttgtattcccaagcaaataaaatcttagccaccagaaatcttgagttggactagacaaaggcacctctccagatagcagctgttgttggaattgaatataagagatgcttaatcaatgtttgtgtaattgaatagaatgggaaatgaatggctcactccaaactttatacaagacagatgaaggcaacttcgatcttaacctttatgatacatagcattttgtactacccttgagaaaatctcagtctcgggttatcatagactcaattggctatcatgggaaattctgtctcagtgatgctccatatctatttaattgaggtttattatcaatttgaaaaatggaaaattcacctcacatattttaaatagccaagatagccagagtgtatgttgtggtttcaatatgtccccaagagttcttgtgttaggagcttggttgcctttgcagtagtgttgagacgtggggcccttgggaggtgattgaatcgatgctgttatcatgggaatgagtttgctatcttgggagtggggtcctgatataaatgatacatttggctgccattttctcttgtttcatgtgcttgcttccaccttcccccttccaccatgggacaatcctctccagatgcctgtgccatgctcttggacttcccagcctccagaactgtgagaaataaatttctttataaattactgagcattctattatagcagcacagactaagacagtgtaagaaagctcttatattataactctctccttctatttgtattcaggttttctcttaattctggaaagtttgggcagcagctgggaatgggaatttattataagacatcccttcagtgtctctacagaattgctttaattaaagtactttgttttatttgtccccatttaattataattcacatcagagaaagctattgttaaaatattttggttagttcagtgtggggaatgggattttccatcccttgaccttcatgactcagtaaggagcagataaaataattttctttgctgggtgattattatgcctcagggacaagtcatatttaagacctgatagtttgattcaagctctcataattgctgtgcagacagtgttcaaagccaaagtcttcctgatcataaggtgctgagaggacattcattttttgccatcattcagagctctgcaagagagcaaattgcttgttacttaaatgtgttacctttgaagaataaaaatctgaattgacactgctgttatttgagccttcaggtgtagggacttggagcacctatgtataccatggaatgtggcttaacaggactaaactgattccttctgcataatgtgctatatactgatttgcactgtatggagtaaaacctcttcaaccatatttgaaagattgatatttactctaaaaagcctataccttgatgatatggtaaaataatcaggttctctataaccttgaatactagtaagctgtttctttgccttcctaataacatgagggtttttagtttttgtttttaaccagcatttgagtacctactatgtgcctaatagagtcagagtgactcacattaaaattaactagagttaccaaaaatttgtccttcttacacaaatatgcaatgacaacagaatgattatcagtaataaatgtatgtgcacttgcagattactaagtgactgatttaccacaaaaaaggaaaggaacattacttagatttgttgctgtccactccttgtttttcattatggttcagtttggattttcaccacaattcagacatgaaaactattctttccataatgaaatcaggtgtgaggttttttttctcattcttttctttagaaaatgtatagcttaggccaggcgcagtggctcacgcctgtaatcccagcactttgggaggccgaggtgggcggatcatgcggtcaagagatcgagactatcctggctaacatggtgaaaccccatctctactaaaaatacaaacacattagccgggcctggtggcacacgcctgtagtcctagctactcagtggtacatgcctgtagtcccagctactcgggaggctgaggcaggagaatcgcttgaacccgggaggcggaggttgctgtgagtcgagatcgtgccaagagagactccatctcaaaaaaaaaaaaaaaaaaagcaagcaagaaagtaagaaagaatagcttatattttctattaactccaaccaagcaaaatttaaaatgctaggttgcactccttgcactccgtagtgcaacccaatagcaccatggctttttaattccctgagagagagatggtggacagggtgttctgggaaactgctgacagtaacatctgtccataccgaaagtcaagtgaaaacttggttcacatgagagcaaatgaaaatatgatgtttttaaagaggctgggaaaaagtcagagaagtgctcccactattttagatgagctcagcagcaagtttctagtaggtaagagggaaaatccattgtggggaaatgtgccaatgactgtttttggttaaaggtttgaatgggcacgatttagcagaactttacaaagctgtgtcttgaagagctttggaaaaacatttagtgttgttgtcgttgatgattttttttcatactctctgttgttcaggttatatgtgactgaaagaaagaatgatgtagtttcagttacttccatgacccaccccgggctagcacctccttcagccacatggtaaggtcccagaaacatttgatagagaccacatgaaagtagatgcttatgcagatgtgacttttgaaatacattcttcctggctttcagatgtgctattaattgcaggtttaaaagcccttttttgtttgatctgataaggtaggcttactttatgtcaccttaaaatgaggttaagccaagaattgcaagatataaagtattcaatgactactctccatttctgctgggaaaaagaccatctgcttaggtaattgcattgtaatactcaaacctggctgaattgcttctgtccctgcaaacgtctcttctgtcttttacattcacagtcatatatctctcctgcatgtagatccaagacccagtgtagccttttgtataatttgtaggattaatagactctgggtctggcctagtacttatattgtaggtctataaattatcataataacataggtataattgcaggtagagttttatatctgggtctgcagtggtttgatcattgactcactgagaacaattattaatcttcaactccaaggtaggacacacagttccaattggtacataaatagtacatacatttacattacagcagggggacattgtctttgaaagaacatgaataatacgttaaacctggaagctgggagggggacatacagtaagtgggaaaagagatattgcagaaagtttaaaaacagagaagaagaaaataaaataaataccaaagcaagcatgctgatatcttaaattaggtgcaaggaattctttttccttctgtgcctcagagctgcctctatgtggccatatgtgccttgagggggaaggagtatagtaagctttgggaatgatgattcttcatcttgcaggatgtagttgctcgtgttggctcaactcagggtaaatattctagatgattgatgtatgaaatcctaatagtatgccatttaggagtttgtttaccatcagtctccacattcagactttttcttgtgggtttgaatgttctgtagtttctgtaatattgaattcaaaggtttgcttttgattggactttcctaattaaaagcaaatttattgtccctacaccttgcctctacttagcccaatctcacacaccctgtgaggctttttcccagatgttatttctccttcttgaagcttcttataggcagaaactggacctcattcatctttttatcttttacagtgctctcgcaaatatttattgaataaataaatgacataatttatacagtctgtgaggcttacaaataccttctttaagctattagtaaaacaaaagtactggcacaaagtgatttcttgttcatataacagaagtattttactttcaaacacacacacacacacacacacacacacacacacacacacacagaaagagggagagaaagagagagaagcccaacccaacaaaccacttaagggaaaccatgaaaatggtatctttgttgagagttaatgagtttatagttaatttatgctttccctggaatacatattatactcattatgtacaagtaaactatgactgtttttacacctatcacagatattccagatcttaaaatgctctgtttgaaataaaaggcagaaggggggacttgggcatattcccttatagttattcttgtgtctcttatggaatagatgcaaaaaagtctaatttgcctttctgtcacttggcaaagtttattatttgcttaagcacaagaagataaatgttttatcctactggcaaaaagtattgtttgcacaaatgtaaaattctgttaaatgtatttatatgtattgtcttagtcagggttctctagagggacaggactaataggatagatagatgtacatatgaaagggagtttattaaggagtattgactcacatcatcacaaggtcaagtcccacagtaggccatctgcaagctgaggagcaaggaagccagtccgagtcccaaaacctcaaaagtagggaagccaacagtgtgcccgaaggcccaagagcccctggcaaaccactggtgtaaatccaagagtccaaaagccgaagaacttggagtctgatgttcaagggcaggaagcatccagcgtgggagaaaaataaagaccagaagactcggcaagtctagtccttccatgttcttctgcttgctttattctggctgtgctggcagttgattagatggtgcccacccagattgagagtgggtctgcctctcccagtccactgactcaaatgttaatctcctttggcaagaacctcacagacacccccagtgacaatactttgcattcttcaatctaatcaaggtgacactcagtattaaccatcacatgtatgtttctatttgagtgtttctgtaaatgacatgctttagtttttgacaagtcaaatcctaccaaaataccctcatagaaaactcttgatgagagtaatggttatatccaagtcctctcaataacaaatttatttcaatcaatatttaatatcacaaaataacagtatgacaaatgaaggatagaatgtggttaactagtgtagagtgtgaattatttggactggattgtgaagtagatgtaactgatactcatggatgaacttgcagtaattatagataataaaaaattaccagccaagtgctgtggctcatgcctgtaatcccaacactttgggaggctgaggtgagcggattactgagcccaggagttccaaaccagcctgggcaacatggggagaccccatctctacaaaaaatgtaaaaagccaggtgtggtagtgtgtacttttatgtaatcccagctactcaggaggctgaaattggaggattgcttgagcttgagtcaaggccgcaatgagctcaggccactgtacttgagcctgggtgacaaagaccctgtctcaaaaaaaattataatgcgtacataattttttcacacatcaaccactttcctaacaagtcattgatcctcaaaataatcctgtgagtattattctcttctatgtaaatggaggaactgagtatctaataggtgattgccacatctaggcagctggcgtggagggtgttgaagatttgagtccggtgcctttgaccccaaagcctatggctggagatgcctgccaaggcaaaactgcccttaccaaagcagattttatcagctgatcccatttctctctcactaaactgagtccatgaatccttctcaatgtagacaaaatctatctgctatcctgacctatgttatttctaagtgtattttgctgggcattaacgcagatggaatacagccgagtttgcgtaagttctgtatagtacaccaccaagcaccttaacaggagcctgcaaattgccgttgagggaggtaacttttagcatctgaggctttgatgtgtttatcttctccaggaattttgttttgcctcctttgggaggggagaggtcttctgctaagcatctacttcctttatttcttactgcacaagaacttcggtctaattggccaactttgagtgtgctgaggtgacctatttctgtctgggataataaaaacattccagatgactgacgccttttactggggacaatttgacctgattctaaccctcctgctctgcctgccaaggaagatgattactacaggccttagtaccgacctctatttacttcatctactttttttttttcattttcttgcaaaaatagcaggcttgtccaagtgcctagctactatggcaataagtgctatttaaacagatgccgatgccgaatacatgtgtcccagcttaaatgagtcagtgggagcagttgtaggatctgattgcataaatgcatgggaataatgtctgtctctggggcaacagaacttcttttgagcccttgagaggaccagttcagttgcagaaaggctgatgtaatgatcacacaccttcaggtgaaagggtcagtttctccctgaatggaaagtgtcaaaaaatggccatttagactttctgctttgtaactagagcaaatgcctcaagaaagagaaaatgaacaggaaagccctcaaaagctttaaagggcttagaaaatgtaaagccattattgttggttattcaaatatccctctgattcaaatagatgcattgattttttaaaaaaatctacagttaacatcaagaaacttgagcctcagtaaatgagcactgccttatagaatattgctgaatatgtcttgaataagttgagaaagcacttggctgtgtataactactcatgtaaaatgctattggcacaaagatgacatttttttcaaagatgcctctatcatgtggctacaagtagattgtgctgattctattcctctacaaagctcagggtcacaggtggtctattagtagttgttggttgttagctctgccataagaagatggcatggttccttaggttagatgcattcagagttggtggtggacttgagtgtctacttatgcgcagagattttcagtcttttatttccatcttgacagtagacagagaagcaggggacaggcttgaaatttcagtcaaatatcaatccagcatgaaggaggacaccctgattttaaacacccactaatatttccttggaaaaaaaaagagcctaacacatctctggctccagctcttctctcctcccctcccttccctcagcccccaattctcttttcttttcctgtcttcagaatatgtgaaatgggggaaatcataaaacagtcaatcttcattattcacagtttccatatttgtgaattcactacttgctaaaatgtcttcgtaacggcaaaatcaatgctcactgtgcttttgtggttatttgcagacatgtgtggaacagtgaaaaactggagttgttccccatgcatgtttctagttgaagttaaaccaggtgacagccctttttgtttcagccctcatactgtaaacaactctcctttttgtggtcagcttagtgccacattttaaaacatttttctgcttttttttttggtgattttactatttgaaatggtccaaggatagtgccagcctactgtccagtgttcctaagtgcaagaaggctgtgatgtgccttgggaagaaatatgagtgttagataagcttcgtccaggcctgagttgtagtgctgttgctgtgagtccaatgttagtgaatcaacaatatatactcaataaacagtctttaagtagaaacacatgttaaacaaagttatgtatttatcagttgatgaaaatgtgaccagaggctcacagacacctagccctgtatctctccccagagcaatgcttcagtatttgctcagaaccaccacaagtaatgagaacaggctaacctaccccttggagttgacgtgaggatctcatgagctaatgcccctaaaatgcatggtgccttacagtgtgccccataggtgctaactatagcagttatcatcatcatcatcatcatcatcatcaatgaaaatacgggagaagaaaaaattaccaataatcccactattgtacctcaacaactctcttcattttgggtattcccttcagtcattgtttcgttgcattcacatctttgtataactgcattaaactgcatacaattttgaatatttctttgctatcattctgtcatgtgcatcaccctgtgttgcgacacagcctccatttctgtggtcttcttgatggaaagcggtaaaaactttgttcctgggctcatgtaagagcagctctcttcaagcatagggatgacttcattgctcacgacaccaatatgccttaaaattctgtgattaattgtaaaaaagaactctctctgaacactacagagaaaactctcacagagcagagaaatttattatgtgatcttcttctctccagaggaaaatggtgtgttttaagtcagaaggtttgggtcattattcagtagaacgaggtgctcgagggattacaaaagaagagtaactctaatctttgtgagagtgatggcctaatacaggtgttagcaaacatttcccgtacaggctcagatagtaaatgtgttagaccttgtgggccatatgatctccattgcagccactcaactctgccattgtagccaaaactatggataatattaatggataatattaaacaattgagtgtggctgtgttcctataaaaccttatttacaaataaggcacaattccaaacaaaatagatctgaacaccaaagtgggcagttcgtttattgctttattcttccacaaaacttctagtatgttaggccttgtcctggttggcagtaacatcagcaagagtagcaaaacatttttctatgcctcatgaagtttatagtctgaagggggagagagcgatcttaataaaataattgtataaatgaatatataattgcatgtgttgataaatactgcaaaggaagaaaacagtgggaaataggactgtgtcagatattcaggcacgaagtttagggaaggggctgcactttgaggtggccgccagacactcattgaaataagagggccttgatcattgtgcagtaagtgatttttattaacaagaacttagtcattacatacctagctgtaagtagatgctagctctgaagaatagattttcggtggtcagtttggcattcaaccaggaccaaaagagaatcccctcattcgctgacttggggctggatttatgagtgtcgtcactccctttgtattttctttttttgtcttattggtctttctaggcagaaatgaataccacatggttgagacacgcataagattcaggtccatcaggtcttgagcatctttctggtaacttaaacataagccaggatccacatatctaacggctacatgggatatagggcctcgttcataaaaacgcatacccatacttcttaatatgcccttgcctgttcctctttagttctctcaccccctgcaaatattcttcctttttaaaccctcagtttcttcaccaaactttcccagacaacctatccccaaggactttctttatccctctttgccagccaacctgtgtaccccttttcttctggaggtgcactgaggacttttccctcctgcctgatcatctgggcctctctgggctacccgggccttgcagcttcatggttcctccctgagcctctctccctagggagggaagcacaaggaactcactggagtgggcagttctgttcacaccctggtaaatgaaatcctctgcctcattacactctgcagacaatttcagcatccagtcatgcttatttcttgaaggaaaaggactgtttttccaccatttgggtctatgactccactggggattaaggaaagagacaacattgtggaatgtgtgtgtgtgtgttgttggagacagcttttgcttgggctggtatcatgtctactccaggattttctgaagtgactgtgggacaggaagaggcccattggtggctacttagcaacaccaggcccttcacgggcagtggaaagtcactggggtaatgccccagaccctcaccctcaacaggctacacctggacagagacagggcacccttatggggctttcagggatgagatgtgttcatccacaaataagggagaagcacagagacttctacaagtatgtagaggagaatctaggagatacaatgcaagggctgagaatttgggatatacacttattactgttggtgtggtcctagccttacaacaggttgtgcagcccaccaaagcatggattacagtgttaacatgcagaaattcctgattgtacctcttttccagctgttcaatcctacatgaggcctttcaaaacccctgtgatttcttacgattagagatgtaggctgtcccatctagtaaatttgtcaaaccactactgggtatcaggtagaaatagagttccctttcatcactagcaatatgtttcttttctcaatggtttgctctcctttgctcattttccatggaaggtcttcattactcctgtattttaaaagctatcttgtcaatattattccaagcgaatttctcagtatattttaaaagggaaaactaataatgtgatcctcttgcttaaaaccctttacagcttcccaagagtgttagaattaatggggctggtactagcatgcaaaatttaagggaatgtcaaaaaagtcagtagtcaagataaataatatttaatgcactattttaaaaatgttcttggcaaactttcgtccacacctgcgtttgtaaatgaggtttcaactcacaccgtgcatgtgacttgagaggccactgcagcacggccaggcctcagtgcactctctggcctcaacgtaactcccttgaccttccatgttgtattagtcctttctcatgctgctaataaagacataccccagattgggtaatttataaaggaaaaaggtttaatggactcacagttccacatggctggggaggcctcacaatcacggcagaagatgaaggaagagcaaagggacatcttacatggcagcaggcatgtgcaggggaactgctctttataaaaccatcagatctcatgatctgtgacttagtcactatcacgagaacagcatgggcaagacccgcctccatgattaaattacttcccactggttgcctcccacagcacatgggaattatgggaactacagttcaaaatgagatttgggtggggacacaagccaaactgtatcatgtaaccaaatatgttaagctccatccatgctgactttggtggtcatgtccatcccgggcctttatatgggttgtcccctttcttcacatctctgctgagctggcccctgctcatccttcagaactcgatcaagtgctccttccctcttgttggccaccctgagccccaaggtgggatcaggctcctctgctaggtgtcctcagggtggtgcgtgggggtcgttagtgtttgtccttagaatacctggcaagcagacatgcacgtgggtcattttgtttattaacaccaaactcctccagttgattataagctccatgagggcaggactgaatttgtcattcttatcgcacagtggcttacatgtcagtcatcactgaacagttaatggtcatttgatctgatatgcttctggtataatttcatgatatcagatctggagacatgaagtcattgttttcctggtggggagtgtgacaccaccatcttgttcaccatttgcagagttctttcctgtcttcgggcaagtagattaggttatatcgttatctctgtttatagctgtctcaaataaatcctttagaagagggagaaagatggtacaaagaaaaaagaagccaaggaggaaagtgactctcagagatgctaatgactttcccaggaaggctgtcacacagcaagaactcagatatgggttttacaactcagaaactcatcctgttctaggccccaacctcactctctcaggagaaggtcctggaggagattcccctctcactttccagaaaaaggacaaagggaattaggaatcttttcttaacattaacgccttgccaatttctagacctcccctcctgctcctcccttaagacatcctatttgcacgtctctgctcttagaggctattgggtttaagcgccacaataaataaaaggcaataaaataaataaaggcaataaaagatatctcctggtaggatataattttctttctttcgttcactgtctcagagttattttatccttttcaccacgagggactcaattggaactggctctcttattagccttcaggttcaactggcttccatggaggcattgtctcctcatagacctgttcacttgacagaccttcacagaagtttcatcagtataaggacccaaaacaccatctaaatggcttcatccagccatggcagatgccctttgctgctgggttgggtttttttttttttttctttcttttttttttgagatggagtctcactctgtcactcaggctggagtgcagtggcacaatctcagctcactgcaacctccgcctcctgagtttcaagtgattctcctgcctcagcctcccaagtagctgggactacagacatgcaccaccacacctggctaatttttgtgtttttagtagaggtggggtttcgccatgttggccaggctggtctcgaactcctgacctcaggtgatccacctgccttggcctcccaaagttctgggatttcaggcatgagccactgtgcctggccctgctggttttacttctgcctgaaacccactggggtgaaaggacaggccttggaaatgttgcattagtagcaactgctccctctaatgggaggacacatcccttccccatagtcagtgcaggagtcacagaagcttgagcacgacctcaggaatcggcttccattcattcattcaacccatatttactgagccccagtgtgtgccgggtacttctggacccttgggatatgaggtgaacagctcacagatccctgccctcctggagtttacattcttatgagagaaacggtcaatgaatgagtagtcaaataagttttacttccagtaatatgtggtatggagaaaaagaaatgaaggagaacagagataaagtttggtgatggtggaaggtggcagacagggtagccaaggaaagccttgcaaacgaggtgacatttgagcagagacatgacatgaagttctgggagaaaagtttatcaggcaaggtatatggctggtagaaaactctgagtccaaggcaaagtgactatccacaatcagccagaggtcaccatggctgggaagcatggcaggaagtgggaccagggatgcatgcaaaggccaaaacaggagggagttcatgctgctcatatctgttctggaaggacactggagaaatgtgtgtgaagaggaacatgaactgacttatgctttaaagggaccattctgaccgtcatgtgcaatgaatggagttgaggggctagtcaggagtagggcagagagatcaggtgagaggctcctagaataatccaagtaaaagatggaggtgactggattggggtgttggcagtggaggtggtgaggaacggtcggtcagatcgtcatgtattttgaaggcggagttcattcaccattgttgctgtaccagttgtgggctaggaaagaaagcagtgtgggtcaagcatcactcattcattcattgacacatacttgttgaatacctatcatgaacctgcccttgttctgggtgatggctataccggtaaacagaatagtcaaagcttcctgcccttgtggaacttacactttattattttatttttatttattttgttgaaacgaggccttgctctgttgcccaggctggagtgcactaatgcaatcatagctcactgcagtctcaagctccttgggctcaagtgatcctctggccccagcctcccacgtagctggaactacaggtgatgccaccacacctggctagtttttgtagagacagggtctcactatgttgcccaggctgatcttgaactcctggcctcaaatgatcctcccaccttggccttccaaagtgctgggattacaggcgtgagctactgtgcccggcctggtttacattttagaaaaagaaacagaaaataaaggtaaaaaaacaataagtgaattataatacatgttcagaagatatttgttatggtaaaaagaaaaaaatagagcagaagagggaccctggggcaggggagcagctgcaattttaactagggcaaccaaggtgggtgttcttaaaaggtcgccaggttttgggccctaagtagttagatggaagctaatactactatttaatgagaggtctataaagattacacaaataggctgggtgcagtggctcacacctgtcaatcccagagctttgggaggccgaggcaggcggatcgcttgaggtcaggagttcaagaccagcctggccaacatagcgaaaccccgtgtctgctaaaaatacaaaaattagctaggtgtggtgacacacacctgtaatcacagttactcaggaggctaaggcaggaaaatcgcttgagcccagaagtcagaggttgcagtgagccgagatcgcaccactgcactccggcctgggcgacagagtgaaactccatctcaaaaaaaaaaaagaataaagaaataaaagtgggaagaggagcaggctggaggttagggtggggtaaacaagctgttgtcatacttgagtccttgagtattgaatttgagctgtctcttagtgacaataccaagtagatagttggatattcaaatctggggcttaggcagaggccagggctatgtatatacatttcaaagtatcagagtctagaaggtctttaaagccataagaccagatgaggtctacaaggatgagagtggagagagaaaaaagagggcccagggccaggggctactgagtcctcagagtagagagaagaaaagaggaattagcaaaggagatgcagaaggaatagccaggaaagtgggagaaaaatgaggcgcttgaacgaagagctgaagaggtagaaagcaagtcacagcgctcaaagcagcaggtgagatggtgagtgggttgggaaagtgactaggagaactttttataagcgacttcctgagcagcaagtgatcaagttaccctgttgttagctatttgacggtggtgtgtagagtcacagaaaggtggcctctccctgtgtgcccacggaaacaccagggctgagccctttgcgtttgccagtgttcatgtgttcacttaagaattaatattattctccaaggcaaggcagtgggtacagatcgcagaagagtcaataccacacacaagattttgaacttaaatttataggcaatggggatttagataaagtttttcagcaggagagtgacatatgtaacctgttccatgtaaatagtttggggagcagaagggaggatgagttggaggaaggagaggtgatagggaggccattttagtagtggagccatgaaatgggggagggggagactgaaccaaaggagatgcagcgagaattcgaaagcagagatgcgagagacacggagaaggtggacatacagcctctggtacgtgattgtgggagggtacaatgagaggaacattgaagaccactcttggggttctatcttgtgtgactgggggatggagcccactgtgggtttttgctgggagatggagaggagaggctgtcagattaaccagtttatggattaattattaagaaacagcagggacctgggatttcccctcctcactgattagttagctggtaattaggcagtggctgagaatgctactgtctgtcccccatcgggtgggaggagcagagctgagcctccccacagttgctgtggtgcatggagtggggacctagaatcactgctatcacgtgacatgccccctgttcctcctgggaacccaactctgaaggggtcttcttgacatccgattttctccttccagagctcttctgaagttcttgcctaatgaagaaaaagcaagaaaagggaaaatatgtgtaccacagaattttccttctctctggtggtgttttgcaaaaatgccatggcaactttcctcttcaaatacttgggatttgtttctcttgcatctgtcaagtgcacatcaaagttgaattttccactttggaattatgatttgtattctgcttctcccatctgggcttctgttctcctgaaaactgcctattctactgtgaaatgagcattccccaaggctgatgtagccgcttcatgctaagtgttgatgggaaacctgaagctgagttgggcaaatgtttttgagatctgtaaattccccagagacttaaattgcttgaattattgagggacattttgacctcttgttggaccaatgagaatgaaagaaaagattggttaaatagaagaaatgttcagaatccccctcagccctccaaattccaaatattttcttttttctttctttttgtttcttttgagacggagtcttgctctgttgcccaggctggagtgcagtggcacaatcttggctcacttctacctctgtctcctgggttcaagccattctcctgcctcagtctcctgagtagctgggattacaggtgcacgccaccatgcctggctgatttttgtatttttaatagagatggggttttactgtgttagccaggctagtctcaaactcctgacataaagtgatctgcctgccttggcctcccaaagtgctgggattacaggcatgagccactgcacccggccaaatgttttctagttaagttcatatacccatgccagagtgcctagctcacacttcattataaatgtctgcctcaaacagaagtcctgggtccatgtttccactgtcctgcgagggatacacaagaacacttggcaaacgaagaagggaaggcctggggctacagtgggtagggagtaccagagacccaggggacaatatatgggttaaatgaggactttatttaatagtatttttaaaaattaaaattgtgacaaaatttaggaatcagtaattatttaaaaatccaaatattctgcttctcttgaaaaatcagaagacatggcatctcggggcccaaatttctatttggcagttttcagctggaggtcagctggtgtccccctaaactcaaggcatgtggtccccagtgggtcacgcccaccagaatcctctgctgtcttgatagctctgaggtccttcagggatcactggggaatgatgttctcctagaagactttctggatcctccaggtccaggttagatgctaaccaatgctcttaaagtagctatagcaacttttattaatatagataatattttatatttttcatattatataatttttgttattatattttaattgcttcctgacttatctcagtcctcttcagtataatttagtctccataagaataagtacttgttgtgtttgttattaatctccaacatcttggctgggcgcagcggctcacacctgtaatcccagcattttgagaggctgaggtgggtggatcccttgagctcaggaatttaagaccagcctggtcaacatggcgaaaccccatctctacaaaaaataagctgggtgcgatgctgtgcacgtgtagtcccagctactcaggaggctgaagtgggaggctcacttgagcctcagaagtccaggcttcagtgagccaaaattatgccactgcactccagcctggcgacagagcaaaaccttgtctaaaaataaaaaattaacaaatctccaacatcttgcataaggcccaggccataagcagacattcaaataaattaatttactaaataaggacaatagactaaataatccctggggtccattttagttgtactattctattgctctgatgtttctctttaaagaaacagattcatgggttttctattagagtaagacactgtatttgtctctacacatacctgagtaagaatgctttgggttagatccctcttttttggttcgtaaaactagagaagagaacagatggaaaggaccttgaagttcagcttcctaatttgcaggtggagaaacaggctcagagaagatacgtggacttccttcgagtcatatagttgtaacccaggttaggacatgtgcctccagggcagagtccacctgccttggtctctagtctgaaggaacaaatgaccagtgtggtagataagaacaaagtatattcaaagcctataaaagaaaagagacagagagaggaaagtggtactagctgacaaatgtcaccttagtggcaaaaacagtaaataccgtagaggtttataggacagaaattacttcagaaacgtaacaaggtttaagcaatccagtgtttattagcaatggttctctgactggggtgtccaaatgcattctaaggggactttgagttccctttgaaaacagtgaatgtacaatttcagggattttcatcatttctgtgagggagtatgacactttcctggccattgaaggggagaagggaattgatttgtaaatgatgtgtatacacaaagtgaaggcccagtgatggaatggtgatggtttgcagtagtttggggctgtggcaattagtgacattttgtttttacattataaacagtgatgtaattggagtgaaatgccattatccactgcgtcattttaatgcagtcaattgttactggcttcgtatttagtttttacacttatgttggtgtcagaattatagaagagttgtaagcaaaagcactttgcatctagttgtgttagttttgtgtacattgatgcaacattgcaatgaaagtaatctaaaacaatgccaacagtccaagagattttatctttcttttagaaagagtctatgcattattcaagcttgttgtgaatgctgacttcctatagcacttgcatttaagttatgagaagttattggcatgagagataatttaagtggcatgagctcatctgctgtcactgcatgaattacttgggaggaacttggtgtgggagatgtgatatgctctcccctcagtaggtggctgttcccacaggcaattctagattctaagataattctgactattgttttattgactttagaaccagatcctttgtaagatgttatgatgtacagggtctaagtggtggaaggatgtgtctttcctttaatgtgatataagccagagttcagcaaactatggcccatggaccaaacacagcccacagtctgtttttgttaataaaattgtattggaatttaggcacactcatttatatacagatggtctgtggctgctttcacactataaatccttagtccaatcatttcgatagagatcctatggcttgcagagtccaaagtctttattatctgacagtgccctaggacccagggtctaaatataaccatttctgcactgtgctttcagcttctgtgtattttatttgtttctctaaagtgacctaattaatctgtcctattgggataattagggaattctagatggttgttgctttgtggaagattccgtgatttctctaataagggaatctagtctattctcaacatagattcctactttcttaaaataggatgctagaagctagcaagatgctgtttgattcaggagccccacctgccagagctagcctcaggctgcactgtgaatgagccacttgtgtttccacccgtccgccctgcttttcggaacccgcttccttcatcatgtctttgcgtcactgccttttcactccatcctgcctctcagtaacatcagtgaaggctctgatatctcacttttaccaccatttaagttcacttcatttgtccacttcttgcttcttccaagggtgtttgcacttgaagctttttgtccccactgtgtataggaagctttgccttccctgaaaggtttgaccaactcagaggagtggagggagaagggatgagggggcagcacaggacggggagtggtagggacagggctgtccctggaaacacacagtcctcctcagtgactgcacggctcattgcacctcattcctgggttgctgtacagatcagagtctacctcacctcaaaagccccacagtatttgttaaatgtctgggggattccagatacttaacaaataatctttcaatgtggtcgacttatttagggaacaaacacaaaaagactcacacaaaaggcatgggagtcaaatgctctttgggatacttgactggagagggctttctacttacacgtgcctagggaaatagtcaaaggatgaggggggttggtatgatttagggacagttcctagaaggagatacttactcctgaatgtgctctgcttaaaaaaaaaaaaaaaaaaaaaaaaaagaagaagaaaagaaaagaaattgtgttgggcgtaaccacagccttcttagccagcctgagttggcattgctcaccctctgaggattaggtcagccacagtgagctttctcaaggaagtggtgccttggggagcccgcgttggaaagcaatagcagatggctgccgtgggatgtatatggtcctgcttttttaatatgtggagaaaagagacctgcgctctctgtatgttcacatatatcaggatcattatatgttaattgcttattatggcaactgatgatttgcctcctgtttcttatgtgttctgtcagttaacatttattgggcacctactatatgtcgatagaatctgcacagtggcaggtaaagttttccctgtctttaaagagctcaagtctgataagaatgacaactcatgaataattgcaatctaggatggagaaacgggggaattctcccttagaattatatccccctcattgacttcacactaaattcgactttttaaattcagcagtgattatctaaagcctgagctgttcagattgttaaataacagtactctaagttaatctacaagaatcttaattaaagaagtgaatttgggtatgttcaaattataactcagctgaaaaacagtttctctactatgcattcccctcaccaatcccacttcccaaataaactgactgaggtgggataaaagggtccagactagaggatggcaaactccagccccaaggtcaagttacacctgccacctgtttctataaatagttctcctggaacacagaaatgcccactcatttacataatgtctatcatctgtggctgctttcaagctacaaggcagaggtgagcagctgggacagaggttgtgtgtggccagcaaagcctaaaatatttactttttgtatcacaggaaaaaaaaattgccaacccttggtctagagtaaactgaacacccataaaaagtaaaaacaacattattcaccacctctgactggcaaaatgacttaagaaccagcacactggtacattttaatagcagttaaatctagacacatttggatttaaattgaaatccaatatcctcctcttcatgatgaagtattaacatggttagctagctaagaaatatttgaccctcacgtacttaaaatatctcttgttttggtgtttgtgtacacaaattagggaatacaaattatgttcatgaagtaagtcatcttcaccaacggaaagaaatattctccaaatcgctgagaccatgcatcaaccctactgcacagttagaagaagggccacattaattacccgaggatacagaatctcttaggaagaggagtggccacagagaacaagagcatatatagtgcatttcagagaagtttctcctgccctccagattcccctgtggacctactctgagtccattctgcaagggggcatttctgcatttgagcagctcccgttcttacccattacacatccctgtgtatagggggcttcaggaagaacttacacaaccaatcgatggcctcagtttaatataacatttaaaaatatctcgctctcctgattctgtagccaaactcagaatcatcaaggccacttcctctcccaggagagtaagcaaacttactgcccagatgtcccccaaagtgtctttgccttcaactttgctgcaggctggaaaggctgtttctctacaaggactggagatgcaaacccttggaggggagggtcctggggagggcaggcacgtgttaaaaagggcagtagatgaaagcaaatgtggctgcaattgtccgcttctgcttgaacagcaagtctgtcccatgctataacagggattctgtaggatggatcctgttttttgttttgttttgttttgttttttgaggcggagtctcgctctgtcgcccaggctggagtgcagtggcgccatctctgctcactgcaagctccgcaggagaatggttcacgccattctcctgcctcagcctcctgaatagctgagactacaggcgcccgccaccacacccggctaattttttgtattttttagtggagacagggtttcaccgtgttagccaggatggtctcgatctcctgacctcatgatctgcccgcctcggcctcccaaagtgctgggattataggcgtgagccactgcaccctgccctgatcctgttttttagagaaagtagattgttaatccgtcactttatgtattgtctctaagatagcatctatcatgtatataggcacaaatgcatactggagtgaattcataaattaatagatgaattaagacctcagactctggagacaagcaaaattgagtttaaatcccatctttgccagttaatagctgttagttatctatcgctgtataacaaattgtcccaaatttagtggcttaagttattatctcacagcactgtgggtaaaggatctgggtttggctttgctgggtaccaaggctgcagtcatctcaaagcttggccaggtggggaaggacctgctttcaagctcacacatgtggttgttggctggcctcaaatccgtcatggctgttggctgacctcaaatccatcatggctgttggctagagacatcagttccttgccacctgggcctctccaaagggctgctcacaacatggtggctggcttcccccagagaggggaatctgagagaaagatccaagatggaagctacagtgtttttgttttcactgggaatgtgggcaaggcattgaaaaagatttttgtgtgagtgataaaatatacacaacattatttgctattgtaacctttctttctttctttttttttttttttttttttgagacagagtcatgctgtgtcacccaggctggagtgcagtgatacttccttggctcactgcaacctccacctctcgagttcaagagattcttctgcctcagcctcccaagtagctgggactataagtgtgcaccaccacacctggctaattttttgtatttttagtagacggggttttgccatgttggccaggctggtctcaaactcctgacctccagtgatctgcccacctcggcctcccaaagtgctggggttacaggcatgagccaccacacctggcctattgtaaccacttttaggtgtgcaattaggtggcattaagtatattcactgtgttttacaaccatcaccactatttatttctaaaacttttcatcaccccaaacagaaacttgaagctacagtgtttttgcaacctaatctcagaagcaacataccaccattctgttatattctgtttcttggaagcaagtcaccaaacatagcccacaattccagggggagggtatcttgaaggacaagaagaccaggaggaagacatcctagaaggcagtcccagaagctgcctgccatacaggctatgtgaccttaggcaggtagtaacctgcctcagtttcaacctttgtaaaacaaggatgatatcttagtctgttcaggctgctataacaaaataccataaactgggtggcttatggacaacaggattttatgtctcacagttctagaggctggaaagtccaaaggcaaggcagagtctgtctggtgagggcctgcatcctcacaggtggcaccttcttgctgtgtcttcacatgatgaaaggggcaaggggtctctctcaggcttctttttaagggcacttatttcattcatgagggctctgttcccatgagctaatcacctcccaaaagccctacctcctaatgccatggcctaggggttaggatttcaacatatgaatttcggagggacagaaacattcagacctagcagatgattttgcctgcctcatagtgctgtacttatatccagggggagcacccccaagtttctactctttaatataagattaaatagatggccccaagccatgatgtttggccaccatggactccaggcagggttttcctgcacggcttctcagatcttcatggtgcttcagcagagatcacatctttagatctctgacagcatgagcagatagagggcagagcagaggcagaactgtggcaatacaaaatatgattcctacatcttcttcccagtacaatctttatggggagcagagcttcctgtaaggaaggagaagcctcccctggacagtgttgagctcccatgtcctcatcatatctcctctgggagtggatccacccctccctcagttgctcacattcaccaccaagatactatccttgtacccattatggtttattctctttcttccatgcacattcccagtatcactttaatgtgtccgccctctttcctggtgagctgtcctgtgcagtgaataagaaacagttacttcccctggagggcttgcatatgactatgcaacgtgcaagcaggctgcttttaaaactattatttaaaatttttcaaaatggtagtatctctttccatccttgtcccctctcacaggtcaaacctaaacaattcagggtctcattccaaacaccagctcatggatgtgttctgagccatcatatattccagccatatctttatacttctgtggtcctgtggaatagtaccaatccagatccttaattagctgaaaattaattcagatgattgcatatttaagccaaagaaataaattaatattgtgtgcaaaggtttctggtgatgagtattttggaaggactgttaaacacatttgaaataaaaatagtttactggctaaggctcagaaaaaaacaaaaattattactgatcagtgttttctaaagtgtgttctgcagaccgaaatgctgtttatttgcccactgaccaaaattacattgataatctgtactaatctcatcagggttgatgagaatatggtaaaacagtcatggactgttttctgctgggagtataaattggacatgcctctaggcaagcaattttgtactatttatcagaatttaaaatgtatatgccctttggcccagcaactctacttctagaagttaatcttaaatcattcttgcacatatatacaaggggctttattgcagtactgttcatagtaagaaaacgttggaaacaacttaaatgtatgtctataatagaccaggtaaatcaattataatatgcctctactcttgaatattgtacaacagtcaaaataatgagcaggcttggtacaggggcttatgcctgtaatcccagaacttcgggaggccaagatgggaggatcttttgaggccaggagttcaagaccagcctggtcaacacagtgagacccccatctctaaaaaaataaacagcccacctgtatgtattcacatggaaagatggacatagtattttgttacctggaagaagcaagtcgtagagcaatattttaatataattacttctataggaaaagatatatacatatggtattatatatataatttctgtgtgtatgcacaatattgtgtgtgtgtgtcacacacacacagcatgttttcatgctgctaatacctgagactgggcaatttacaaaagaaagaggtttaattgaacttacagttccacatcgctggggaggcctcacagtcatggcgggaggaaaggaggagcaagtcacttcttacatggatggcagcaggcagaaaaagagagtttgtccagggaaacacccatttttaaaaccattagatctcatgagactcattcgctatcatgagaacaatgcaggaaagacccatcccataattcaatcatctcccactgggttcctcccatgacacttgggaattgtaggagttacaattcaagatgagatttgagtggggacacagccaaaccatgtcatatatgtatatatataaaatacatgtacaaccacatagatttgtttggaaggatacacaccaaactgttaatagtggttattcttcctcttgagaaagaaatagaattttctagagggtaggagggttgcttcctgctttgctgtgtatccttgcatattgtttgaattttttataattagtatacattgcttctgtaatttatgaaacaatttaaacatctcttaaactcatagacataacatatttatttttaagcaaattaagaaaaagaaccatgtaatctctctgcccaaatgtaattactattaatcttccatacctttttctatagatgtattgtttgtttttaaaaaatgtaatttttccatttagaccattttgtaatctgctgcttttatttcacaatatgggataaatgtgattattccctgcatatttatgtgccagtagatattcagttatatttctaatgacttcaatgttatggtttttaggtatatgagattactggaaactaggcatttgaaatgggcaaggtaaattcctagtgcaatatcctgttacctggcttcttgctttcatcttgttcatccgtacatctagattgtccaccctttatgcctaatctctgtcattgtcttgaataaaattttccatggctgcccattgccctcaagataaatttctagtttccttagatagattgcaaggcccctcactttccagttcatgtttcctctggcacatctttggccaacacctttatcttcaactcccatcaacagctcacctcacccaggcttattctcactctgccttccggtttcagctccaatgactccatttctgattcagttacttctctgtttctcagagcatcttccacttcttccatctcttgtttttgccacccaataggcactctcccttttcctgacaaaacagttcattgtgtgtgagagacttcgggcaaggttattaagctgtccacgcttcaggcttatcatgattcatcatctattaataggacaataatagtaccgacctcctgagattgttaattggaggaagtgaatgaatatctctcagtggattagaagtgcctggggcataataagggctctatgtgtttgaggctgcagttgctgtaattggaatcatctctcttttactcagtccacctagtttggttgaagttggttctaccctctgctctaggggttgctaaggtaatcagtaaatctcatccttctagatcctgtgatgggttcagaagagaacacaaaacccgatttgagccagtgagagtcactatgaagactttactttctgaaggagagaaactctctatctctaggcatgtgcataatgcatgctaggcttactgctattggagctgagacattgcagatggaagcccatcagagcatggaaccaacacagagggaaacacagctgagcaaagagagagaagtcctgtcctggtgatactgggatgagcctttcatgaagcgatgcctgaccagctcttcctccaattcctcagtcgtttgagccaaaatacttccttgttgcttaaaccactaagggttaggttttctgtcacttacaacccagagtttcaagagatatataccatgtcttaccaacatcataccttagtataatggtctttctattgatctctctgctgcatgagaccttaaggtctgtgaggacaggcctgggtcctatttccctttgtatctccagcttccaacatagtgcttgactatattagatgcaagtatttgttgaatgaaaaaatgtctcagaggctaccttgactatttcagcataacttgttcaatgctactggtttatccaggtctaaaagtctgctaatcgtatcagcaaggcataataggatgggaaaagaattaatattattgaatgcctgtcagtaactaggtaatgtatatgatactttacatcatgtcttttaatcagaaagcataattgctttctcccttcctgctatcccatgataggtctattactatacttccaagtcagtaaaataagaataatgaaataagaatatcaatgaaataagaatatcaatgaaataagaacaaaagtcagatgtggtggcacacacctgtaatcccagaactttgggaggctaaggcaggtggattgcttgagctcaggagttcaagatcagcctggacaaaggtgaaaacccatttctacaaaaattagctgggtatggtggcacacgactgtggtcccagatacttgggaggctgaggtgggaggattgcttgagcctagaaggttaaggctgcagtgagctatgattgtgccactgcactccagcctaggtgacagagtgagaccctatctcaaaatatataatatatgcgtacgtttagtatctaacaagaaaaatgaaaggcagataaaaagtatacatattctattctttaaaaggcaataatcatttgaatcttttgagttcaaaatgctgtgttttataaatttataaatgtgtctataaatttttctttctatttcttctacttcttcttagcattgaagtgagcaattttattaaaatctgccattttggtagtaaaacatttaaattcaaagtcaccttaagtgagtgatgtgcttgttgccagccacttaattagctgggggatgtgacacagttgtctacatgcaggacaatttcaaggtcactggtggaaaccctctcacctccccatgctgccagcttattgtcccatacatggtaacattcagatttgggactagatggccaggagaaaagcactgagtagcctcactccagaaggattttttgtgcttggctccctgacttctcctttcgttcagggagcatgcagtggtgagaacacctaaatcatgatccttgtcctccatctataactaattcgtattgttttaggttagtttctcagagcataagaatgaagactgtagtatggcccggctctttcttaagaaagcactcttgatgaaacaatctacataagtagactgaccagttaaatatggttattaatcattcagttttatctgcgtaatggtcttatcaaaactaattattgccatattaggtagatatttagagagcacccttttatggaccaaactctttgcagaatacagatactcaggaagaggatctcttgtcttgaaggagctgaaaattgagttgagttatcccagaatcgcttttttcctttagagttggaattttgacagatggagaaaattatctaataaagtgttcaaaaacttggttggcccgtgtgggttgaggattaatccgttagagccacaggcagattgagcacactattcttagctcagaagaagcaagttattcagagaaggatgagagatggcacattccctctagttcctttttgctgctagagaggtgagcttccaggggctcctagttcaggttgcttgtatttttttcacctacatttggtctccacaagccttcctttcatcgtcagatttgtccaaaatttaacacctgtgtgtgtctaatcaaggaaggacatgatatcacattatgagtgtatttaggtgagaagtcattgaggaaaataatgtttgtcatttgaaagaaagaagagtgttttatttttgagtcacttcaggtctttgtcctgaagaacagattcactcttgtttaaactctgtctcagtgagaatgtttgcggggatgggaggtagcacttcccattgcatctaatcatctagaaaacaagagactacaccttaacagtgcaaatccttttggaattgatctacctggtcttctgctttttcctttctccactctgctttgtcctgaattcccagaaatgccatcttaaaactcttctaaaactgctggctactctttcccctgtttttttctaccagtttttttgtttttgtttttgtttttttttaaaccatcatataaagagacagcttccaaatggtactctgtaattgagcaataaacaacaaacttttgtctgtatgtatccatactaccagtcaaaatacttaataacaaaatatcaataaaaaatggccaatgtgacatttttcatcttgtgtcaaaatcagaaccctttgttttaccatttgcttttaaatctggggggtacataaattcctgagaaaatactaagcatatacatcaaagaaattcagacaaatatatgtgaacagagcaggtcactgacactaatcttggccataacctagagttattcagaaaagatgtccagagacaaatcttggaggttttgaagaatcagaaagataagaggaaaatctggatacagaggtatcacagaagccaaggaaagtgttttaaaaaggaagacgaggtcaacagtgtcaggtgcagctaaaatattaagtataaagaggactgaaaaatatgtcttgaatttagagacttgaaggttattagtgaccttaacaagcattgtttttggggagttatgcagctagaagtcaaactggtaggttgaggaaggagtggaagctaaggcagttgagctgtgggtacggacacttccttcagattagctgtaaagacagtagtaatagaacagtggctgtaggaggataggggactgaggactaggaaataatttattttagatgggagatatttgaataggttcaaagcttattggaaggattcagctgaagacagaagtccggtaacaagagagaaaatataatagaatagataatgttaagttcccaagatccacaatgacccccaaacgtaagaatcatcttagaatagacttgggatacgaagttcaactgcaaaataccctatttttagacagcctccgaatttaggaaaccatgtccagcccagaggaaaaaagaagagggctgagttactattttctccatgtttgattctaaggaatgtagcattatttggatattacataaaaccttggaaaataagggaaggggcaggccgtgaagatatgtgcaattaaaattagaaactagacatggccagtaaattgattacaagttaatctagctttgccataacctgagagaggtgatgtagtcaggaagttaggttttatctcaggttggctttctaaatattgaaagctgtcaccaaagaaactagcatagaaccagtacgttacctgggggagagcacctagagccacagatgttggtgtgcctgagaaagtccagaattttaaaaataaaattagaatagctgtgaccggcagtaccctccagactcctcaattgcacacagctccctttgtgtccattttgaggactcagcaccaagacttctaagacatgaagcactgggcaatgctttggggacatgacaatgctaattatgctaaatactcatgatatgttgtctaatattgatattgataacctaagcaaagacttactttagctaagctgaccttgctgaattgcctgtgttagctgccaacaatgtcaacagagaggagagtaatggtcaaactggaggcagatagtgttatgatttatgaggggccatgaaggcagtgtttttgtccatgggagctgtgattagatgctgtgggtagctgaatacagttgagatttttcaaaaattggcaggcatgttactttggaagttctccagtgacacatcagagatttaattattacagttttgtattcttgctttctgtgacatctctcccctttgtgcttaatcaatgtttgtttcccagtatgtgtttgtcactattattaattttggaagatacaaggaaatccccaaatcagtaaatgccctctaggagtgattctctagtcttgtagttggacacaaacccacaacataacctcctttgtaggctcatgcaagaggaaaggaattcagcatagtgatggagtaggcccagttccaaggatgccactgggtatcctgtacatccagagaggaacagggcaacttcctgactcttttacgtcactttctgaaaggaaagggaacgtttcaaagtaggaccatgcacagatacctgaccacctatccctttttaaagtcccacctgtcaagtctctacaccagttgtattgcattacctgggtaaaggagtcaagtgggaaggggtggagggtagtcccaagctaatgagaccagcattcccctgggttattttatagtttatcttattaatcctagaagcttgactatgaggcctgtgttaggaggtttctccttggggaaagataatcttaccaacatctttgggctgttttcctaattcttaacactactcctgtatatttcaaactgggagctatgaaatagacaggtttgcctctcgagactttctatgaaagcttttttgatgttactcctgggagcttctcagtgggccaggaaagaggccccaaagccacactgtatactaggctaagtcaccacatgacgtatgtaagattcacagaggatcctcttgttcacctatgacgaggccagacacaggccctccaaactccctttctctgtctcataaatgattagctgaacgtttacccccctgtgatcaatctggacaaaatacttactaatttgatttgaccgctgtagtgaagcttgtctcctcctccacagcctgtaaactttgactcattcctgaagctaagcaagtgttggaactgggaacaacccctccttaatggcccttcctgagactctccattggctgcaaacaaatctttcttgttcagctgtcacatcatcccacgtgtgcatcccccatgcctagctccttctagccatgtttattcctcttcattaaaagagaagccctttcagcctgaccatctggatgtttatagatcttatggtcagagtcttttccctattgcaaaaatgatcctgtccatttggcgtattctttaaaagtaaagtctgtccttacctaagtctaggtttgtttttatttgacactactctctatattttggtatttaatactgtgtacattgaacacgatcttttcttgatgacctagcttcatctttaagactattatcacattgtgctgaagaggtagttgtcagtgaggccaattctgggtgggatattggctgacctggcactaatgctggagccaacttatttctgggatagagcagctacttttgttttatgcattttgagttacattaaactcatttggatagagtataatggtgacctttcacttggccagaagaaaaaaaactacactgtttattttcttatttttttttttttttttcactggggtctcactctgtcacccaggctggagagcagtgggtgcaacctcggctcactgcagcctctgcttcctgggctcaagcgatcctcccacctcagcctcttgagtagctgggaccaaaggcacgtgccaccatgcccagctgattttttgcatttttgatggagatggagtttcaccatactgacactgttttaaaaataatcctagaattcgtaactttctagcgtgtgtatgtataaattacaatctgttatgtttagaaattaacaagaatcaaataatgaagctaattttccaaaacgtgattgagctacaatgcaggcgtctgaccatcttatttttagcccccaaggcatgcaaatgttagaagaaaaagaatctttaaaattgcaattgatagtaaaattgcttaattatatgtataatatgtggaagaatatgtatatacagccatttatcaaaaaagaggtcaggaaagttgggtgcagtgtcacacacctgtggtcttagctacttgggaggctgaggtaggagaattgcttgagcccaggagtttgagtccagcctgagcaacatagtgagacactgtctcttaaaaaaacatggggagtagggtaaggaaagaaccaggtaaggatggaagaaaaccatccagccatgaggacttacagagcaatatgatagagaaattattctcatttcttaatataaataagaaaaatgagatttgaagatttgcaatttgcataaatttacctgacttgtaagtgccagaaccagagttagaactctgttattctattttctggtctatgactgtcatcaggacactgtgaagcctttcctttagtgagttccaggtaacacagaccagaaaacagtcctaattgtattcgttgttgttcatgtcactgtcagactctacaacttgttgcttccattactgatttcaataccaggggctgctatccactcttctcttcctccttttctaggaagccttactgttcaaatgtgtaaaaactcattcttgacttccagccaatcagccagagacatgaccttcatgcagaccatcatctctttgaggctgtgtctatttctgagtgcttggaggctgctgctttgctgacggggtagagatagaaagaaagggactgtttctctgtttctccctgttagaaatgcttgttgcccagtgccataaagaaatagcacttgaacataaatttaatttcctcagcaaggccattttttttactttctgcagaaagggtacactcaccagcagttttgccatgaaagtacaccaaacaaaagaggcagggtcatttataacctgatgcgtccaccctactgctgtgtcccgtttccattggctggaacgggacctcacattctgtatttgtcctgattggctagcaacttagaactttttaaaagaggcaaaggcagaggagaacaaaggaaggaggaagtaacttgtggaatgccgagaaaggtaaaaacaccttcaaataaggaagaggaacaggctaagacctaatgcttgcttggaccagtgtaagcatgccagggcaaatatttaggctaaattgtgggagctaagaacataaagtacattgatttctttattatggctagcagatatttaagaatgttagcacaggtctttgaataatttttgcttctaagagaagttactatttattcctaattagatggggaggaaagtctttgaagaggaacccctactttattttctatactccctcaccttcctaggtcgtctgaaggtttcctgaggttctggaaaacggaaagtatcctaaatacttaaatagtattatatgctaccaattaattgtccactctatcatctaaagatctcacgacaaacagtatatggaagtatatgtttcaccttattctgtaggtccaaattctcttttgagaattatgtggacttcagagctagtttgtttcatggaggtagctagtttgtttcattgacatgctgcatgcctcacttggtaaggctcaggcctcgtccagagcagggtatagcctttggtctagccaaccttgctggatgttgtaaagtattttagctattggattatgctttctataaatgtaaagatgtcacgggacctcaggtgtattcatgcaggctttgccatttatcctagctccaattagttaccgcaggtacagcaaaacaaatgtaaggcaccgcaccaacacgaggaattatcagtcttgttactaagaggacagaggaatccctaccatgtagggtaaatttctttctaggccctttaaatgtgaaatgtaataaggcaatttaaagatcatttcactaacatgtaaaggaaaatacaaacatgtgcacatctaattgcaggtcttacaattttggttctaaggaaaataattaacataagctcaaaatgacacttcctgcctgggaacagttctggcgaaataatgaacctgtagaaataaaattgaagagctaatcagccttgaacggcgctgaggtgtgtgtttctctctctctggttgctgttcatctcttgcttgtctctctgctttcccctatgcctttgatgagacacataatttttatgttgggcgacaaggtgacagttctctctgataattacatagatgagaatatatttggttttggaggaaaaaaatttactttacaaatgtatatatagaaataactttgaccttttggtaaagataaccaagttcttcctcagcaacagaaaaacaggcacattcggaggtgtgtgtttcattttatagtggtagctcctcctaataaaaacctttgtaaggaaaaggacaaagttgttggttcagggggctagcggtagaccccttctcctaacagctcaaagataaggtaaatcaaagtgccccccaagagttaaatgagagaaaacccacatgcagtggatagcattagccgtctgtggtgggaaaggaacagattgtcaatgaatgcatggttaaagagtttgagaacacccaaaactttaatcaaggtgatatgggagcaatctcatgaaagtagaatgggaggatggttgcatttagccattacaacctcatcagttgcattcccacaggaagactgcctggatattaagatgatgtcatcacagagctgggattctcacagtgtggtaagaagacctctagcatgagaatctcctgtaaaaatgcacatcctagggctttactgcatagacaccaaaaatatttggagtgggctcaaagaatctgcattttgtttatattcaactgaattttcttttttatagtttttttctaatttaaaaaaaagtaacacaatatgggctcattgtaaccaggaatgcaaatatgaggaaaggaaaagtaaatcttggttgatccttctttttctcttaccctgaggtagcaatactagtagcagttgttactagcaacaatactggtgagcatgagcatccttccatgccatttttcacacttacaaacatatatacatttttaagaggttttattttttgcttctcttgtttgtttttatatactaggtcatattataaaatttggagatttacttttctcaagtcataatgccaaacactccaggtattttaaaaatgtatgtacatctatatatgtattcacacacatttacacatatacatacaaacacccacatacatatgtgtgtcaggttgcttgaaaatgcagcttaaaacccatttagggctaaatactggcacagtagtccagtatcataaggaaaagttgaaaaaaactttgaagaatgacattcttttaaattctatagttttctatggaatggattattaagatattcaagcgtgtcccataggtgaacattcaggttgttttctattgttgctgcatgtgttttatttcattgccattacaaatgcctttattttggggatgatagatgagcagaaatgggatttccgagtcaaaggctatgttcattttaaattctattagtattataatatgactttcctaaaagcttgaggtaaattacagttgattatcatgattccacttagttatgtcctataaaatcaccttgagcactgaagtagcagacactgactcactgtgttaatgtattaatatgttgtatcaatatattaatattgaattaatatgttgtatcagtatattaatattgaattaatatgctgtatcagtatattaatattaaattaatatgttgtatcagtatattagttattaactctggaggaaatacagggttaggtttctgcaagctccttgtcacacatttttcaacccatcaatacataaccttgttttacatgtgtttctgtttaaatacatcttatttatttatttatttatttgagatggagtctctctctgtcaccaggctgtagtgcagtggcacgatcttagctcactgcaacctctacctcctggattcaagtgattctcctgtctcagcctcccaagtagctgggactacaggtgcacaccaccatgcccagctaatttttgtatttttagtagagatggggtttcacgatgttgtgcaggatgatcttgatctcttgacctcatgatccacccaccttggccttccaaagtgctgggattacaagcgtgagccactactcccagtcagcttatttattacatattattgataacctagcattgaactcatggccagcaatatgtcccatgcctgaacaatgcttatctaacacatggactttctctatcaggcactttacagactaaagtgcctttactaaagtctgtaaagtgcattatggagaaagtccatgtgttagataaggattcagccctgtgcagaaaatgtggcattaaattgaccaccaaaaggatactaatttacattatgagggtgaaacaagaaaggagaatgtcatcttgttctgcctggactgggaacatgcatgctgggtgaccacactgcacgtgaccatgaatgaccacaaatgatctccaaagtgccacaagtattggctttggggttacaaatacatttgagagtgtaggcaaatttgtgaatacagaatccacaaataataaggattgactgtatattcccaccagcaaagtgtttgtcatgttgattattcttcgtcttcactgtttcattttttaaaatatttgtgaaattttaggggaaaactatttcctcgttgccaactaactagtgaagttcagcctattttcttaatttattacacatttaaatgcaatctttgataacttacctgttattatattttgccctttttccaaccaagtgacttaatttttttctcatcaattcttagaaactgtatattagggatatcaatactttgttatatgttatgtaaatacttttttattctattgcttgtcttatttttgttttgggtatctttgctatatgttttaatactcaaatatatcaaccttcctcttgtgatttaaggtctcctgtcttattgtatctccaagactacatagaatttcacatttttattccaatatttttattgttacatattttgcattaaaatcttgactccatccagaatgtttttgtttctagtgttaggcaggggtctatgttcattttttttcttccagacgaacattcctcagttgttccaaataggaagagaggaaatcaacctctccatgtttgcagatagtacgattctctgcctggaaaaccccattgtctctgcccaaaagctccctgatctgatacacaacttcagcaaagtttcaggacacaaaatcagtgaacaaaaatcagtagcattcctatataacaacattcaagctaagagcaaaatcaagaatgcaatcccattcataatcgctacaaaaagaataaaatatctaggaatacagctaaccaaggaggtgaaagacctttacaatgagaattacagaacactgctaaaagaaatcagagatgacagcaaattgaaaaacattccacatgaattttttttttcccatctgaattgttcctggatctacattatccatgcctggtttccaggccctctcagagattctgtaaactacttatatcctttattgatccttttctacttagcctggataaagtagattatgattttgcaactaagagtagtaattggtgctggaaatatttgtacctaatggactgtcaagtaaatgggaacctggggttagctatttaacatagttgagtttgaaggcatgtggagcaaaacatttccgtaaatattggctttggttaattggagtgaagtgcctactgaaggcagcattttgggaaactcaagtggctgcttccgtatagtattttaagaaacgtggctgtactggctacatggaattgtgctaaaaatcttaaggaaagaaaaataaaacaggctcaaggttttaaattattgcctcaatgtagtctcagaaaacaagagaagttttgactggcctaaaagaatatcgtcttttatagcaacaaggttgatgaacttgaacatcaaacatatgctctgattctgtgacttattgaattacaggctgcattgaaagattggctgtgtttcttaagtgaaatttaggacattgggaagaaaagaatgggaccctgagaattagagtagagacatttgggaggattcagatgactcacactcccaacctccctaaatcctccttatcagcagcagcagcccttatcctctgaaggacacaaacctgtctgaagaccttagaaagaccttgcctagcttctaagaggatgccagttcctcatcactcactcctatcttattacctctacttatctatttgaagtcagatcccagtgtgtcccagagatttaatcataaagtcacaccttgggagaaatatatttcttctactactgccactgctattgcaattttttacataccaaaaaatcacaagattttgcaatttatgtctacaaaatttgcataaagttatccattgctcatcctaattttcttcctaactaaaagggacatctgtttttgcaatggctctagtagaatactacatttcccaagcttcctaatatctaggggtggccgtgggacctagtcaatgagacataagtttaattgtactgattattcctaaaaaaaagttttggtatcctaagaactgctcttccttcttctgcattcttccttactgcgtgggcttggtcacaatttctggaactatagaggtcatcttgcactcatcagggaaaggccagaagaattgctaggacttccaatctgacatttttaaacccctgaacaagtgacgacaatcacttttactttttttttctgtaattaatggaagggaaacaaacctaattgatacattcagccaaacacaatcatcagcagtgatgatgcaaaaatgtagcaaagacatagaaagcacctattttccccttgaaaaagtgaaaattcttgagtttcactgattttgctaatttagatcccataccaacactttattcaattagtttggccagagagtcgctgtgtgctagttggcttaggccagtagggccctccctgggagctggggtcaatcccattaaccccacttgtttgcagctccatgggaagaagtgctaagaagaaaaaaggagatgtttggatgtgaaataggtgagtaacatgtccacttcatccctattgtgaatatgtcattaaaatttactactcttattccactttcatggtcactgaacaatctgctggttggatttgacttctcatgtaatttataagagggatatgaactaatcaactaatactagcattgtgatctgattgctggtttagttaatacatttacatagacgattttatgaatcagcatctctgtctgagcttagttaatgtaagtactccacccccacctccaagagatctgctctgcctgtgatgacaagccaggtcttgagtctgtaaggatgttcagggccagatcccagaacagggaattctccaggtaaatggcatcctgcccactcactgcctggggaactgcctttgctgtactttttagcttctccttgaacccttgaaactgttgtagatgtcatgagtgttatttttcttcatgtaagatttcagcagtagcatgtgccctgtctccaggagtaccaaagataccatgcagggtgggacagagccagttcccatcttcctggagtcaacatgattctagaaccttcaccactatagattgtcatcacttcgattccatttaagagtgctgtggcagatgtaactagaatgataccaattgcagaaatgcagggtgagcttgcaaaacaaaaagtcattgattctgtaacccataggctaccaagtgtcatgcaaaacatctggggtatagttaacttgccaatatttattgagtacaataagatgtacatctgactaatagagatgttattagtaatactcaataggataaagagagttctggatgggaagatagaagctacactgctaagtgctaattttctttactatggatgcctccatgagcaaatcacttcaattgaacggccttcaagtttttcacctccaaaactgaatactgtactcacaatagttaaatatttcctgagcagttttatttatctcattaatttactttaaaaggcctttcttcgtatcacaaactccaactggattgtggtttctgagcaaattataacaaattttgtgtttgtggaatccaaattaatgagatttaactgcatgctaattaaaacgccttagaattctgcaaagactttcccttcaagagttcaaatttgttgatgaaattttctcgttagacttcacaatgagtgtggaaaacaaatgatcagtctgtaagccctaaaaaaagaaaaactttaagatattcttcccaggttttaataacacaacctggcagcaatggaacaacctcacaaacctggccttaaggttatcttgcaggttaactccctctcttaaagagattcttgtaatgatttaaaaccaaatggcgacgtagcattgaggttcaattagcggattccttagttgggtcttgatcacatctctgattgtcacctctaatagggcgtattaaaatttccattcattatagtcattagtctctgccagtgataaggttgtgaacaaatctgttggtgttcaacttctaatttgtgtgataatttgtttatgcttagaacacttactggttgtggatggagggggtgtgacccatttagaaactattcatgtagataaatctggaaagtttgcctggaatggctaaggcatggtgatgccacctagtctagtaatagacaagggccacttagaaggtcagatgagtcttattccagagtcaggaagagaagtggtttacccagagatgcaatggggttgcttcaaatgatccagaagggggtttttgcatggaaagaaaggttccattcggtcattgttactctacaaatggggagaaaagcacctgcatcagaatcatctgagaagcttattataaaggtaagctcttgggctacactccagacctctggggctagggccctggaatctgtgtggttagtaagcaccccagattacgcctaggcgtgctgaaattgagaaccactgcaggagacacctgagagcagagacacagaaacaaattaggtatagcaaagacatcaaaacattttgtagtaaagtattgagaaaccattcaacttgcatttatcattgggatttttgccgtcaacagctgaaatacaatatttaagaggaagaaaatttcaaatttgcaacaagccataagaaatggggcttggcaaagtgtcttactcctgtaatcccaacacgttgggaggccaaggtgggcagattgcttgagctcaggagttcaaaaccagcctgggcaacatggtgaaaccccatctctacaaaaaagtgcaaaaattagccaggtgtggtggcatgcacccagtctcagctactcaagaggttgaggtgggaggatggcttgagccctggagggagaggttctcgtgggcaagatggtgctgttgcactccagcctgggtgacacagccagaccctatctcaaaaaaaagaagaagaagaaaaagaaatggtttgggtgtgggtttttttttttatatactttagaggctttcaggttttttcttgctctgtgtggtcttattgagttatttgtgtttgagtttggtacataaaataattttagtacttcttattatatatacaagaatcatggatatgctcaactttatgtctcctatgcctgaaaagttgtgcaccaataactcataagtttttttaggacactgtacactttgtgaatctgatgaaaggcgtggaacttgattcccacaaatgtgtgtgcatcagtatataaagcattacatttaatctctggggacttagagatcagtgctctctctggactctacatcaagagcctctgacctgagcctaaaccacccagcctgctgcttcacaaagtcaagtagctccacctatgactcagccatagcaagcagggaaaggccatggtttgtgtgggaaaaatggatgaaagcaaaactgaggaattcagcagtcctcgaggcctcgactcacacctttaaatctgttggaattgccacaaaaatatttgttttcctacaagaatattagagatttacccatcttgagtggcaagcctagatgccccattcactcatcaaggcctgatgccatatttagcaaaagagccataactgaaggtgcgtttgatgaatttaataggattatgtcttactaatgacattaggctcctgggtcgggcttagcctttatatttacgttttatcactgcaaatgaagatgatattctctggcatatgagttttgcaacctcagggttagtcttgtgatatgtgaagtggcccttggcttgttttgggcccattataaattagatttttaaaaaaacattcactgtgtttattttttattttatttttgagacagggcctcatgctgtcacccaggcaagagtgcagtgatgcaatcacagccctctgcagactcaacttccctgggctcaggtgatcctcctacctcagcctcctgggtaactggggctacaggcatgcatcaccatgcctggctaatttttttggtattaattttgtagaaatgggttttcatcatgttgcccaggctggtcttgaactcctgggctcaagtgatctgcctgcctcagactcctaaagtgtcaggattacaggcatgagccaccacgcccagccaaaaaccattcgctttaggaaaaagaaaaatcaaacttcctataataccaccaccaaagatacctaacgttaataatatagcatgtattcctctagcaaaaattctatgctttttgcaaaaatagggtcatactatatttagtgtaatcaaatctggcttcttcacttatatcttaaatatctatttcaataagttccatctatcatgttcactggctgctaatattctccaatatttatgtatactttaagggtcaactaatagatgcttcagctcattccataaatgagatttttctaacatctttctatgcttatagccattaacatttgggatttttgctgctgttatggttaattttggagtctctgaagaaacaggtgctttgtagcatccagttttcttgcttaaaaggaaattcctcagagtttaagggtgtttagatgtaattttcacttttcactttgttctggaaaactaagaataaataaaaatccaaatctatagcccatgtccacccactcctttgaaagtaatcaacctcagtctctgaaatttcaaaggaaaaaactgaaaataccactgaaatcatttttaattagacatttagcagttcctaaagcaagttataatttggccttcaaaagcagtatttttaaagaagggagcattttaattggtatgttctggcttagcatattttctcagacattaaaattttaaaatctagatgtcatatcaaagtatatgagatgaaaaatatgatttcttctatctaactagctaaactgtggcacataactggacgtgtctatatggatggatctctgggagaaaagaaaaacttttctattagctatggcttgatatatctgggggcccagagctgccaattttatatcatgcatatgctgtgtagtatctcctactcaaagtgtggtccacggaccagtggcatcaatatcaactgggaacttgtcagataaatagaaccatgaatcccagcccacatatcctgaatcggaatcttcattttaacaagatccccgggtgattcttatacactttattgattgattgcttgattgattgagacagagtcatgctgtgtagcccaggctggagtgcagtggcgcaatcttggctcactgcaacctccacctcctgggttcaagcgattctcctgcctcagcctccaggcgcattccaccatgcctggctaattttttgtatttttagtagagatggctttttgccatgttatccaggctggtcttgaactcctggtgtcaagtaatccgcccaccttgacctcccaaagtggaggcattacaggcgtgagccactgtacccatgcatgctgttgaggacaccaaacaaatcaaaccaaccagatatatacacaacattcatctacttctctccactagatatacgacatttctttcaaagaacttgattcttgcaggtgtttgtaaagtgatttaaaatatgaagatgttgtatgtgcattaatataggaatgtgtgtgttcaatcaaatggacataaagagttacatatagtgaaacttctcactttattttgataataggagatttggtgagcaccttcattccttcttttcattttaatattgcatactgtgcagttttttaaaatttgttttagacacaagatctcaccgtgttgcccaggctggacttgaactactgggctccagcaatcctctcccctcaacctcctgagtagctgggactccaggcaagcaccactgcatggggcttggaacattttcttaatctggagacatctaaattaagactacaatattaaaatgatgaaaaaattgaataaagatgttcaccaaaacccctagtgttttgggcaataatgattttaaggctttgaggccccttcccaatgccagtcattctacaaattgttcataagcacaagcaaaatcgtaagttgtaatttggccttcaaatacagtatttttaaagaagggagcattttagttggtatgttcttgtttagcatattttattagatgttaaagttttagaatctagatgtcatattaaagtatatgagataaagaatatgacttcttccgtttaactagctaaactgtggcatataactggatgtgtctgtatagagggacctctgggagaaaagaaaaacttctattagctgtggcttggtatgtttgggggtcccagagcaagccagatacttgactggggaggggggaagagcaatttatgtgccagtaattacaattataaacacatgaatgtcctgggattggagaacctgttctgtatgagggtaccaggagatcttaacagtggaagaacatttaaactgaatcttgatgaataagtaggattccccaaggggaaccaggaggaaccagcacctcaggtaactggaagaatgaatatgaaaatacaaaagtaggccaggcacggtggctgacacctgtaatcccagcactttgggaggccgaggtgggtagataacttgaggccaggagttcgagatctgcctagccaacatggtgaaaccccgtatccactaaaaatacaaaaaaattagccctgcattgtggcgggcgcctgtagtcctagctacttgggaggctgaggcaggagaattccttgaacccaggaggtggaggttgcagtgagtcgagattgcaccactgcactccagcctgagcaacagagcgagactctgtctcaaaaaataataataataaaataaaaataaaaatacagaagtaggttaccatgttaacaaatacgttcatcatcttgttagtagggacccattggagggttttaatcaaggaatgccattagatttgtatttgagaaagataattctggtggttcagtagaaatagagcaaggtgaggtcagaggcagggaaatcaactaggaagccgctgcaaccatctgagtgacagaagatgaacttgaatcgaacattgaatgtagcaatagtagtgtgggactaagttcagagacatgctggaagtggagcaggcaggttagggactgagcaaagaggtagcgtggggagactagaaagacaagaaacactttgaagattctagttcggggctgggcacggtggctcacgcctgtaatcccagcactttgggaggccaaggcagccagatcacctgaggtcaggagttcaagaccagcctggccagctgaccaagatggtaaaactccgtctctactaaaaatataaaaatttagccgggcaaggcggcaggtgcctgtaatcccagctactcgggaggctgaggcagaagaatcgcttgaacctgggaagcggaggttgcagtgagctgagattgtgccactgcactctagcctgggcaacaagagtgaaactccttgtttctgtcttcccttccttgtgaaatcattgtagatacatttgggaaaacaacacaaagagattccactgtcccccaatagtaacgtcttgcaaatctatagtaaaataaacccttctaaaaattgtatgatttatgagcaattttaaattaaaatatcagtatactctcatgctgatttctaactagtcatttctctgacctcccacccctcccctcaccccttggcccctaccaccctcccacacacatacctaatggctctccagaccaggtcctgtccccatgctcccctgatcaagcagatcttgaaccttgtggggaaaatcacgtctctggtggtcactggatgcctggtgtccatcctgaccctctaaagctagggcttcccattgtgggctggtactccctacatgtaccctccatgtcctcttgtagggaccccagcttcagcagtgctctttaccatgttgttaaatatatggcaggttggggtttgattctggccacagctctccccagataactgacagagtcatttagggcctttgtcccacatttctgggaaatttgtttctataatagttaggactttggtatgctagtgacagatgcacagatcaaattaacttaagaaacataaatgtactggcttactgagttgggaagtccagggataaagctcccttcggagattctgggactcaaacaatatgatcaagattctctctcccttgcacttttgctgatttgttgacctcatgctcttcatggtgtggtttatatggccattggcagatctggagatacatccttatatctcagagtgacacatgaggcataagactcgcttctccaccatcactgcaaaaccctactggagaagggctctgtttggcctcatttacatcctgtgccaatcctgtgggccaatcacttgtgcagggcgatgtagtgtattttggatgaatcaaccaatgactcagcctgagctccttatcatctgatagacttggaattggggtatcaaattgtctggcttagtagaaccagatggaaagggaagaaagagtttttcaaaggaggagatattgacgggatgggctaggcagaacagctaatgtccattttagttattcctggatctagcgtcttctcctgtggtgaggagagaggaatgtcacatggcacctatggttgtctcttgggagttatggtcagtgttgacagaagaaggcaaggatggctgtaagcaccaagatgtttatatgtatgaggttggaatttagaggtgttcagaactaatagccttaattgtctttgtgaaattgaaaacaaaagcacttgtgaaaagacaggaaggcagggtggggagcttaaaaagctagttgagggtttgaaggatgagagagagatcacaaggacagtgtagaggactgctaagagatattgaggatccaactaagattggaaactgtagcactcaggattctccagagacacagtaggatggatatatatgcgtacgtacacacacacagaaatttatttcaaggaattggcttatgcaactgtgggggttgcacatctgaaatctctaggacaggactgcaggctggaaactctcaggcaggagctgatgctgcagtctcgaggcaggatttcttcttcctcggggaaacctcaattttgcttttaaggccttccaggtgaagagatgaggcccacctgcatgatcaagggttatctcctttactgacagtcagctgattgtagctgctaaccacatcaatcaaatacttccacagcaacacctaaattagtgtttggtgggataactgggtaccgtagccttgccaagttaacacatacattggagtgtcacagaggcctaaactctgtgagccagtctgcatgacactagatgatctatttttcctcttcagttccacagagataaatacctagcaaatagaagccaagagagtggattgttaaactgattgatgattggaggaatcttcaggctggggtcactggagtctcaaggggagatcttgacgttgctgtcgagagaatggtggacaaagtccctcagggttgtggctggactgagaagttagttccccaagcgtaaagtgacaagagcatcaaccccaccagttaaaatgaataatgcatgaataatacttatgttgggcactgaactaagtatcacattaattttaaattattatcattgttacgatttcatttaattgtcaaggaactgacactacataaagtcagagtggatttagtgggagtaagagggtgagctaaatgtggtatattggagtttatttatttactcaaccaccagttatttaataagcattgattatgagccaggaactgttttaggtgctagagatacagtggcaaacagaacagacaaagtctctgccttcatggggcttaattctgttggtgggaggaggtatctgctaataagcagacaacttcagcaagcaacactagccccaggtccagtggtaagcgtgttatgaagaatagtaaagccaagttaggcaatagagagtgatggggccagacagggctggggtaggatgctagacttataagagaaaccctttcggataaagtgacatttaaacaggaccccgaaggcatgaagggagagcgtgggctatgaatatatagggaagagcgtgttcgagagaaagaacatggtgtgtgcaaaggtgctcagaggctggaggctgcttctccctgtaagtgaggaggagaggggtgggggatgaactgggataggttgcaacaaggagccatgttgggtgtggtgggtcattataagttctctggagttcatgctgagtgaggtggcaagacagtggagagttttgaacacagaagtgacaaggttcttctctaagggccgttttggaggccgtatgaggctgtatgaagggatactgggaggacaaggatagaagaaggagaccagtgggaaactgttaccgtaatccaggcaagaagaatttgtggtctgaaagccatgctaggtatgagcatgaccaggaccatgccacgggtatgcattgctgaagcagcctgccagcgaagaccaagatggcccaggaccctagagcagcatgtctggaggggtctgctgtgttgacatggaacttcttcaagatggagacaggatgggtgggcatggggagaagaactctgacccagattctgaagtcctccaggagagggaagatggtggaggaaagcagcaacggggtagaaagaggagcattagctgcatgcaggcaggtgcttgaggctcctgcctctgggtctttgcatgcacttctttcttttctgaaacattctcttcctaatatccacgtaactcagtctcttccttcccacctcagatctttatttaaatagattggaagactgctgtcaggacatagtttatgtaagaatgaagataactctcttgcctccatccttatgtcacctggcatggggtggcatgagcagccactgcctggaaggtctacttggaagtggtgtcctcaatggagaggcggatctggcttgaggctgggaggtgaggggactctcctgtgaaaggggtaggaatgctggggaccttattgaccatgggctaggggtttcagcaggcactgtggggagtgtctttagggaagtcaggaaaggagggtagaatcaatggggatgaagtaatgagaggaccagagggaacaggtgctgggatgggagctgaggatgccagaacatgggattgactgccctgggagggcctggcaagcctgaggctggcgtgcatgcagcctgtacgcttcctggggcaccaagcagagcatgggtggccacaggagacgtaagggagcgttgtctgaggggatgtgaggaatgaccaggtgctacccacctacagagctctcaggatgcttaactcctgaagaagctgtagcctggaatggcttgtagacctgaatgtataccaggtgtaactggcagagagggagcaggccccagaaggtccttgttcatcctagtcaggtccttcatcctgtcccacttcagggcccaaagtgctctgattctaatgccagcctctttggccttgcatttgtagagaagcgagttccctatcattggaggtatctaagcaatgaagtggacagccacttagaaggagtgtgcaggatggaggcttgggtatttcttgggggctggactcgaagacctttattttccacttggcctggagcgtctgtgagtccttgtcaaatactgcctggcacttacctccatcgggacacagtgcaggcatggctcaagtgggtaaattgtttatggaatgcaaacctcgtgggacttatagatggcttatcaatgtggaaactgtattaaaaataagttgagatcagcaccttccacagcctctgcatatgaaatgtcacttacatttaaacccacatcaaaggttctgggttgattctttgtatacttgttagtagtccaatgcttaggacaccattttcaggtagctgttttttagtgtgtgtttggcagggctggttctatacaaacgttcacagtgagcagagggacagcatgatgtctcctgccatggtttcacaattagctagaagagagagggttgcaggctcactgggccagaccggacgctagaggctgtattcagtaggtggggcagtggcatggacctctctgcccatgatgtggacatcctggcagatgggctgtttcgagagcaagccatggcttcaagaccttggctgtttgtggtgatggggtgaaggaccgaatagttagagttcgtactgagtgtctgtggtgcagggagattctaatcacatcatttgggggtagcggctgtgcttagcactggttaagggaacgaacgggcatagttgtgctatgcttgtgagtatgctcacttcctggagatggggagagtcaaattcttagagtgttgtgtggcttatatattttattaagcacctgtgttctaagtccgataagcactttgcgtacactgcctttaattttccgaatcattccgttttgcttgttgaggaaggcaagcagttaagacaggctcatctcttgacatgaccccacatagtgactgtacctcagaggggtaaccattttctgagagctgggtcccaactgtgttagggtcaaaattctgatttgcataaccagaggtgaatgaagacctgggaaactgacacatactatcttgactcataagagactgatgtataaaaacagaaatgatgccagctgcttattttgtgagaagaaaaaaaaaacaattctgtgaaccagatacatatgttctctcatcagtgcattcaatatgaaggcaaatttatatgaggacataaattaagatcagaaggttgcttatcagcatgaaacagtgtaggctgagtgaggataggacaccttactgacagggttacagagctgtgatcgtcttggctccagtgccaccctgcctgctgtagggctggatggtaaggttacctcacagtgacagggacaccaccaccagtcccagccgctctcagtctctgcttgcagtgcctctaacactgatcatcatcagcccattgggctgattcatcctttctttagacattttcctcatggaccctcagtaagttgtcatcttcctttgagagcaagttttctctttgtggtatctttgcatctcaccactttatttcgttatttttgttttgtggctataagctctacagagaagttgtattgttccatttccaaatttgtgggaaaggggaagaaaagaggagaggcaccatattgtcagcctgatttcccacctcagagacgatattcttgtcctcgttttacaattgagtcaactagatggcatggctttttttcctagctcccattgccatctgacgtggtatttatttagttgtttgtttattgtctatttctcctgttagaatgtaaacttggggacagcaggtctttgccatattcttggcatctggaacggtaagtggcctgaggtaggtgtgggcaggtaggagtatgcgtggattgaagaaggatgaggcaggccctcaatcccagtctctcccacaccccaccttcagtttggtgaggtgacagaagggaggaaaatatgagaagatctgagccaaaatgaaaatcagacaaaaactcagggcatgttctgggggtccttgtgtccctacatcgtcttaaagaaccagcctgggacagtggggactggagctggtgacacacaaggacccaagaatatggaaggcctttctctggcataattgaaataaactttaatgaacaatttgtcctgttttaaatatctttatagataatatctggagctggacaaatcatgtataatctacttcctttatcattcttatttcaattatatccatctacaatgtctcagccaaagggaacaccatttacctggtagcagccacctgaattttaggcattgatatctaagagaaaataagttgctcaatggttgctcctttgtaacgccaaacctaggacttgactatatggttctgatacagtccaacaatgtgctagttgataacagcttgtagatggatatatatgtattctgcatattttgtttggtgaataacccacagcattctaactcaggtgtccagtactgcttatcaaataaggctttaacatagaaatacataaattctagaaattgtcttgcatttattgtattagaaagtgaaattggtttctttaaatctttgtaagggctattaacataatatcttgttccaaatcaaatagagctacttactactaaagacttttgtactttcttcaataattaaagcaagcaagatttgtagacaatgcaattttcatgatgcattgaaaaatgtattcttacagcagctgtgtttatcacacactttcattttcttaatatcttaaaattgcttggcaaaatgaaagggaaggagggtggtcagggatgtttccaacattctattaggatcattttcacacaaacagaaaatctgaagtaattgttcagtgggtcccctgcacccatcacgtacattttacaattaatgttttcctctgtttgcttcatcactggctatccatgtattcatccctctcttcatcttatttttggtgtattttaaattaaattgcagaaatcagtacacttcaccactaaacagttcagcatgcttattattaactcgagttaaatatttaatatatatttcaggtaaaatgtgcgcacagcaacataagcacattttaagctttccattcattgagttttgacaaatgcatacacctgtgtaatgccaatcccaagccaaggtacagacattctttttttttctccaatttaaaactttaattaaaaagtaaactttaatgtcgaaaatgcaaacttggggaaggcagaaagatcacacacaaggctgtcacttcacacttggaaggttgcacagcggccgggcagaggcgctcctcacatcccagacggtggaggggccgggcagaggccctcatcacttcccacacggtgagggggccgggcagaggtgctcctcacttcccagacagggctgcggccagagagaggcactcctcacttcccagatggcagggggcgctgagcagaggtgctcctaacttcccacacgcggtggcagctgcgcagaggcgcttctcacctcccagatgggcggcggccgggcaaaggtgctcctgcttcccagacggggcggcggcattcttaccacccagaatggtgatgctagtgcctctttccagtcgatttccaccctacgtgcacgcagagggaacccatgttctgatttttttctcagcatggattactttagtctttcctagaactgtatacagttctagaatcatatagtatgtactatttgggataagtacatgcaatacatactactttgcatgagactttttcacgcagcacatttttgaaattcatctatttttgtttgcatatgtcagtaatctgtacccattttagtgctgaatcatattccattgtgtgaatatgccacaatttttaaatctatttacttatcgatggtcacctgcgctgtttccagtttgcagctattatgaagaaaattgctgtgcatgttcttatgcaagtctttttgtaggcataagctttctgattacttttgaaactcctggaatatgtagtcttagcacagagtctacacacagtaggtactcaatgaatgtatatattgccctggcacaaaacccacatgacatgttgggttttacagtacaccagacgttttcttcctcatctgttctcagatgagcttcgtaactacctgctgaagaggcagaggcaatccacacaatggaagctgagacattacataatcgctaattgttggagctaaactagaaccctggtttcctaactcctagtcctgtactctctgactgcttgctattgagacgggagagttcccttgacccctttgcaggacttgtgaaaggggtgtggcccacttatttgactgccaccatgctcaaaccccctgcctgagagggagcatgcaggtgagcaggtacaggagctgggggaatgtggcaagaatgaaccccgtactggtactggtcaacggcagcatccagggttgtctgcgacctctggagccctcgagggcatgtgttacaacgctcatagcagttactatctgcagatagctaagtgttaaccagctcagtggcaagtcagggtgacaggcctttacaccctgccctctgggtacctggcttcctgtctggtgtccaggaagaatcaggtcacataggcttgaaggatggttcaaaatatggagattttattaagcagtgggagtggctctcagtggaaagggagctggaaaggggatggtgcgggaagaaggtgctctatctctgaagcttggccgtctctgaggaggctcttctccaaagttgttctctttgaagttaagccgcatctgtttatagtttcggacactcagttgcttctccttttcacgttcagctgcttgtctctctgccagctaaggtctgaggtttatgtgggcacaggagagggggagcgggtaggccaaaaaggtaacatttgggtgggaaaacagggataactcttctcatttagggctgtggtttccaggcttgagggtggggcctttgccaggaaactgccctcttctacccagtacttccctgtctcctgtctgtatcgctatgtcagtgccaaaccgaaggtatgtgtactttacatcctcccttccccccaagcattgctctgtgccacagttacggtctttgagagttttgggtttgtactttggctctatttaagctcctggtcatcagaacttatgtatattttccccttttatatcatcttgttttctcagtgtgtatatattgaggtgaggggaggggcagcagggagggcctgtagagggagttattgaaaagtgacctaagccaatctggtacttttgattggcaatcagagaagtcagccatgaggttcctgagtctctctttctctgccactcccagctgctctgggatcatgaaaaccagcctccaacctgattctgcaacacatgaaaacttttattaacaaggagattcatataccatgcctaaaacactcatacaacctgttctgtaaactcaagttgtcccccatccgtggtttaggcagcccggttgttaccagtggaaggtgtccgagttactggcagcaattccatatggatctgcagcaacttcaattcttgcctcctcagaagaaagaattcaatggaggggcataaagcagaaaaagagactgaagttaagtttcagagcaggagtgaaagtttatttaaaaaggctttagaacagtaaagaaaggaaaattcacttggaagagacccaagtgagcacctgaaggtcaagagccccgtttaacggtgatgctaggactttctaggattcccatgattcctcccttagggtgagctgcctgcatgcacagtgccctccttacctttgggaattgtgcacacacagtgtgtttaggaagttgtatgcatgcccatctgtggctttcttcccttttctggtggtgtgcccctggaagtcatactttgccattttgtctcttaatgcacctgcccaggaagttgcttctccctggagcctgcgtttgattaacactttaatgttaacagatgtgcctcatcaggagattgtctctccctggtgcccttggactggctgctgaattatcatttttagagaggcagtgtgataattgtcagaccatcacctgacattcctagtgggtgggggagaagagccttctcctgccccgctcatgcctgtctaactacctgtaacacagtgagcacctctcttgacaccagtaatctgatagcaggatcaggaagctgcttcttgaggacagagtctttccggaagcagtaggacagtggtgtgaaggaagttctgggcctcagccctcctctgaaagtgtttgctaggctggctaagcccagcacccttttcatggaaattttgaggtttctagccatccctcaaatctctcatagccttcatttgaccattgaaaataatttctaatatccctttatgctaattaatgaactatctgttgcagattcagatgggagagttagaagcttttatgaggccacctctgggaatataaacaccatttgggatctttcaaatgctcactaacaccactgtcttggtacttcctgcttagggtgcttcatatattaactagtaactgttgagggtgtcctaacatgaatctacacacacacacacgcttaaagctcactatggatggcggagtgtttcaacataaaacccaggtcacattggggaggtactagagtccatgtgtccttcccctaacccccaccctctaacggtggcatttccaccagactcttgagttttcagtttgagggaatcctttgaataaatatgattttctgcctccacacttaatgtggttagagctgcagccttgatcctaatctgtctgatctcccatcctcattgatagtaaaccagtgagtaggcaagtcaactgtgagttaatcggggtgggggggatttttaaatgcaagtctgatgtttaaatgtagctctgattatgcctcttggctatcagaagtgagtttcatttggatggagagccattttactgagggcacacagcacagaagctgagctgcagtgtaaagctttcaagtgactcttggagctattaaagtgccactcatttggtaactgttgctgttaattaagtttgtagccccattattaattcttggctctactattattaattatgcttctataaatttatagtaggcagtacctcagggaatttttcaagttgtatattaaaattagagataaataaacacttaagcttccttctcaatataagaagagtttggggtttttatttccggtactaggtaaatttgaaaggtatgtgatggtcattttctctccttactgaaacattttctacatggtttgcagcagaaatttctgtaacatatttaacaatgcggtttagtatttaaatatttaacccattcactgataacttgtagctaattcctacaattaaacttacgcctttggccaggcgcggtggctcacccctgtaatcccatcactttgggaggccgaggcaggtggatcacgaggtcaggagattgagaccatcttggccaacatggtgaaaccgtgtctctaccaaagattcaaaaattagctgggcatggtggcatgcacctgtaatcccagatactcgggagactgaggcaggagaattgcttgaaccagggagtcagaggctgcagtgagctgagatcatgccactgcattccagcctggtgacagagcgagactctgtctcaaaaaaaaaaaaaaaacaaaacttatgccttttatgagagcaagcagacagagaaggaaaagaaaaaaagcctggcattttgtgtataaaaaatcagagctcaagtaatgttggtcaaatatagatgcaaacaagtccatgtgcatattaacaacccctttcaccatgtgctttatttctgaaaatactttaaatccttttctgtcttctgatccagctctccagacaatagttaataaatgggttcataggtaattatgatgcattttggttcttttacctacagcaaattcctttttttctctctctcttattctaagaaggaacaaaaattgcccataattctccaggttatagaaaacgtctattggcattttgatgtagttcctttcagatgcttttccaagcatatatcaaataatttagatcacacaatgttatggtttgattttaccccttaacatttgatgtagcaattctttattattggacatttaagttgtttataatttttgtccttgcaaataatagatatatgatatgttggatagctctttaaataaatatttgagagtacctctaattatctattttaatgcctagaaatataaattttttgcctaaaggcatgaacattgttcaagttcttgatacatactgaaaaattgctttccaggaaatgacgccaatttccagtccactagaaacattccacggtgtctgtcttactgcggccatgccatttaatatagctaatacaattataataatattaacttgctaactttataatttttgaattcggaaacttgaatgagatatgctggaacatcaaatagtgacctattttatctcaacgcttcattttgctttttggagccaaaagagttctttctctctcaaattggattcagtagttgaggggctacacattaactgacagtagccatattaacaagagaaaagacaatatttatttacccatgcatgggagagctgctcagtaatgagtaacccaccgactagccagagataagggtttatataccaacttaacaaaggtgaagggggcaattagggattcagggggaaggcatgaaggtgctcttgggcttttcagtgataatgggaataggaaatatgtcttcatggcagctgaattaggaggaaactgcctttgaggggagttaatggcagctgtatttttgggaggctctgctatagtcagataagggaagttcagataagacttctttctgcatctcctgcagctcaaatgttttcaccttaaaataacctttataaagactctgagggtccaagtgcatccccatactttctatttattttaacatcacaaataaatgtgctcaataatagataaatttttcatcatgaaatgtattgaatattagtaataatggtgttttctgccgtttttgacaggtaaattaccagtaagggatgacacaggaggagaaaaggagaaaatgaagaactgtcataaggataatttttattacagatatgaatatatttgtttggaactaacaactatttttagaagacaaattaggcagaagtggtcactactgtatggacaagggtgaatagtagttgtgattttcaaaaattttttaaacatatctcttgatacagtatttttccaacttcatttcttttctttttttttttttttttttttttttttgagatggagtctcgctctgtcatccaggctggagtgcagtggtgcaatctcggctcactgtaacctctgcctcctgggttcaagcagttctcctgcctcagcttcctaagtagctgggattacaggcgcgcgccaccacacctggctttttgtgtgtgtgtttttaatagagtcagggtttcaccacgtgggtcaggctggtctcaaacttctgacctgacgatccacccgcctcggcctcccaaagtgctgggattataggcgtgagccactgcacccggccttccaacttcatttctttcaagtcacagtcatggaacatgtttacaacttctgagttacactattttggataaatagtcataaatatcagaaattgaaaattagattaattcctccttattttgatattcacctaggaaatagtttttctacagatattattctggcaaatctcagtttcttgaatctcagttccttgaatcttgacttttgtcgccacccttgatttgaacatcccttggcagctttgtggataatacagtgtgagagacataattgaaaagcatgacaagtgagaaaatgggttacatacctcaaaacaaaggctcattatacatgacaatgcaattcatttgggtctctccattgcatatttgctacaggtattgattgccttccaactcttcccacagccttttgctagtcttaaaggcataaatcacttggtgaaaggatatttctatttcagccagataaactctttcctttttgtttagatttaatatgaaggcaaaatgcactgctctcagtgaacagccttgtttcctttcgtttaatggggaagggaacactgaaacatttcctacattctctaggaaaagcaccttttttttttttcttgtctttataaccctgtatctgttgtcactgattcagctattcagtctgggacaaagcgacttttaagttctagagctatgaggaagctataaagggaatacagttcactctgtagagaaataacagcctgggagatcatggaccagaaatgttactctccaaaggtttgctagagctttactttgaattctattcatcaatatttttgttggcctggatcagtgactctaattatgtatagaagatagaaacagcagttatatttagcaagctggaaaagtccctgcagtctaccctcagaacagctaaacatacggagtcaacctgagattctgaatgctctgttcactccctgagagataatgatgactgaagagtgatagcgcagggaacagagtaaagctagaatgggaggcaaggaaagttatcagtcagacctctaggagaagtcccagcccctgccccatgcttttgttttttatttgtctaactttttttttttttttttggagattttccatttcaggcttttgttgcttttctcaaatgtcaaccctacctacctctctctgaacgaacagcccacactttctacttcatcaagaaaattgctaccacagggatgatatcatagcccattactgtatgatgctatctataccttagcctgggcttccaccatttctttgtctcccaaggagaagggacgtgactgcaccggatcttagtgtcatcttttctgcctcccattggggactgtgaagttattccaaggacagttgttccccctaccatagctgctagctccttccctcgtgccaggagccacttagtcacagggtaactgaagagaaaaaagaacgagacctattgctgagcctagagcaagctcccccatacctgcaccccacatgtgtaccaaaagcttgctttctctcccattcccaggtctttgatggggacgaagctaagaccatgtatgccattggccccaggcaataagaggtgcattgtctgcaaaagtcttaaaacaatattaaaatcaactaaaaattggtctttttttttttttgagacaagagtctcactctattgcctaggctggagtgcaatggcacgatctcagctcacagcagcctgcacctcctgggttcgagtgattctcctgcctcagccttctgagtagctgggattacaggcacccaccaccacaccccactaatttttgtatttttactagagatagggtatcaccatgttggccaggctagtcttgtttttattatcaccatgttccagcaattctaaacgatatcagcgttggggaggaaaaacatctcttctttctacctgtcttaagttcattggctggggcccctataacaaaagacagagtaacaagagaaaagcacacacgtttgttgaatgccagttttatgtggcatgggaatcttcacagggaaatgactttgctgagaccagctcagtgggggagaccctaacccagcggtactagaggaattaaagatatacacacagaaatatagaggtgtgaagtgggaaatcaggggtctcacagccttcagagctgagagccccaaacagagatttacccatgtatttatttacagcaatccagtcattagcattatttctatagatgttaaattaactgaaagtatcccttaagggaaaggaagggatgggccaaattaattgcagcaggatcacgcccttaagacacagattgctcatgcttttgtttgtggcttgagaatgcctttaagcagttttcctccctgggcgggccaggtgttccttgccctcattcctgtaaacccacaaccttccagcttgggcgttatccttccagcttgggcgttatggtcattatggacatgttacattgctgcagagattttatttatggccagttttggggccagtttatggccagagtttgggggggcttgctcccaacagacttgaagaagcagttaaactgggagtttttatgctagcttgagtgaagagtggagagtcatggagaaatgtgttaggacagaaaaagtatgagccgaggatagtcaactgggagaaacaacaaggtctgtatgttcacattcctcttgacatccctgtgtctttggagagaaagatgttattttcctccaggcatagggagggtacctttcacatgatctgcctcagggaaggatcagacaatctttgctatacatgctgttttccaaattccttcaacctaaaatattcagtattccaagtcaccatattttggggtagtatgtcttgaaccttatcatcagtgatgtaatattcctccccagaaaatccttttgttggtaagttacaaacaattgctataacgattgttgacccactggcttcctacaggcaacccagctatactcagctgagtgtcaattcataagggttggaatcatttgagtttgctgcctgcacagtttgtgtctctaagccctgtgatactacctagtcctacgtttaaaaagtaggttcaaaataaacaatggtaatacaacaattctaagggtaaagtgacagagcttgccttattgcacttttgtgtgcagatctttctctaaccttgtagcatttattcctttggacgtgtttcttttatgctctccttctcccttaaaataaatacttaaatgtaattaaaaattattaatccattactttgtttccttttttgtactgtgatagttttctaactgacttgaatgtacatacaaaatttaataaaagactatgttttatgtttgccattattttttggcttttattactattattttaagaatattattgaaggcttggcgcagtggctcatgcctgtaatcccagcactttgagaggccgaggtgggcagaccacccgaggtcaggagttcaaggtcggcctggccaacctggcaaaaccccatctctactaaaaatacaaaacttagctgggcatggtggcgtctgtagtcccagctacttgggaggctgagacaagagaatcgcttgaacctgagaggtggagcttgcagtgagctgagatcatgccactgcactccagcctaggtgacagagcaagactccatctcaaaaaaaaaaaaaaaaaattattgaagacaattttgttgtgtagaggaggagggtcttaaatgatcctctctggctgtcagatatgctggggactccctgtgttcctgcacacctgcccaggctctctcctctccttcctccctcattcctgcacctagaatgttttcaaaagttattctaaaagcctaaaataacttccgtgaagacttgctgtgataattccagctctttctttcttctctgaattcttctaacacattgtagttttccatacaatgtagcaagtgatggtatgccagcttagactttttctaatactttttttcccaagatagaatgtaagctccctgaaagttggggttagccttatatttcttcttttgtgtctccccaaagacaacttttggaagtatcccattaaaatgtatactctgtagaaaccagctcaaatccttcaaaaacagctcttctactcctgcaaacttcattatcctctcataactttatgtgatcatttaaaatcaggtttttctaaaacttcggtctgagtgaccaaatgcaattgcttatcttcaaggaaatagtgcttgctttaggcattcactccagaggcacacaaggagagataggtgaaatcaacatgagcagttaatttctggtttcacccgtaaaatactgatttctgtggtttgaatgtgtccctcgaagttcatgtgttgaaaatgtaattccaatgcaatagcattgggaggtgggatcttcaaagagtaatttggtcaagagggctctgtcctcataaatggattaatgccattatcttgggagtgggttagttatcgagagagtgggttgctaatgaaaaggatgagtttgttccattttcctgttgctctcttgtggactgtcttattcttctgcctttcactgtgggataacacaacataaagaccctcaccagatgccagcccctcaaccttggacttcccagcctccagaactataagaaataaatctctgttcttaattatccagtctgtgttattctgttatagcaacacaaaacagactaagacagtgactctacaaccctaaagaggtagtcactgaagaactattaagcattctctcagttgtgtcagtgaaagccatctctatttgtgttccctatcttaagccaacagttctcaaaatatgatccagggactcccaggagtcctagagacctttccaggggttctgtaaggtcaaattatttttataacatgacccagacattatttgcctttttctctctcctaagtgtgtcaaggcattttccagatactatatgacatgtactatcattatagatttagcgtggaagcagatatgagaagccagctgtggtccattaagccagagggtaaagagatttgccaagaatgtaaaaagaatgtcttctcatggagttttttgtttgggaaaatagagtaataattcataaaaatttcctatttatgttaacatatgagtttattgctaattttaaatcaattcataaacacatattttttaatttttcagttttaattttgtatacagcaaataacactctatgtaacccacatatacaaaaggtccttgaggccctcaataagagtgtaaagaccaaaaagtttgagaacttctatcttaggccaaagcagagatttttagaaacatattcttttaattctttctttggttacttacctccaaatcaaagcaatgtgctgcaactgaatccagtggaaaaattaattagctctatgttaattctttggctttgctgtgaaaagcctgatctttgggccattgacatctgttagaaatttaaactcttgagccctgacccagacctactgaatcagattctgcattttagtaagatcactaggtaattttaacctacaggttgagagttatgagcactgctccactttgcctttgtgaatctggctgggatctttttccaactttattgaccatgttaattaactccctcttttttgattctctcctaataaggcttgcagctataactgcagtttatcctgataaaacttatttctgtagggggaaaaaaataatcttctccttcactcttcaagaatttttagctgggactccctgtaacaaaaggtagattaacaagggaaagcaaacaaaagcttaataacatgtatacttcctgtacacatgggagataatgcagaaaaatgagtaaacctctagagtagatctaaaaaagttgtcttagtcttcaggcttaaataccatcctttgctaagacaaaagaaagttatagggaaaggcctggttaagaagaggtggccaggaaaagcatcataaacaaaaccaaggtttgttatgcagatttaagtaatgccttctgcattgataagagtctctagtgatttagacattttcctcttcctggtgcagagagggagacattcctaccaatagggatgtcctgtatagatgtaaatttatgttacaaaagggtaacttttcagtgcttcttctgtatgtgcagtttctcaaaataaccagttcaaaataatcccatgccaaagaggcctatttggatgggcatattctggtttcctacaatcatatgttgggatgacatgtcctgaattccatcacttcctaatgaaatctgataaaggactgacttgtctgacatttattttcatcctacaatgtgaatgcaatgaaggatcaatttgcaattgtattttttatggccttttggatttatgcactagagaggtgctaaagctgatgtgttgattcaagtgaggagtaagaggggtgagaaactgtgagaaaaaaaagtactataaagacacatgcacacgtatgtttattgcggcattattcacaatagcaaagacttggaaccaacccaaatgtccaacaatgatagactggattaagaaaatgtggcacatatacaccatggaatactatacagccataaaaaaggatgagttcatgtcctttgtagggacatggatgaaattggaaaacatcattctcagtaagctgtcgcaagaacaaaaaaccaaacaccgcatattctcactcataggtgggaattgaacagtgagatcacatggacacaggaaggggaatatcacactccggggactgttgcggggtggggggaggggggagggatagcactgggagatatacctaatgctagatgatgagttagtgggtgcagtgcaccagcatgacacatgtatacatatgtaactaacctgcacaatgtgcacatgtaccctaaaacttaaactataataaaaaaaaaaagtaactgtgttttcttctgtttaatgattgttgcactctcctacaaattctctttaaggaaattttcctagaagccttcttccttgaatttgtaagaaagtggcttttcagtgggttgacctcttggcttttacatgtaaatacaccgaaaaaaaaaaaaaaccccaagggatgtaaaaacattgagaagtttctcaaaaaaagaaaaaagaagtccatttagtctggtataactatgaagtaaaataaatcatagtatctgagaaagaaggggaaaatattcaattgtcaaaattagcctgtctcatttatttggccttggagaataatagtcattgatatagaccagtgggtttcaatcttgaataaacagaggatcacctataaactcaagaaaaagcccatgtctgagagattgaattggaatttggtaggtacttatctttaaaattttgacaaggtgattatgaaacacaatgagaattaagaatgtatggtatggtcaaatacgtgagcagatggaacacaaagtccctagtctttaagtgtgtggattcaatcatttattcatttttctttatccagggttagatcctgtaggggcaaagataatttccccctccccctctgaaggttcaagtctgctgaaatgaactgatgagagagattaacagggcaaaggcatacaagtttattaatgtgcataagcatggaagccatacaaaaaaatgaggctcacagaaaggccagatagctgaagcttaaaaagcactctctttgtagaggagccagagatggtggatgcatgaaattgagggttagtagtaaatgctttttaagagagcttaatggacccaaagaggaaacaatagtttataaatgattctctttggaagttgaatttatgggacggtaaggggcagaactgcaaagcaaacgaaggttgtctttttatgcagataaagtttcttgggtaatttcctgaagcggtcctcagaagggtagatgaaaagtttgtctgggtatggtcagaattttgctttcttctcttctccagtggttaatctttcttgttaatttaatgaaattcctagggagggggtttaagactattacaattcttttagaaaaagttttcttaatcagatagggaaattccagagagaggtcctccctgcacttagaagcaaggaaaacagaaagttagcaagtccttggttcagaggcactttctgaggtattccaatttctttcaattcaaaagtggtcagcatgccaaagcactttactttggaatatcatttttctgagccacaacaggcctgtccagagatttgaattaagcaaattaacacaggaacagaacaacagatgccacatcttcttatgagtgagagctaaatgttgaaaatatgtggacataaagatgggaacaatcgacaccagggactactagaggggaggatggaaaggggagcaagtgttgaaaaactacccattgggtactatgctcactacctgggcaataggattgttcattcccccaaaccttagcttcacacaatatacccatgtaacagatctgcacatgaaccccttgaacctaaaataaaagttgaaaagaaaagaaaaatgaataaatcctgtttaacacaagaattttatggccttatacattttctaatgactattagccaagtgggaaacttgttgaaggtgtagagaactaagttcaattcctcatttattccctagatgagctatgccattggagtgaagactctgaactaaattaaaaagaatgtgttagactagtttttgtaccatagataagatggatgcacttgtgctttttaggtacaggaattcagacctgtggaagatccctggagggttaaggaatgcaaatctgcattatctgtaagccaaacatgtaatatgattcactcatgcgtatgcccgccattctttgtcaaatgtatgtgtgggctttattgacagaaaaggttttcaaaaaatcatttagaagcaccactgaacaatgattctttttatcagttagtttagaaattattaatgaccatcaactatgtatcaattacatgtaccctgggatacagtagtgaatctgacagccctaaatcagggagacatacagattaacagatgattaccatctagtgaatttagtgctgatcccattatatctatctgcagtataaatttaggtgtctgtaatcctagaaatactgctttaaagccagcatgtctgctcccatctccctgttagcctgtacaaatctgctcaagtgttaattagtaatcccaggagagaagtgctgtcattcacaattttctcaaaattacctctagaaatagtaaacagtggctcgtaactgatgaatgtgatggttttagccaaaacatattctcaatctatgtctactcaaagtagggcaatagtcatgatggggggaggggtgatagtaaaaatgcattaacatgaaaatgttgaaaacaatgatgcagtccaattatctctttatagaggaggactctataaaatgttaagagagatacaatgacatgttctagattcatggtctattaactcttgatcctaggtttctcaaagggctgaactgactcaaatatactggggactccctctgctcctcacacctgcccaggagggttacttctcaaggtcttgtgccagccattagtgttgtccactcaaactgctcaggaagcgtggtaagcacggtcagttgtgtcagcatttgcacaaagtcagtgacttacggtgcttccttgtggaggagttctctatccaatggtgccaggcttggccatgtgacttgctttggtcaataaaatgtgagcagatgtgatatgactatccacatccgtgcttaggctgtaagagccatcatgtgactcagccatgctcttctctctgccatgagaatggcatattaccataggaaatagtccttcagcctgtggagatagggcaaaacagagccacggcccacctgccactggcatgtaaggtgagtaggaaataaagctttctttgtagtgtacacccctgtgattggaaggttatttgttactgctgcataacttagtgaaagacaacttatatagtaggccagagacctgccaactttttcttaaagaccagatagtaaatattttaggcttgtgggccatttacagtctgtcatagctactcaattctatggcaaaagcagctattgacaatatataaacaaataggtatggctatgtgccaataaaactttatttacaaacacaggtctttggcttgtgggctgtagtttgcccacccctgccataggattttgcttcctcacctccttgaagttggatgtggccagtgaagttgggtgtggcacttgctttgcctagtggaatgcaagctatttaaagaagtggtgtaagtggtggctactctgtcagtctgagtcttgagagataccattagagagctgagcatcggccaacctatgctggacattcagcataactaagaaataaaccttattgtttaaaaccactaagatgtatggggtgtttgttactgcagcatatataactgcgcctatctgtactgatacaggtctatctggcattacgtttcggggcaccacctctgctcactgccatcccagggcacctcacgtggcattctttgttactgacttctttataatgtttgcgttgtagaccacgatgacagaatttacttaacgatgatgttttgattatcatgcaagtgtgggggaggattgttctgttgaaacagcgtgactgcaaatattttaccaatagatcagtgaaattcacgtgcccttgaacattttcaaaggtatgaaatcacctgaaataattttttagttcattttttagtggctaaaatctgttaatagtttgattcacaagcctggcctttgaaaaagtaaaaattggataatgctgcacaagccatgttctccctggtgtgtaagggttaattattggactcttgcttgatgatgacagtgcaggttcattgaagtcatcactttatatcaccagcctgtctgcagcactgttggggccacgcctcttgtgcgatggttggctcagacctgtagcttcctttgccttatcccctttcacattgaagcctcatctgctgcttgacagtgcatgcctgagagttgcttttccacagtccctgttcttctcctaggtctggttaattgcttctctgttaaacagagaacatgttgaacagcagccttaaattattgtccaattttagcctactgggaacccctctgcagctactctgatcaccactgatatttctagaaagttcctattcacaggggactcttttctcccttctttatgctcaagggagaataaatcacagaagcagcaatccctccatgtgtcaaactatcaatcctacatggagctacaaaacaaaaggcagtatccctttgttgccagagaacatccagtccctgtacaagtctgtgcctcaggggctcaggctcattagcaccatagcagtggctcatgctttccatacacttttctctaccaacacctacagttagtctcagagttgttctttatcatgataggttacagagcagtgttttaaccatattaccttgactgaggtatggtgaggccagatgtggatcaagagaaagaaacagggatggattttatggttttgaggctcacagttccctggggagacacagcaggctgtgctgggccactcagcggaagcacagagtgaggcatgaggcagagggagatgggggatggtagggaagcagctttattgtcgtctccagggaaaggaaaaggaaaggcagggtatgcaggtttaggattggctaatttgaaaatgttcttggggctctggggcatagaggctgtccccggttgtctcatacctggccccagggtgatgaggtaggtccacggtggcctagggtgcaagagccacttaagggaagtggtgggagtttaaactacttggttgactcctcaagaaggggaactgactggcctctagctagggcctcaaaacagggtgaagacagtatagaataaaaaatatattacaactaggacagataccaacatactgggggtttgtacctaccacagttattccttacatttatgtttcattttgtctagtaatagtgaagtgaatggagttctagactgaagtctctgtttaggcagactctgaatttgttttctcattggttcccagagatggactgagatacctcagtcctgtggatacctcaggcaggcttaaaatgtggcacaaattctctttaactattcagttgatactttttcgtgagggcttcaaagaggctgattttctattgctaaaaattgcatacctctctatgttcaaagaaaataccatttactttatatatgaaagagcatttgcttatttggaaaacttttatttgcatttcacattttttatcacttcttactaaatagaagtttctcacattctctagggattgaactaagtgataacttagaaagaaagtattgttcaaatacccattttttggcttttatgttagtaaaatgtttcccctttttctagcttttctttgtgatttcagaaacgtgcaacttctttgaacgcatattaaatgtttttaaatttaaataatgaaccacttgcttttgttacagcccagtggttcttcttgcctgctgcacagacagagccaaggcactgagacagtagtgttgcagcgagaaagatttaattattgctaggcagtcaagtgacagaatgagaggcatttctcaaatccactgccccaagagctcagaggctagggtttttaaggataatatggcatgcagggggctagggaataggtgctgctgattggttaaagatgaaatcattgaggtcttcatgcactgagtcagtttctgggtaggagtcacaggaccagttgagtcagttccctggtgtgagtcatgggtccaggtagagtcagtcagtagccagaatgcaaaagtctgaaaaatatctcaaagaccaatcttaggttttacaatagtgatgttatctataggagcaatttgggggcattaccaatcatgtgacctctggctagatggctcctgagcagtaagaaattatagaaaagcaagctaggggacaatggttggttatcatttagttactcctacattttagcagaattcaggcccctcccataattctaaccttgtcgcttttcattagttttacaagggtggttttcagtccctaaacaaggagggggttagttttgggaaagggctattatcatccttgctttaaaattaaactgtaaactaaattcctcccatagttaggttggcctatatccagaagagttagcttgggaggttagaagcagaatggagtgagctattttgctgactagctttctgtcattgtcataatttttagaaaggtggtctcactcttagtaaacagtagtatgctatgctttactcagttgtataatttcatttgaattcaacaaataactacagacagctgtcaacttagtgatgttgagattggggctaggcctgcagtaatcctctgaaatatgtatgtgcaccccaaaaacatgtcattgagatgggtagacacctgcaagaggagtgcttttaaaacgtttttacatgaagatgctttctacttcagtgagacttttgccagtggtgttagaagttgctgtgaaaaccaagataaggagccactgtgtttttgatttgttctagggatttaatatccctcatagttaatcactcaggcaattactgggttaacaatatgtcctgaagaagagtagtttttgagccatgttctttgaatcactaagattcttcaaaactgctttagagtttcccatgaacatttggatcacattaaagcaggctcattatttccatcttcatgtccatgtaaatgaggttgagttcttcacttggttctcagctttagtgttgttagtatatagaaatgcacctgattttttatgttaattttgtatcctgaagcttcattgcagtcgtttatcaggtctaggagtcttttgcaggaatcttttgggtttctctaagtataagagcatgtcactggggaccccaaaagtgaggaaggtgggagagaagtgagggttaaaaaattctctattgggtacaatgttcactatttatgtgatgtgttcactagaagcccaaaccttaccattatgcaatatacccatgtaacaaacctgtacacatactttctgaatctaatataaaataacaaagaaaaaaataacaaaaagtaggctcgttagtaagacaatagctgaggagccctgaggattggtcaccttctagcagagagaggaagggccaagctgatttacaacagtcctgatcaaagaagggtgacctgtccagggcaagtccacaagcctccccctctgtgtcatgaggccacagagcactggagttccatgaagtcaatggaaaagaagagttctactgcttaaacaagtttaaaaaccactgctctagcattgtttataagaaaagaaactaagaataaaaacaatactgaattcaaacagctaattccttaagacctgggaacattgtgtgttcttatgcagttataatttaatccaaatacattggaaccacaccataattcaattctaggtcaagagcagagttttgtatacagcagattcattttggagcactctctggggatttggttacagaaaaatccagaggatttatctgggctgtcttactcataaaactgcacaatggcctagattttagagatgacattacagtgaggtctcctccaggacatgctatggtatacaccactatacaccacttaatctttagagggctcatttgaatcacattatttatgtagtgtgtccacatgttagatttggccagattctcaaactggggtgtcagttccacgtctagcccattaatttgttgccattgtgaagacagtagacttgaatgccttcagaaggagcatgctgtactgcacaagtgcgaggggcctcattcctaaagtgatcacactgtgttttagggaattgtgcccctttacaatgctgtgactttgggtgacactctctagcttctatagtacccaagtctgggttgcgtctgaatttgaaatctctactatgagactgtattgtttgtttttaaagtcgatggagcacttgacttggagccagaagagaaagcttgggtcttcacgcttcttgattaattatcaagccagttaattttctagagcctctgtttattcatttgtcaaatgggacaaataatgtctgtttcacagggcttgttgtgaagattatactctgttgtgttatagaggtttaaagtggacctgtgggtttgtatgaaatacagcaaggtaacataaattaaaagtagatgagggataaaagcggggaaagggtctaaaatggggttaacaagttgtaccttttgtgcagatctatatgcttgctaggaatgagccacaaatttgcttctgtgccctctagcagccaaggagaaaatggaaaccttattttctttaatcatggtgtctacgagattgggaacacagtagggagtcatgaaaaatattccttttcctagtaacttaacagagagagaccaccctcaggggtctgcaaaagaggacattgcatggtacagcctatagtgtctgctacacagagaggttgcaaactggcagtccaccagtgtcaccatttgttgggatttttgttttgttttgtttaggcttgatgtctaaaaagtttgatccaacatttaaaagaatcagattttgcaaaaataacatttttaagttttctttcaaaatcagatgatcagttaatattgtaactatatatcaaaattaattggcactgtgtagcagcttttttttaatgtagcaatgatttcaggtttgccacagtctccaccattccctactgccttacttactacattttatttcctacttggcatttaggcatctgatttagtgactcctattctacagcatccttgtagtaggctcagcagtacgcttcataaggctgagaatccctgagaggattgattgatatgggaaaatgctggtactctgtacaatattgttctacaataaaaatgtagaattagaatattgaagttactgttagaactttgaaatcatgactgagggtttaaaaatgcttaatgagggccgggcgcggtggctcacgcctgtaatcccagcactttgggaggctgaggcgggtggatcacgaggtcaggagatcgacaccatcctggctaacatggtgaaacctcgtctctactaaaaatacaaaaaaaaaattagccaggcgcggtggcaggcgcctgtagtcccagctactcaggaggctgaggccggagaatggcgtgaacccgggaggcggagcttgcagtgagccgagatcgcgccactgcactccagcctgggtgacagagtgagactccgtctcaaaaaaaaaaaaaaaaaaaaagcttaatgaacgagagtctcaaatagctaattaaaacaacctcaacttccaaactaatctcctagcaagtagtttacccagagtatccattccaattgctctttaatcaaataaaaatttcagaatattttatttaaatatttacatagctatatattttcatcagaaaagagtatcacaggaaagacatgttttaagtatgcttttaactgtataaagtttgattgttaggctctatgatctggtgacaatagtcgttactgttagaggtgaatccttgtaaagttgttatttttgtcaaggtccactttggcttctagacttgttgagtttggtaagatgttttgagcgctgagttgctaattttccagaaatgtaatttgcaatgaagatgttggatggggctttcccaattatcagaaggaattctccaaagttgaaaatgagtgataattatctaatattctaaaacatgctgctagacatggatatagagtgtttaataaaagatgtcaaagttgtgttgtggccaccagccaccatcacagctctagccaacattagagatgactggtgatctaggaggagattgtggagggttatctcagtgaagagcctcataaagagtattggggaattttccctcccattgccgtggagagaagagatgagtgctcttaccctttccccaagccaagagagaagagctctgatctagagataggggttatggcaaccatgggagattggcatctcacttcccacttggatgcctgcggagctctctccaggcccatcagaatggagcacagcgatgattttagggatctgtgagcatatatacagatgcttccaacatacagtatttgatagatgcaaagttgctagagcagcctgtgaaagtgaggcaaagaaaaagatgttcagtggttgacaagctcaacttccaccatttggcagagaaagatgtgtacattttcgtggggccaagcaacatcaggaaaggtagagagtttgagcaattgttgctggttccttgtccagaggtggccttttgggttgaggcaacccagactgtgagaaccctgacatgtatgttgaagtagaagatgtgtgttttgggggaggggctcacaaaaggctggtcaaatggttcttccaccatgctagggaacttggaatagagggtccatgtgggcctctgaagaacctacaaatgcaccctgtgaaggtcccaggatgtgactgcctgccttgcacagctgactttggtagccaagagaattgaaaacagcacgacctgatgtaagaagatgttccgtttcctcaccactgatgtcacttccctgtgttaacctgagaagagctacggcacagagtgatggaggagagaatgaaagcagaggaggagggtaaaaggaaaggctacagtcccttccccactacaggtcatacaaaaggaggagggaaaagctttgagttggatatgagattgaagttttgatacgaaattactatacttttagtaagtgagtgagtcttagtttccataaataaggctattataagtgaaagtgatggaaaaatgatggggtcttcctgagctgtccagctgcagggaatggagatccactggaacaagtcaaagataataataatgagaaaaaaaaagattcttaaatccccaccattcaatgaaccagttaccaaacccacacgatacagagacattgagattccaatatgaatctctccacagaaggaggcaccttctcttgccatcttctgtgtattataaccatttttgggggggtttggtgcttcttgttcaaaattgaagtcttgtagccaaaagtcaaaatcatattcttctaaaattcacttgaaaaatatttccttttacagttgaattaaagcaaattacttggttaattaatgtcaaaggtgactctgttctagagataatttctgagtcatgatacctaatatttaaaaattatgttttgatttttatctttagtcatggtgatttcaaatgaggttattaaatcactgtaattcatgatttatataaaatatgaagacattaacctacaacatcttggattgctttttttttttaattgcattagtcactagtaccttctaacagttccagtttttggaaggcagcctctagtttcctattcagcctcatcatagctgttccttttggagagcggtggagaatacaggattgaaggtgaccctcacagcatgacaaattgtcaatctggctccctcagaaaccttatagggagtgtattagtcagctttggctgtcgtaagcaagtaccacagactgggtggcttaaacagcagaagtttattttctcacagttctggaggctggaaagtccaagatcaaggtggaggcctctcttcctggtttgcagaatcccaccttctcactgtgtcctcacgtggcctcttttctgtgcacttaagggagggagagagacagctgtctggcgtctcttcctcttcttctaaagacaccaatgctacctattagggcccatctcttatgaccatagttaacttccctaaagggcctatctctacatatattcacattggggattaaggtttcaacatataaatttgggggcctggggagaacacagttcagtccataacagagaggaagaaagagattcttaaaaagtgttctcttctgcaagttgacatttctgaaaaatatgtttattctccaaatttaagagacttttagaaccaattacctgtgaaattttcttttccaaatgaccgaaactcaactcaaactagctgaagcaaaagtggatattttttggctcacatagcagatggccaagggtcagatatgtcagccacagctggatccagggtcgatgtcatcaggtctttgtcctccccttgagctctgtgtccccccatgttggcccctcctcaggagggtccttttcctgtggtggcattgattacctggggcagctccaggctgatctggcccttagaatttgcagctttaaatggagagaaactgtctcccaagagtcaactctgactgcccccgcctgggttagggatacatattagcagcctggacccagggcctatctgggtggttatgggctggcattcccaacagctgggagaggaccaaatgaaagattccaggcagatcaaactgtaaggcatgtccacagtcttccccttctaagtttctgagctaaaacaacttatttgtcctttgtgacttgtataattgtataattgatagtccagagaaggtccaaattagttcatctttatatgtgtaagagattctatctaaaggtcatcagaacctttttgaaagtcaactgatgtcatgttggcctttgctggtgtttctctgcagactctccggacgacccagccttgtcaccacctggagatttggctccagcctggctaaccacaggctgttgacatgatggctgtggtctctctgcactcctcctccaacctcccccttctctatcctcttatgcatacctattgttgtggtctaaatgtatgtgtcccccccaaattcatatgttaaagtcctagcccccaaagtactagtattagaaagtaggtcttttgggagctgattaggtcatggaggcagggccctcatgattgggattagtgcccttatcaaagaggcttgagagaggtctctcacccctttcaccatgtgaggacacagaagacaccatccatctgtgaaccaagaagtgagccctcaccagacaccaaatctgccagcatcttgatcttggacttcccagtctccagaactgtgagaaacgaatgtctgttgtttatcagccacccagttggtggtattttgttatagcagcccaaatggactaatacacctaatgtcacccatctcatgtgaatgtaggtgctcatctcttgcctgaaattcttggggtcaagtgtgttctggaactcagtttctaatttcagaaaggccatatcgtatacacactgtttactgacacccttagcagagtctgggacagcacccagaaatccatctcattaacatttctgcagagaaacacgtgaacattcatactacgtaggataaagaaaatcaatagtagccttatatcagttcaggtcaggttttgtcaccaaacacattacgagaaaggtttgttctcagggcttttcgtaatttcagaattgtaaacaagggatcccgaatttatattttcttgtatgcattaagtgctacctttgttggactctcagcagctaggactggtctccataaaatttaaaacttaagaaacattttaacttaaagcactttaagcagcactttccaaagtttaaagtatgtaagtaaatctgtgtgagtagataactataaagaacaaactttcagccaatatcttcactttgagtggttactggggggcaaagaattagaaagccactatgtataaaattaaacatttttatttgttcatttctttaaagtacaacttattttccgggagaggaaagtactctcaccaaagaagatttttacagagagaaatcaggtcaacttgaaacttgtttgcaactctctatttgtaacaacctttgtggggttttcataaaaggattttccaagtcttttgtcttcaagaacataaattagaggacactcttaccaggagtacatgcagtttaagtacccaaaaataagtttgtttaccacttagaatcatggagttcaagagaattttcaagtttgcaatcctgggtctctcccagggacattgagagggcagaatcgattctagttttgctaatgcgcctgccaactggtgtcaccatttcccatcacgatatctcagttatcccatctgtcagctctaagagtctttgatgtatttcaacataccatgctttcaggaacctctcggtaccacgttctggtgcttggcagctgtccaggatgaatttgatgtacctctccctgatgcctgccaggagggagttggaggaggggcttaaaggattttctggtaaatccaaatgatcacatatgagctgttatcaatgtgggagaatggaattaggggatagtcttctcattagaattgtgaaaattcaggatggtggaaatactcagtatgaagattttcaggttggctaagtgtatgtgaaatgtcctaatttgaaaaacactttggatttgattgaattagtggtgttaaattagtggggtgtggtgggcatggtgacacggtgctgggcatccttgcatacatgacggatcagaaaaccagcaatccaggcaactctgtggccaatgcggcattttgggtccaagccccttgaccctgtgtctctctccttgcttcatgggaaatcctgccacctggctcagacacaggcctgggggttaaatggagcatgtgctgccaggtactggtcagtgccctcaagggtggagaagacctcttgggaaccacagacaggctgtagggttgtcgtgtttgtctgtttttaagtgacaggctgcttgatctcatcccattagtagtgacgttgctagaggtagagcttgcaaccacccccttcccattaactctaccatcaccacctgccgctaactactgacggctacccaatggccacaaggcacataatattcacggagagccaaagtggcttgcctgtgtcattacagtagctctccttgttaagagtctcttaaccatttccctccttcccacaccccactcttcacacatacatgtacatccctacctgagctagagccctgcttccatccactttcctggccttccccaagctgcctgtgcaaagcctcccttttctgctccctcagcctccggtttcttcctttttctatacctttccccaacaatttcagcctttattaaccttttccttctctaactatcagtcctatcgcttttttgggggggggggcgggaggcaggtgggaggtgtacagctcctcatacttgctgttctgtttatgtatgctctatagcaaactatccccaaatctaacggcttaacacagtaaactgtttccctatcatcactcatgattttgtggatcgggaattccagccggactcagctgggaaattcttttgctcctcgctgtattgaagggggtcgctggatactttcactgggcagatgggtgaactggaggtgattaagatggcttcacatgcctggcgccttggtgggatggctggaaggcatgttcagctgggtgtgtccactggggcttccacacatggtggtctcaaagtagtcagacctctttcaggtagctggcttccacaagagtgagcatttctagagaaaggaagtgtaagtggccaagcctcctaagcctgggcccaggatcctctctgctgtattcggtggttgcacagttatgccgtcctcccagtttttacctagcccccacctctctgtgtgttacaacaaagtctgccaccactattaatcttccacacgtgcctcctccattctcgaatgttcttgaagattatattgctttctccaaacctaaactgtctcataagtttttggcgcttaagacaagtttcaagaaataagaattgaaaagtgttggaggaaagaaagtttccatctctaaccactttctcagaagggcatcagggtttttgcagcaatgtggggatacctcttctgatctcatagcttagggctctgaactaaactgatggccttttctagatttcttcctaggggtgtcaggttggaagtgctgagggactgctctttctccccagggctcagctgtgtcaaggctaagaccaggagtggttcccacagccaggctgggtgagggcaagtttatcctgcggtgcagcacctcagaccagggtctagccaatggtggcctgcaggctgaccccagtccaccacctgtgagcagccaccaccacctgtgtttatactacccatgagctaagcacgattgtcatattttgtttgtttgtttgtttgtttgtgaggcagagtcttgctctgttgcccaggctggaatgcagtggtgcaatctcagctcactgcaacctctgcctcactagttcaaatgatttctggctaatttttgtatttttagtagagatggggtttcaccatgttggccaggctggtctcaaactcctgacctcaagtgatccgcctgcctcagtctcccaaagtgctatgattataggcatgagccactgcacccagccaatttttatatgtttagatgattgggaaatagattttaaaaagaataatatttcatgatacataaaaattataatgacatgcaaatttcagtgtccataaataaagtttctttggaacacagtcatgctcattcgtgtacatggtagctgtggctgctttcacactgtgagagctgggttgagtagttgtgacagcaattattagatgacctgcaaaaccaaaaatacttgctatcttgctctttacagacaagtaacttttttgctgttcttgccaaagaccaaatgcatttttcaaagctggattccaggctcagagttacagcaaagagaacagaaagtatagctcatgattgggtgctgacaggacaagggagagagacgaaaaccattaggagcattagcaacaaatatattttttgccattccaactccatggagcaaatggcttcctaaaagccagcagagaaactaattacctgaactgggagaagaatgaaagactcattgttagaatattcctcagagctgaatcccttctttcagcctactgtattttagtgattcctaataaaagaaaaaaatgtatttttgtcctcacagccaattaatttctgctccaaagcatagaatatgattatttctgtcattattttagtttccagagtcattgatgagacagggaatgacacatacctattaacacactcgcacactcactcacacactcgtgtgggtacatgcatttccctagaagatgtactggaaggatctgactttactttcaggtgccttcatgtcctcgcaattattctacaaatggtttttaagatatttctattgtatttgttgaaattttcctgacattttgacttgtctagacgattattcttgcatccagcacattgtaggaaacactcatttgaaataccccactgtgcttccgggggagctcatctttctggagcatggcgggtccctcatgaggccctctttcgttaaccgaagaacaagctgcagtctgaatgtgagttgttaaaggtatggtattgggagttttctgttctcctgttttcccattctgtaatgttttctttctttctttccttcatttcatttcatttcatttcacttcatagcaacttttgaatgaaaacctccccacagggtttgacaggcaatgaaacttcctcccttgggaggtgtctcagcctgagggaaatggaacagcaccccacagaggattttcctcacttcctccctctctcctttacaaatcaatgttaaagagcctgcatggatgtggttagcaccatctctgccgcatgtgacttttcagtcattttcacccgaaataggatttcattcaccagttactataagctactcgtgccttctaatggactttgcagcagtgattcatccaccctgtgctgggagagagaaagagactttaggtgagaaagaatggttgggagaggggagacaggtaggcagaacagttgtggtaccatcccgccccataagacaataatgatattcagtgttaggcgctttataccaagaaatattccacctgacacattatcctggttgaatcttatgacacatctgcaaatagacattaccaaatacagagggggacttttaggttcagagaggttaagtgacttgcccagtaacacactgctggcaattcgacctgatctctctctttcttccgccttttccatttcagtcagtggcagtgccatctttccacctgcttctgtcaaatgtgttggtgtgatttgatttcttttctgtttctcttgtatcttttaatccagcaataaatccctgctggctctacttgtaagatatacccagaatctattacctccgcccccccaccacccaccttgctccaagcctccatcatctctctcctggagcactgtgatacccttcttcttggtcatcctgcccctgccctgacttccctaaagttgatgcccaacacacaggcagataaaccagatcagacttgtgactgttttcccattctttgggcaatcccattgcattccagataaaagcggaagtccttagagtactgcagtttgcctcctagcccacgttatctctggccttcctttctcactttctccctccattccagccacgttggcttcctgctgtctcttgaatagtcagggcctttgcccatgctactccctctgcttgaagcactcttatcccaggagactgcatgattgagacccttacctccttcatgtctttactgaaatgtttttacagtgaaacctatcttaaatttttttttttttttttttttttttttgagacagagtctctctctggagtgcagtggcacagtctcggctcactgcaacctctgcctcccgggctcaagggattctcctgcctcagcctcccaaatagctgggactacaggcacccaccaccatgcctgattaacttttgcatttttagtagagttggggtttcaccatgctagccaggctggtcttgaactcctgacctctagtgatctgcccaccttggccttcccaaagtgctgggattacaggtgtgagccactgcacccagcctttgtatagctttaatgcatcaaatatgggcttagttcctcatgtaaacaattctcccaggaaattagaggataaaaagttaaaaatagcatatatgtcctgccctcaggaagtttacgttttgaaggggggatacaacaaaaagctagaatttgtagcagcgtacaacacatgccaataaaacttgcaactcaagccctgtgcacagagaaccatttggcagaaattctagagaggcttcctggaggaggtgctagtagaggagaccttgacaaatggggatggatctagatcaaattcccctatgccacgtgctcctctttgcgttcagaatgctcttgtttgcaagatttcagccatgtacaactcttctggcactcagccatggactaaaacgaggttcatgcccacagtattggtctgcagaaaagcatgagactggatgacagtcagaacaaatggaatcctctagggtagggagaagagaaagaaagaggaaataaaacagcataatcccaggaactgccaataggaaaggatgggagaaaggacaactggcaaagactctgatgtggtgtccagcctttcagatgtcacctgaggacgttgctacaattaacatgcagccagacacacacagtgactacacattttggtgtggttggcggcattagttgagtcttaaacaaaagcaatttcagttgcaaatcttgtgccaggctttcagagaaagagaataaattatgctgctgtgacaagctgttccactgtggcaacaatagtttggacttccagtgctgcctgtcaaccaggactgaaaatacatcttcatttgttgctgggcagctgggaagatgagtcattaaagaattttataatacatcaaaggccatgattttctacctttcacgcagttacaccttttcccaagtcctcattctgccacaaaaaacttttgaatgcaccgaaagttaagtagaattccttttaaaatgttctgttctgtgcacatatctctaggggaagtgcagaagacatggggcattcccttttgtcatgcatttcagctccataaagatttattgaccacctactatatgccaagcattatgttagtcagtggggttaaaaagatgagcaaattgtggtcttgaaacccatgccttttgttcagattattacagtgcaagagaagcagcatcagccatgtgtctgagaggccagaggaaggagagagtgaggaaatattgtacctcattaatattgttcctctcgtttcaccactgtattaatctgttctcatgctgccaataaagacatacccaagactgggtaatttataaaggaaagaggtttaatggactctcagttccacatggctggggaggcctcacaatcatggcagaagttgagagaaaagcaaagggacgtcttacatggtggcaggcaagagagcttgtgcaggggaactcccatttataaaaccatcagctctcatgagacttattcgctaccatgagaacagtatggggaaaaccacccccatgattaacttacctcccactgagtccctccacgacacatgggaattatgggagctacaattcaagatgagatttgggtgggcacacagccaaaccatatcaaccactgtagacatgaccaagttcagacttggtcagtagtcaaatgagcctgtgagagaatggtgccacatctttcctgtaagagcacagcattttaacctgcgatggatttgtgagcagtcattccaactctgtattagttttctacagttgctgtaacaaattaccacaagcttaatggcttaaaaccatgtaaatatattatcccacagttctgaagtcagaaatctgaaatagataggctaaaagcaaggggtgacaggctgcattcctttctggaggctctaggggagaatctgtttccttgccttttccaacttctagaggccgctggcattccttggctctttgccccttcccttcttcaaagccagcagcagtagttgagtcctccttaacacagcatcactttttttttttttttttgccttcttcttccacttttaaggactctgtgatggcactggggccactgggataatcgaggataatcttcctattttaagaacagccaattgacaaccttaattctaagcaatcttaattcccttttgccatgtagctgaacatatccaagttctggggattaggatgtggatgtattggggtggggaaattattcttcctaccaccaaccctcatccatctctaaaggcactgatttttttgataaatcagataagtaccagagatgtgtactctgggctcaggagtgaagagggttagctggcctttgccaacagtgacttcatatcaccatactcaatgcaattgaggtgacttaatcaaggggaaaagatggacagcatgttttatggaaatagcacttgcctggtaatcaggagacttggattttagcttctctccttcaaacagactactgagtgtcagtaggcaagttgttgaactgctctgggcctctgtaaaaaatcaaggttgtggttagatgttctcaaatcctctttcatcctctagccttccatggctctcaatttctacagggaatgtactggaaatggagagaggctagcctgtggaaaatgcagtgccattatttcagcatcaaaatcctgaaataagatacagaatgttgtgtaatatacagctcggtgtctgtgcccttttatttctctcttgggcccagccccatcatcctgtccttgatcattgtaatgcagtgttcactaccagtcttttctccccctacattggaaattatgccaaaagagtaatgaatgaattaggtaaatgaattagatgaattagagataaaattatggctctacagttgaaatatcagctttaagagaatcgacttggagaccaggtgcaatggctcacgcctgtaatcccaacacttagggaggccaaggcgggtggatcacctgatgtcaggaatttgagaccagcctggccaacatggcaaaaccccatctctactaaaaatacaaaaaattagcagggcgtggtggcaggtgcctgtaatcccagctacttgggaagctgaggcgggagaatctcttgaacctgggaagctgaggttgcagtgagtggaggttgcagtgagctgaggccgtgccattgcactccagcctcggctacaagggcaaaactccatctcaaaaaaaaaaagaaagaaagaaaattgacttggagatgtacgggttcacatataattgaaagtgagcattccacagtgacttgagaaagttgattccggctttcaaagcttgcattatgggtaagaaacttgagcctaaaaagaacttatatgtatgtgggtcattagacaatctcctccctcaccacctttttttttctttaatcaaagaattatacatatgcaagtaactgaatcacctcttctttcatttttttccctctttaatcacagctgtgtggaaagtttccagctaggcattaaattgggtcaacagctaacacagcataagtgtggacagcaggggcaatcggtggtatatacataggaaataaacgacactgtgctgctggcattgataagctgttgaatagtgcaagggccctattaagatttaaagtaataaaagatgggaggaaatatggttaccagcagctgataaacattcttgccttatgaaggcattagtttcacttaatggcttctagtgcctggagtataagctcttgtaatttttctcccccagagcagactgaaagaatacctaggaattgtcatctttgtagttgctcaagaaagatctttgggtggctgtgagcagatctgaaaatagtaagtatggcaggtacatggagctgcatccgtttgcaaaagctatcaataaagaaaggtatagaaaggatgcccttgaccccggtatgtgcagatagaagtggaatttcctccggaatgtgcatgcaaatgtgcctagctgcaaaagaagaggcattccctgctcaggtgtgtagagtgatttagaaccatttgtttctgctcaatggttctcaaatgaacagtatttcctcactaggaaacagtgctaattccaggctaggacggtccacagagatggtggctgtgcccagatcattcttggaaatctgaggaagggagtcatttcttctcatgccacacccagtaaggggtacattagatactctatttcctccaggcagatctacagtgaccaggaccacgtactaggataggagaggttctggcactattcatcattggctccggaaatagctttcccctctgagctcaaaggtaggctcatcctctgctagagtctattaggtctggtgggattggaactcaggtgcatacccctgggctctccaaccactagtgctgcatccagggcttggggtcctgctttgtgccatcaggtcatcagtgacatgactagggcagctcaacccgcacctctggcatcactgccttcctcccatggccccctagcatgaacccaaagaccacagggccggttccctccttcaggcccaaggctgggcctccaaataatggcctcccaaagatgcccacattcacatgcccagaacctgtgcatatgttaccttatgtggcaaaagagactttgaaaatgtgagtgaattacaatatggagattggcctgggttatctgggtggactcaaagtaatcaataagagggtgacaggagggtcagagtcagagaagaagttgtaatgatagaggcagggagccatgaaccaaacagtgtagacagcctctagagactagaccaagcaaggaagtggattctctcccagggacttcagaaggacctcacccctgccaactcatccgaggacttctgacctccaaaagtataaaataatacatttgtgctgctttaagtcactgagtttgtgataatttgttataacagcagacagaaactaatacagtttatcttattcctttactcatgatcaactactttggggttaacgaacaacagtatatttacttccttcaatgaaacacttacctccacccaccagagtgaaagtttgtcaccctggttccaacaaatgccacaaaccactgtatgatcatctttgggtaggtcagcttgtctgctatggtatttttcttttatattgcagtttacaaagtgctcatttgtcttgtatgatagttatatatggaaggtagcattactatttcacttttctgattttctaaaaaatatctttaatgaacacatattaattttgtgattaaatgacacaataattagaaatgttaaaaggagatggcagttttagtcacttaataaccataatactaacaaattcaggccacatgctatctcagtggatagtccccagaaccaagttaggctagttcatgaggcatttcagatagctgaagggactaagtatacactggaagattgggtacgaagatcaaaagacagctctacaacaaagcttcatgggccattggtttcacagtagggggaactgaaatccaggctacagattcaaaagcttacaacctggcaatttatgtagcatagggaatcaatgtctatagtcttaattacatagaggctaaagcctcaattattctatttctgtaggcaggattcctacataatctatagcatctattggcataaaacattcttagtggccattctgggtacaagcatcccatttctctttctgtccttccacacactaccagtgtctctcgcttatttcctcccaactctaatgttcatatgtgggttatttgagcttctaagttaattccttgcctatatgtaaggaacatattggaaaattataaccaaagtgtagtatatattgcagagtctctacttcccatgagcagctttggagggtacctcacaggagagggttagctggcatctttccattaggaagccagcatcagcacaaggggaaaacttctctccaacgtctagacctctctatcccatgagactttggggactgggactgggtagcagggcagaattgggggaaggaggcacttaagagctttttaatttcaatattctaaccattagtgagggtgtgctgctgggtacatgtctgcccataaataaacatggactgttcattgaaacttgcatttttatgtagaaaagctcatgctaccttatcactttttgcacaaaagttgacacattatgaatgctttaaaaaaaaaattataccttactcccatacactgaacatatctttcctcatctaaaactatccaagcagccaactttttaaaattaatggaaggagagggtctacagcatgtattctcaatgggggcaatgtagccccctaagggagccaaaattggttctgggttgggagtggtgaaaaaagtctttaaaaaaataaattgcagaatatacatgcagcacatagattgatatatatatctgtgatattaaaatttcatatggaggtagttgggaaaaaatgtctaaaaaacctccttagggtgatatttgatatggttttgctgtgtccccacccaactctcatcttgaattgtagctcccataattcccatgtgtggtgggagggacctggtgggagataattgaatcatgggggtggtttcccccatactgttttcgtggtagtgaataagtctcatgagatctgatggttttataagggatttctgctttcacttctcattttccttcttgcctattgccatgtaagatattccttgctcttccaccatgattgtcaggcctccccagccctgtagaactgtgagtcaatcaaaactcttttttctttaataaattacccagtctcagatatgtctttattagcaacatgagaagagactaatacaatattgaaaaaaaaaaagttgagaaacactgatctatagtaaaatttaaatatccaacttctactatttttttggctgtccattcccagtagaatacaagttccatgaaggcagggatatttgtcttttttgtgcactgatttctcctaagtgcctagaatggtgcctgggatgtaggaggtattcaatccatacatattgaattgaatgcatgaatgaacaacttccctcagtgtcccagagtccactttctctcaacactgcaagtggtggcaagctggaaggtttgtgagcagtgctggagctgggctcttccaggtgcattcacaatagtttaaaatagcaggtgcatcagaggaggcctctttgttcctggtactatgctcattgatgtttactatgagccccttgcagactcaagcatccattgtttgccttttaaatatctctactagccgggtgcggtggctcacgcctgtaatcccagcactttgggaggccgaagcgggcggatcatgaggtcaggagatcgagaccatcctggccaacatggtgaaactccctgtctactaaaaatacaaaaaatgagctgggagtggtggcacgtgcctgtaatcccatctcctcaggaggctgaggcagaagaattgcttgaactagggcatcaaaagttgcagtgagccgagatagcaccattgcattccagcctggtgacagagagcgactccatctaaaaaataaaaaaaaaaaattttaaatttaaaaatctctactctccaggccaggtgcagtgagtggctcctgcctataatcctagcactttgggaggccgaggcagtcagattgcttgagttcaggtgtttgagaccagcctggtcgacatggtgaaaccccgtctctaccaaaaatacaaaaattagctagacttggtggtatgcacctgtagtcccagctatttgggaggctgaggcaggagaatctcttgaacccagaaagtggaagttgcagtgagcaaagatcatgccactgcactccagcctggacgacaacgagactatgtctcaaaataataaaataaaataaaataaaaatcctctactgtctacttcccccacccctaatatcctagctatgtggcccaagtacttatttagcccagtccatgaaagtaaaggacagtggacagtgtcctttgataggaggatggggcagaatgggaaaagaaaatggtagggtctggaggtacaagtgggggccagagagaggggctttacagattattcgggtgtttgaaagtcagttggtgttatctttaacatacaaacatgtattatgaatctctgagcatccttcaacgattcctgaattttcaaaacagttgtgtccaaatgacacaccttgtccagaaacaatttggttttgatagaaaaagaggcaaaataaaaacactgatttacaggctcatggtgaggggtttggggaggcagatgagaagagaacctagaaaggatgtcaagagcagacttagctgacctcactttgctttgggcttgctttcctacagacattgacagtgagagttgtttttgctcaccacactgggaatatgtattgcttaggagacacatggcagttaaggcaaacagcacatgccaacaatatgttgcatgatttgatgcctgttttcagggaacttcactaggaagtgtgtgtgtgggtttatatagccacgtacatacatatacatttatatatgttttatatacttagaaataaatacggaatttgttacaggaacgtggccttacacaatcatgggagctggtctgccatcttcattaagccattgtctggtacagatgctggagtttgaagtctgtaggataggaaatcagatgttgtctcagttggcacctgctgcataatacggtaccatagactaggtggcttaaacaacacacatttattctctcatacttccagaggctggaagtccaaaatcagtgtcttgcagggttcggtttctggtgattccccacttcctggctgtgggcagtgccctcttgttgtgtgctcacgtgacctcttctttgtgcacatgtggagagaacaggctctccagtgtcttcacttataaggacactcatcctatccgattgagaccctaccttatcatcgcttaaccttaattacttctgtaaagggcgctatctccaaggacagttatattgggattggggctttaacataagaattttgcagggacatgaattgcagtccatgacagatgtaaactttgagaaacaggaaaaagctggaacctacaagcagaagtgggaacctgtgaggttggactgaaactcagatcagttcttgctgcctctgaccttgatgtatgtatcctggaggagatgctggcatctctcatcatggagctaattgtaggacaggcccagaaatggaagaagctggaagagagtctagtggaaggtggggcagcgtgggcccagctgctgttgcctgccaaagaggtgagcagcagataagtgacgaggtatgtgagctcacacacccaatccactgtggcacttctgccttccagatcctccataagaaggtctctttggcctactctgctcagaaatatataaggcaggagattctgagaaatctagttgagtccagccacgttgacatgctacaaagccaccacagactctaaggagaaattatgtccagggttgggagaagagagccattagctgtacttggatgaacagttagtggcctagaaactgatctagaaagggatctctgttgatgaaaaaggacagtggtgtaaataaaggaagagtgatttggcgatggggtgttggttcagagttaaagacatgagaatgacaaagaaaggacaagggtggcaattgagatagatgcctttattaagtatagggtatagaagtgtagaatagagaagacaaagaaaagcaaaagaactgaatagctagaatgtattaatgcagggcatcaggcatgtggagccagctaaaaagtgagagatcaaacaagattcttagagcaagagaacatcagtaggaactagccacatttatttcacggactcaatgatactgagtttctactactacagggtactgtgtttgatgcacataaaaattattaacatgtattcctgcttatcattattggaggcaggggttgtgaagtcagcatggtccccaccgccacgcccccaccccaggccaaactctaaaggtatttacctgggttttctttcgaaaaaggaagaggtcttattttttttttttatgggagctgagggcagtggataaatttggaaccagacagttgaagtattaccataagcatcagaaaaagtgaataggtttttaaaataatagggaatagagatagaaagcaatcaacaaggcttgttttagaattaaaactctacaaagtaaaagatgtagcctgaatgacccttgaaatcacatgtataatttatagcacctgattccctccaagtcatggtacagaaaatgtatgtctcagctgtgccatgctggccaatctggtctagcctcaggcttgtcacatatgaagtggtgatgacatatttatatcacagaacaattgtgaaaaacaacggctaatgtagttactcaacaaatgtagtgtgcactaaccttatgctaggcactattcccggcactagggacacagaaatgaagagagaaacaatgtcctcattctcgtggaacttgcaaggtagtcagaagagacattttattatttaatctctcactgtctaatatcatagaaatcatacattcacattcatccagagagatagttattattacctttttcacatgctgaaacagaggttacttgtctgagacctcttgctatcaagtgttaaaggtgagactgagtccaggtcttatatgactccatatgcccagcactcttcaaacggccaaatgcctcgtcccacagaaaatagaagcccacagtcctcatatactataaaacttaaatagaatacattatctcatgtggacagatggttatgactttataaactaggaaatcctatgtaggcagatgtttagttgatgaaaagaagtgtaaacatgaccctaatgaatacatgttctgcaagttattggttgctattaatacagagatagttatgctgtattaacggacaaataaggcatatgtagcaagctaaaaagtgagaagtgaaacaagattctttttttttttttttttttttggagacatagtctcgctctgtcatccaggctggggtgcaatggtgcaatctcagctcactgtagcctccgcctcccaggttccagtgattctcctgcctcagcctcctgagtagctgggattacaggtacctgccaccatgcccagctaatttttgtatttttagtagagctggggtttctccatgttggccaggctggtcttgaactgctgacctcaggtgatccgcctacctcggcctcccaaagtgctgggattacaggaatgagccaccatgcctggcctgaaacaattttcttaaggcaagagaaaccactgggaactagccacatgtatttcatgacttcaaatgatactgagtttctactactagaggaatacatgcaatagaggaaataaaagggggtgatgggatcgagtgatggaggagaagatctctttagactggttggtgagggaaggcctctgtgaggagactattgagatatacctgaggaatgggaaggaggcagatctctgaaaatctggaggaagccctttctaggagaaggaacacacaagcaaaggccctaaggcaagaatgagcttggtgtccttggggaacaaaatgaagatcagagtggctggaggttgctgagcaaatgggacctggttaattcatgcatctggaaaggtagaaaggagctagatcctgcaagtccttgcaggccacagtaaggaatctgaattttgttaatatataagacacaaggtattggaagacacaaagtcatcggaagattttaagcgagagtgacaggccattggtattttttaaaaaatcactgtggctgctataaaactatcacttatggagcaactgtaggctttttgctctttttaaagattattgtgcattggatcattcatggatgccagacttgaaatgaacaagatggggaataatggggaacttctggaatatcagtaaaaataaagaagctgctaggatcctggctacagtgtgaacccttgagttgtggcagccgtgagagatggatgtgatggctgtttggtcctgcgagtcacttttctctatcaaatatacttgaccttcatgtgaccctttccatctctttgtgaccaagtaccaagtgataagcgttaattaatttttgggtcactgtgacagatcatcagtgtgctacacttttcaggtaacaggtttccgtgaaccatttgcaatgcccaaattataagaaatcccttaatatctgactctaacagagttgcagtttccaagtctatagcatcccactaacagaggggttggaagacaagatggagccacaaaggtagcagtggcaacccgtccacccctgcttaatgctactcctggtttaagacatgagcccaatttctctttagctggtaggatgacagaaaaagttttaacagcttttttgaggcataattgatattaaaaaggacacatatttcatgtgtacattttgatgagtttggacatatgcaattacctgtgaaactatcatcacaatccagggaataaacatgcctgtcacctccagaagtttccttgtgcccccttgttgtttttgtttgtttgtgtggtagaacacttaacatgatatccaccttcttaacaaattttttaagcgcacaatacagtattgttaattatagggactgtgttgtacaacagatctgtagaactcattcacctttcataactgaaaccttctacttgttcagtaataactccctatctctccctacccccagcccctggcaaccacgattctactctctgcttctatggttttgactattttacaatcctcatataagtgtgaccatgtagtatttgtccttctgtgactggcttatttcacttagcatagtgtcctccaagcttatctatattgtcacgtatttcagaatttccttttttaaggctgaataatattccactgtgtgtatagactatattttctttattctttcatccatcaatgagacacttaggttgtttctatatcttgactattgtgaagaatgctgcaatgaacttgggcgtgcaaatatctcttcaagatcctgatttcagttattttggctatatacccagaagtgggatcactggatcatatgatagtgctatttttaatgtttttaggaatctctgagatggtttggctgtgtccccacccaaacctcatcttgaattgtagctcccctaattcccacaagtagtgggagggacccagtgggagataattgattcatggggatggtttccccatactgttctcatggtagtgaataaatatcatgagatctgatagttttataagaggttttccctttcccttggctctcactctctcttgtctgccaccatgtaagacatgccttttgccttccaccatgattgtgaggcaccccacccccagccatgtggaactgtgtgtccattaaacttctttttctttataaattacccagtctcaggtgtgtctttatcagcagcatgagaatggactaatacagtaaattggcactgcgagggtagggagctattgtaaagatacctgaaaatgtaaaagcaactttgaaaccaagtaacagggagaggctggaagagtttggagggctcagaagaagacaggaaaatgtgggaaagtttggaacttcctagagacttgttgaatggctttgaccaaaatgctgatagtgatatgaaaaatgaagtccagattgaggtgttctcagatggagatgaggaacttgttaggaactggagtaaaagtgactcttgctatgttttagcaaagagactggtggcattttgtccttgccctagagatttgtggaactttgaacttgagggagatgatttagggtatctggcagaagaaattgctaagcagcaaaccattcaagatgtgagtttggtgctgttaaaagcattcagttttgaaagggaaacagagcataaaagttcagaaaatttgcagcctgatgacgcagtagaaaaacccattttctgaggagaaattcaagccggctgcagagatttgcaaaagtaacaaggaaccaaatgttaatcaccaaggcaatggggaaaatgtctccagggcatgtcagataactttgctcccattacaggcccagaggcctaggaggaaaaaatggcccccccacctgctatgtgcagcttagggacttggtgcccggcatcctagccattttagccatggctaaaaggggccaaggtatagctggggccatggcttcagaaggtgcaagccccaagacttggcagcttccacgtgggcacacagaagttaagaattgagttttgggaacttctgcctagatttcagaggatatatggaaactcctggatgtccaggcagaagctttctgtaggggtggggccctcatggagaaccctttgctagggcagtgcagaaggaaaatgtgggattgaagcccccacacagagtccccacaggggcactgcctagggaagttgtcagaagagggccaccatcttccagaccccagaatggtagatccactaacagcttgtatcgtatgcctggaaaagccacaaacactcaaagccagccctgaaagaagctgggaggtaggctgtaccctgcaaagccacaagggtggggctgcccataggaacccacctcttgcatcggcgtgacctgaatgtgagacacagagtcaaaggagatcattttcaagctttaagatttcactgccctgctggattttggacttggatgggacctttagccccctcattttggccaatttctcccatttgggatgggtatatctatccaacgcctgtacccccattgtatctaggaagtaactaacttgcttttgattttacaggctcataggcagaagggacttaccttgtctcagatgagactttggactgtggacttttgagttaatcctgaaatgagttaagactttgggggactatagtgagggcatggttggctttgaaatgtaaggacatgagatttgggaggggccgggggcagaatgatatggtttggctgtgtccccacccaaatctcatcttgaattgtagctcccgtagttcccacatgttgtgggaaggacctggtgggagataattgaatcatgggggcagttcctccatactgttctcatggtagtgaataagtctcatgggatctaatggttttatatgggttttctctttcacttggttctcattctctcgtctgccaccatgtaagatgtcctttttgccttccaccgtcatcatgtggaactgtgagtccattaaacctctttttccttataaattacccagtcttgtgtatgtctttatcagcagcatgaaaatggactaatccaatctccatactgctttccatagcagctacaacattttacattttacatttccactaacagtgtacaagggttccagtttctttacatccttgccagcacttgtctttttgataatagtcatcctaacaggtgtgaggtgatatctcattgtatttttgatgtgcatttctctcatgattggcaatgttgaccaacttttcatatacttgttggccatttttatgtcattttttgagaaatgcctgttcaagtcatttgcccatttttaaatttgtttattttcttgccattgagttgtagtaggagttccttatatctcttaggtattaaacccttgtcagatatgtggtttgtgaatattttatcccatttcataggctgccttttcactctgttgattgtttcctttgctgcacagagctttttaatttgatgtagtcccacttgcctatttttgcttttgttgcctatgtttttggtgtcacatccaagaaatcattgcagagaccaatatcataaagttttgccccatgttttattctaggaattttatagtttcaggtcttacatttaagtctttaacttactttgagttgatttttatatggtataaagtaagcattcaatttcattcttttgcatataagtattcattttttgcagcataatttatcaagggactaacctttctccattgtatattcttggcacgcttgttgaagatcagttgactgtatatgcatgaatttattgctccactgtctcttctgttccattgatctatatgtctgtctttacgccagtaacatactattttgattactctaggttcgttatatattttgaaatcaggaagtgtgatgcatccatttttgttcttctttctcaagattgctttggctttttggggtcttttgtggttccatgagaattttagtattttttttttctatttctgtaaaaaatgcccttgggattttgatggggaaagcatggagcctgtagatcactttgggtagtatagatattttagcaatattgtcttctagtccacaaacacagggtatctttccattttttatgttttctttaatttatttcattgatgttgcctcagtttcagtgaataatcttaaaccttcttggttaagtttatcctaggtattttattctttttgctgctattggaaataggacccctcccctcccctccccttccctcccttctttcactctgttgcccaggctggagtgcagtggcacaatctcggctcactgcaatctccacctctcaggttcaagcaattcttctgcctcagcctcccaagtagctgggattataggcatgtgccaccacacttgcctaatttttgtgtttttagtagagacggggtttcaccatgttggccaggctggtctcaaactcctgacctcaggtgatccacccaccttggcctcccaaagtgctggcctcccaggtgcaaactaccacacctgaccaggattgttttcttaatttccttttcagatagttcagtcttagtacagggaaatgcaactaatttttgtatgttgattttgtttcctgatatttcactgaatttatttattagttctaacagtttttgtgttgagtctttagggtttactgcatataatatcatgtcatctgcaaacagagatattcttacttctttctttcctgtttggatttctttttcttgcctaattgctcggattaggactttcagtagtatgttgaaagtaagtggtgacagtgggcatcattatcttattcttgatcttagaagaaaagcttttatttttcgttagtataatgttaactgcgggattgtcatatgtgaccttttttatttttatttatttttttgagacagagtctcactctgtcacccaggctggagtgcagtggcgtgatctagacttactgcagcctccgcctccccagttcaagtgattctcctgcctcagcctcccaagtagctgggactataggcatgtgccaccatgcctggctaattttttgtatttttagtagagacggagtttcaccatgttggccaggctggtctcaaactcccgacctcaggtgatctgcccgccttggcctcccaaagtgttgggattacaggcatgagccaccacgcccagccaacttttttatattgaggtaaattccttctatacctagtttgttgagagttttatcttggaaggtcagatgctttctctgcatctattgagatgattgtgtgatttttgtccttcattctgttaatgtatattatatcaattgatttgcatatgtcaaactatcatcagatcccagaaataaatcccacttggtcatggtgtatggtacttttaatgtgctatggaattctgttttctagataggtgagactttttacatctatgttcatcagggatattcgcctatagttttcttttcttgtagtgtctttgttttgactttggtgtcaaggtaatactggccttataaaatgagtttggaagtgctttctctccttcagttatttttttaagactttgggaaggattggtgttttaaaaaaatatttggtagaatttgccagtgaatccataatggaaatattgtatataggtaatttagtaagtcaagaattgtccctcaaaaggtactagaaaactcagttcttacttttaagactcttctaattatcctggtggaatggcttctggaatatcaccataatactgaaatttactccataatactactgaatggaagggatccagtgctggaaactttacatttgaccaggtgcagccctcaatactaggacagtttggctagggggctacccccacaggtagcagggaagaaggctgcattggtttgactgggatggaagaagaataagctaagtagtctgtcagagtttgccaggttaaagaggaaagatgatagcacaggctggagggaggtcaaagtcacattctggggaaactagatgtatgttgaccagtaggggcaagcctagtatggaatggtgggtgacagtgaacattgagggccaatgagatttagagaatgaattgaggagtgaggcttaggggaaagaaggccgggcacattagaaggctcagaggtctaagaagcatgaggaagattgtcctccagagagctgtccccttgaaggaggtgcgttggcatgatcttgtcatgaatttctcaccctgtcagaaacatcttatgtagattttttaaagggcaacagttttcctgctcactctgagtacctgaaccttgattctaagacttaggtaaggttcacttggcctggatgtttataaatgccagtaccaaggggagtccttgaaatggcatagaagatggcaaagggctctgcagagccacgaaacccaaatttagaaatgagaattactaacaatgcatatacaacatgtctacaataaactagaaaggatgatatagtttctgataacagtctttgaactttccctacctatgaaatggtattaacccttaatcagcagctcaggaaatagtccacggtagatcctcatctttgtatttcctttactgtctggttacttactgaaaagtggtagctgaggccgtatctcctaacctgcatgctctccctctctattttctttgtctcccatgttctccctacaaagttagcattcattcattcattcttattttctttctttctctctctctctctctctcactctctctccccctccccgttttcctgtggtattgaaagcttattgtcaggatgagccccttattgcttggaacccaatctgtgtccatgaattgcccatttcacagaatcacgaaagccacgctgcttcctgagcaacacagctaagtggcattccccacccctgctcttagcaaaagttcctcaggacattattgttgaattactcaatgcctattatcatagaacctcatgttcacgctgggaggtagttactactacctttttcaaatgctgaaacacaggttacctgcccgatacctctctgctatcaaatgtcaaaggtgaaattcagcccaggtcttctgactctacatccagcattctttatagagctaaatctctcttcccacagaagatagaagcccacagttctcacatacttacaaaacttaaatagagtacattatctcatgtggacaggtggttatgactttataaactaagaaaatctaggcagatgtttagtcaatgtcaagaagtgtaaacatgaccctaattaatggatttgctgaaagttattggtctctccttgtcagaactgttgttttccctgtcacttctcagattggattagaaaaaattaagcatgaagaaaattggcatttaaaatgtgtttattcttcactatcaagacagatagaactttccattcaaaagagaatgaaaagttcattttggcatggtgaatcataaataagaaaaacagaatagagaaatcctaggacgatcaatctctcataaaataaagaaatcgagattttatcgcaaagaattctgcagcacataaaggcccttaggactggactgatctccgagttcaagcgttacacccagtatgctgcataaaccctattcagtgtttgggctcattctcaagaggttgacatccttcccattttcatatcacctccctggtccacctttgctaggtcacaggtttttcaggcactttgcattctgccctccctcctctcaaaagacttcccggcatgttttcgatagcttcacacctagcagatggcagtttttcttctgaccttctgccagccctcttccttcctcagcttccttcctctccacagcttccatttaaggtattttggaagtccctcgaaatgggtccttggtgagtaaacccctttattgagtctcggactttaagaagttcttggcttcatgggacccccttcttctagttgacacttttggggattgatttcaagaatcatctgttgctgataagtcagtgtggcttctattgctgcagaagcaaggaagaaactaggcatatagtggaagaaaatgcgcttaattagaaactggtcctcattagggattcttaaaggaagtgctcaatttgcacctatgttagcagagcctcacacggattaattaaaagctgctactctcaccagcaacacccttcatggctgggttgaattgtttgtagctgtcaactctgtgccaagggcaacaaggtttgaatctgagttctttgaaatgcaggttctttcactcactatgcagaatctagggatccagactctcaagaggcaaagctctggaagaacaggtggagtgagtatccctctggcttctgctcccgccagatgatcaccatgcctctcaactctacactcttttccctgcctgtgctccagttcacactctccacatccctggggccaggctatacctagatccttctgcttgatctctcaggctccgatgtttcaactcgtcattccctaggctattaacttcaagcccttagatggcattcaagctccttggtgacctctctgcgtccgtctccatccccatctgcttccgtgagcttcataggcaagccactctccatagttatatgtccctcaaatacccagcatccccatgccatcatttcaaccagactgtcctttttcttttcccacctaaggaaattctattagttcttcatggctgggttcaaatccacctccttcactctccaggaagactacattattcttttcctaacactcctgaagtgcttgtcctctacagcattgctgcacatattttgttctgttctttattacactagtccatatggctttactccctgctgaatttaaactcttcaagggcttgatctctgtcttattcatctctgtaacctcacagtacctaatcaagttctttgaacaaagccagtgttgaaaagtgtttgttgaattgagaacagcaagccagactttctgatgggctagaaagatatacctagaaagatagagcagagtagcatttctaaagatggaaaggacaagcctggctaaaatcatgctcaaagaaaggttttcttttagggtcctcatcacatcacaatagcaaatttttaaaaaaagaaagggccgagcacgtcagtatagttaccgagcgtacttgtgtactgggcaaagtactgagcgcaatagaaagttactaaaagaaagaacagatgctttttctcctttagagctggtcccttttcaaaataaggcctcaaagtgcatcccattattaaccctgaaatagtgggacacaaacgtccagatagatatgtgcatgccaatacgtgtttaaaaatctggcgtcacacagcacactccagaggaagccaagcctaagagacatgaacacagtaacacggtagggagccgtgtgatccagactgtcctaagcagaagaggccccgggtggagaattctcacactgacagccgcagagcctgccttccccagtgtactggttttcccagggcatcaaacattttatttaataagctacatgtttgagtcacaagcgtagacttgacacccctgtatggtcaactccagctgtcgtttgttctcctcccctctcttctggcacagtggctggaacctgtatctggtgtatcacaacgctccatttcgctgatcacacacagccagaagtgacagtcgcttctctcactgccaaggacagaggagactctggctggacaggagaaattcaggtcgaaccaaggcaagtgaacgatggaattaaaaacggctgagaaatcccatagacttagaattactcatatctgcagactagagggaaatgagttggtcctgatgacaaaacaaccctttcttttctctagtctgttaaacttctattttcccgtcagactgttttaacaatgccctctactgggtattttcaaaactgcagggttctgcaggcctgacctgctcttgttctccttgagtaattctttctgcaagatgaactgaacccaaagttttcttcacataagcaagatgttactgatgtatagtttcttaagagcataaaaagtggaccagtgcatcccctggaaggagggcctcttgccctcttgagagatttctttgtaaaggtgcatgaggaattgaaatctcaccacctcctgaactggcccagagctgtcctggcatggatgacacagggaccttgacatgggctgatggattaagaacaatgttacattttctgaacgcatcacttttccaacagctcttgatctcacatgtgaggctctttctcatccctgaaggctactgacttttccctggatatatttgtattgtgattattctgcatatctaagaatttcatccctttctaaccgctcctctgccaaaacagaaaccaaaaaaagccaaaacatcactctgtgctagttagtttctttgacccctcttaaagaaactctaaacaaaaaatctgcgtccagttatatccaagggggtgttcttactgggtattcccgtcagaacctcccatctgtctattttggttcattctttgccattatcatgtaacaagttcaagataattgtgtttcatctccagttattattcatagtccctctgcatgttgaagattgctgagacagcacagaaaaatagtaaagcaacagatgaggtctgtttgcaaaaaatgtagaacaattcgaggtgcaggatgttcttcaaattgtgatggggtgaggttttgaaaagttcttcggatgggctagtgtttgttttctctctccctctccctctcttcccccctcccctttccgctttcccacttcctctctcctccttccttcctccccatccatttctcttaaatagaaacaaaattccatatattcttagaatccataggatccatatattcttagaatccataggatccagcattgcattttatttaaaagcaaatgccgaccaagtagtcagtagcaccctttcagctccaatagttggtgctatattctgtactcagcagtagactcatttcattattttggagtatggacctgaagaaaatgaatatcagacatgggctaagccaaggccagttaataaatattttaggctttgcaaaccgtatagtctctgtagcaactattcaactctgctcttatagcaccaaagtagccacaaataatagtaaacaaatgggcatggctctgttctagtaaacttacttgtggaaacgggacaggctgaatttggcccacagaccctcgtttgccaatccctgggctaagctattgcaggggtactgctgatggatatgcgggctgtgtcctgtgtgacagtgcctagccaagggggcaagtgggacctgaaatacaacccatgctctgcttctccacgccttccaccacaagaggtcctttttgtaattcagacagaggtaccatttgttcacaggctgtctccaaccagaataagcacatttcctaatggattagggtacttaacatggtttgcataagtgggaggaagagggacctgattttcctgtattaggataagggttacctttgatcccaatggctgttattgaaatgactaaagccacatggttcaaacatggctgccttagcccacatctacagactgggagtaggtggtgggagcaattccaacagagatgtagactgggaaagtgccccaggtaagaggaaccccaaagaaggtgagtttattggttagggggcttgttggatattattaccaaagccatagtccctttatgaagtttgttctgtccaaaaatgtgatttaggccactgtatgagtccattctcacattgctgtaaagaaatacctaatgctgggtaatttataaagaaacgaggtttaattgggctcatgttgctggaggctgtgcaggaagcatggtggcatctgcttggcttctggggaggccttgggaaaacttagaatggtggctgaaggtgaaaggaggagcagcacttcacatggccagggcaggagggagggagagaggggagctatcacacactgttaaagaaccagatctcgtgagaactctatcatgagaacagcaccaaaggggtggtgctaaaccgttcacgaaggatccaccactatgatccaatcacctcttaccaggccctatctccaacatgggggattacaactaaaatgagatttgggtggggacacatatccaaaccatagcagccaccactctccatcttagaatggtagaataataaaattaggaggaaacttggtatgcttttgcatgcattttaacatcagaaccctttgttcaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaagaaccctttgttcaaataaaatcttatctagaactccagtatacgcaactgtgaaaaagggagagtgctctggtgcagctggagaggaaagacaaggagtgccctcagtaaccccctccccagatccggctggcccagagagagctgctgagactcccccaggacccagtttggagccactgatctcatcactgcataggagggagagagagaggggagatatgaaacaacggaggcaaaatgaaataaaataatcttaggtgacaacattttttaccaggttttgttggtataaaacaccctttccttttcagttcccctacctgaaagtctttggttgcttatatatatttaggatgtttttatatagggtaatatagaattgtaaggcttaatataatattaatatttgacattctattggatttaagcagccagtgggaagagagtaaataaaaataactacacaaaggaaactgctattagcgtttgttaccatgtgaatgaaatagcacatcagctgtgcatttaaagatctggatagaagtttgtttcagttatttgtttgttttgaggtacatttacatacagtgaaatacatagcttttaagtacacagtttgatctgtgttgactatacttacgtaacccacagctctaccaaaatcaacaacatttccatcatgcgggaaagttctcttattccccttcccaataaatctttcccacccagaagcaatcacagatgtgatgtctatcaccacacttggttctattctaggactttgtataaatggaatcataccatatgtactcttttgtgtctactttgtttcacttagcataatatttttgagatttatccatgttgcagcatatggccatacctttttcctttttatgcctgagtagtgttccattgtgtgaatgaatatgccagtttatccattctcctgtttatggacacttggaatgtctaaaagctgccatgaaaagccttgttcaaggctttttgtggacatatattctcatttctctaggataaatgcctaggagtagaattgctgagtgataagagtgatgcatatcttttaagaaaaaaactatcagagttttcacaattatccattttacacatccatgcaatatatgagcattctgattgttccacatccttgccaacacttaatattatcagcctttaaaatttcagctattctatttggtgtgtttctcatgtagttttaatttgcatttctctgtaataatgttgattgccttttctaagtgcttattggctattcacctatcttttgtcaaatgtctattcagatgtttgccctttaaaaaattgtgttgtctttttattgttaaattgtaggagttctttgtaagatacaggtctgggaaatattttctcccaatctgtagtttgcttattttattgagattgtcttttgataatgagttttaaattttgcagttaaatttatggatatttttctcttatggttattgcgttctgtgtttgaaggaatcttgccttcctcaaagtcacaaagatttatcttatattttcttctagaatatttatacttttaagttatacatttatgtctatgattcatcttgagttaatttttatatacaatatgtggtaagattcaaagttcttttctttttccacatggctatctagtcattccagctcaatttcttgaaaagatgtttctttttcaattgaattgctttgatatctttgttgaaattgatttggccatatatatgtagggctacttttgggctttcagttttatttcattgttctgtttctattttatttcactaaaaccacactcttgatttgtatgtttatagttaatcatgaaattagatagagtaagtccttcaactttgttcttctatttcaagaatgtttgggctattctaggtcctttgcatttctgtataaattttagaatcagcttatcgatttctacaaaacgtcttcagaaattttaattgagatctattaagtcattagataaacttgaaaagaaccaacatcttaagaatattgagttttctaatccttaaacatggtatatattattattattattattttttttttatactttaagttttagggtacatgtgcacattgtgcaggttagttacatatgtatacatgtgccatgctggtgcgctgcacccactaactcgtcatctagccttaggtatatctcccaatgctatccctcccccctccccccaccccaccacagtccccagagtgtggtattccccttcatgtgtccaggtgatctcattgttcaattcccacctatgagtgagaatatacggtgtttggttttttgttcttgcgatagtttactgagaatgatgatttccagggacatggatgaaattggaaatcatcattctcggtatatattatttatttagatcttctttaatttctctcaacagtattttgaggttttcagtatatatctcacatacctttcattaaaattattcctaagtactttctgttttgggaagctattttaaatagtattttaacatgttacattgatgaattctttatgtagaaggtttttttttgaagattatagaattttatgtatctaccaggtttgctaatttgttttagtttatttatatctttgattaattatagccttgtaaaatattacttaatattacatactggtcatttcctgttctgtcttgcagatgattttatagctgacatcggtcaagaactacattatggtgggataaaattttaatttactagagtattatagtgagggaagttttttctttcttatggagagtttttattatgaatgctttttaaaatgctttttctgcatctatttagatggccatttggtttttctccttttaatctattaatatgttgaattatattgactaattttaggatgttaaacagcctttcattccagggttaaacttcacttggccgtgatatattattattattatgtatgtgtggatacatttgagtttttaatgttttgctaatgatttttgtgtttgtgttaatgagagatattgtcattaatgttcttttttttttttttttttttttttccccccctctgagacagagtctcgctctgtcgcccaggctggagtgcaatggtgccatctcagctcactgcaagctccgcctcccgggttcaccccattctcctgcctcagcctcccgagtagctgggactacaggcacccaccatgacatccggctaatttttttgtatttttagtagagacggggtttcaccgtgttagccaggatggtctccatctcctgacctcgtggtccacccgcctcggcctcccagagtgctgggattacaggcgtgagccactgtgcctggccctaatgtttttataacttgcttgtttcagtgtctgggcaacactggccttttaaataattggaaatgttctctcctctgtttctcagagaatttgtggaggattttactattttctttctcaaacatttagtagaatttgccagggaacctctccaggttgggagagttctttgtgggaagtttgtatttatgagtgaaatttctttaattgacacagggctattcaatttttctatttcttcttgggtaattttgttcttttcagtctttgaaggaatttgttcatttcctgtaagttgttaaatttattggcataaatttgttcatacaatttccatattaccttttattgtgtctttgtaggtttttatggtagcatctttatagagatataactcacatataacacagtttaccatttgatgtatacaatccagtgtttttaaagagatttagctatacagctaattttagaacatttttatcaccctaacaagaaatcgtggtgccataccagtccttcccaccctatttacccagccttaggctaccactcctctcttttcagtctttgtagatttgcctattccagactttttatataaatgagataatataataagtggtcttttgagactggcttctgtcacttagaataatgtttttaaggtttactatgctgctgttaacattcatgtacaaatgtttgtgtgaacacacatttttatttctcttgggaatatacctaggggaagaatttctggatcataacgtaactctatatttaagcttctgaggaactgatggactgttttccaaaataactgcaccattttagactttcaccagcagtgcaggaggatttcaatttctctgcatccttgctaacacttggtgtcatctatcttttttattacagccatcctagtgggtgtgaagtagaaactcattttgctttggatttgcatttccctgatggctaatgatgttgagcatcttcccatgtgcttgatggccatgtgtatgtatctttcttggggaaatatccattcagccttgttatcctttaatgactgtagaatctatagcaatatcccttctcactttcctgatatcagtaatcttcatttctctcgtttttttcttaatgagtctaaataggagtttataaattttattagctctttaaagtgccgacttttggttttatcatttttctcttttgtttgttaattttatatttcatttctcctttttactacttcattcttttacttaccctgagtttaatttgctcctcagattatttagatcaaggatctaaatttctaccttaagaaactagctttttctagcatatgatctatcctagtcaacataccatgtgaacttgaaaagatcgatgtattgatagtagcttttactttttctctatcttttttttttctgatactattgattgcttagaagaactgctttaacatagatttccaaactctatacccataaaactggaataggttacactatacccaatttatagataaaaaaatgaaacttgaggctcagaaaggtgaaatagattgctggtctgaaacttacctagagatgaaagttaggtagactccactgcttaggttggaagaatatgcagacaggaaaccagtgggaaggggacagtacaatgtacctgcagacctgattattccagtatagcaaaagcattctgtctcagcctgtcacactttgataagatatatttgggggaatatcatgagtttttggcttatttgttaaacacctggatttttatggtctaactttagttgttgactaagcaaagtatttgttgactaatgtgactgagttgtgaaacgtctcgaaatggcatttcaattgtcagtgaagggggtggcatagacatatgattccttcatatccactcaactgagtctggcgtctccttgaatgcaggcatgcggaatgtccatgtgcctggcatcttggcggtggtcagtaaatgtttgtcaaaaggagctgaagtgtataccgtttctttgacttcttctgtgagtcaagcaccaggttcatctgagtgaaaaaatgcaatgtggatgagactgtgatgtgtcctgtacactgaaagagatcttgatcgttactaaatgggtattaaatgaggcagtgtggccatgacagaaatatgcaagaataaaagaagtgttgtagttcgcagaactttagagggggaaaatatgatttatttattacttgtggaatctcttgatttgatacactggtggaacatagcattatagtcaaagcagcagtgatagcttggcttgtgtgaaaacaaggtaggatttgtaataccatctgatattcttctccgagtttcagattcagaaagaacagtatcaacatgtaccgagcaggggaaacaatataggaaagatataaaagaaaatatgcaatccttgaccaatgtaaataaatgggaacttttgatttatttgtcatgtactcagattgatgggtttcgtagtgaagtaaatgtgtgtgcatccctggttcaggagagagtgttttgtgtatcattctagactactccagactgacatttcaaagcaacgtatcatcagtgaagtatgtatttatcgttagctcttgaaggatttttttttttagttgatagagtcatgtcttagtttctcaatgtggagaagctaaaactgtgatcctgtttctcattttctctctcaccacataggaaactatcctggtcagaagctaccccttggttgtatcagtttgctagggctgtcacaacgaagtaccacaaactgagtcacctaaacagaaatttgcaatctcagttctggaggccaaaagttcaagactgggatattggcagtgttggctcctaccaagagctgccaagaagaatctgtgccacacctcttccttagcatatgttgttggctgacaagctttggcattccttggcttgtagaagcatctctcccacctctgccctcatcttcacgtggtgttctacctgttgtatgtctccaagtccactcacactggattagggacccacactactccaggacaaccttaattaattacatttgcagaagccctacttcaaataaggtcacattttgaagcactgggggtggggacttcaatatatgaattttgggggacatgataacatgctgcttataggtggaaaataatttctacatatttattaataaggaacctctaagatgaacagatttggaaatctagtttatcttcagtttgttctaagcatctgtgtgacctggaataaattacttcattatcccaacctcagcttcttcatctgcaaggtggaagaggtgatacttgctctcctatgttatagagtcgtagtcaattataacaatagctgctgccatttattgagtggtaataagagccggcactatcacaagagtggacaccttttacaggctaggaaacagtggcacaaagaagtaaagtaatttgcccatagccaattaagtggcggagccaagattcgaacccaagaagaatggctacagtgccaactctttcaaccagggaaccaggagagcatcactatataaattctgtgtaaagtgcaagacacaatgcaaaagttcgttgtcactaaaaggagaactcagggcaaagtcttgtccttcccacttctaattctttttttcctactccagtgtttatcaaacttttcccccttttagaatacttattggaaacccatacaaaactcatatctcctctgatgtttttgaaatttcagaacctgcatcattattgaagtaaatccaagcaatcagaatttgaaaatctagctttccaaacggcctcagaggcccccaacacacacatacacatacacacacacacacacacacacacggacacataacacacagtgtgttaactcagtccttcctgccttcagtttctgtggtacagccatgatatggcttggctgtccccagccagatctcatcttgaattgtagctcccataattcccacatgtggtgggagggacccagtgggaggtaattgaatcatgggggtggatttttcccatgctgttctcgtgatagtgaataagtctcacaagatccgatggttttagaaagggctgttcccctgtacgtgctctcttccctgccgccatgtaagacatgcctttgctcctcctttgccttctgccatgattgtgagggctccccagctatgtggaacagtgagtccattaaacctctttttatgtctttattagcagcatgagaacagactaatacaagccataaaaggccaagatcatcattcctttacctacattctttttttgttatttgcccttgcttttcatcatgcaccacatcatttatgtaactaaaaataccaacttccaggccaggtgtggtggctcacgcttgtaatcccagcactttgggaggcggatgcgggtgggtcacctgaggtcaggagttcaagaccagcctggccaacatggtgaaaccccatctctactaaaaatacagaaattagccaggagtgatggcatgtgcctataatcccagctactcaggaggctgaggcaggagaattgcttgaacccaggaggtggaggttgcagtgagctgagattgtgccattgcactccagcctgggcaagagtgagactctgtctcaaagcaaaacaaaaacaaacaaacaaatgaaaaaccagcttcccttagattcccccatgagtttctgactccactacctaattcaataaaggcatttttaagaaatataaatcatatttattcatggttatatgtacatgatacaaaacatttcacagcagaaatggactcttttttaccccatcctcaatcaactaatttccttccctataaaaatctattatttgttttgtgttgtgtgtttcagccagagatactctatgcatgatgcaaacatattagcatccatatgctactttcatctaaaaagtagcatactctccacagtattctaaacctcttctttcacctattaagatatcatttctctattgtaagacttaaaatttaatgtagtgcctttgagcccaaaagtcttgagtttccctacttctaccagatattccccccaaccttcccaaagagaaaggctccctacttaaatggttcctctatcatctgggcctgctgggccgtacccattcctcaacctaacaggtttcacctcccggccagcccatgacattagtcacatcctcctgtaggaacctgaggacacctctcccccttgttactacatagccggcctcccacagcccttgtggtttgctctgctgtggactgtagcccctgtatggtgaacagtgtcctcctcccccaggctgcaagtgtatgtgactagtaaaccacgatctgtctcttttaagtggtgtggggtgttgtttgtctgaccttctcatattatttagggcagaggatccacctttaccaactgggtgaataggaggtgattagaactagtccatattaccacatagagcaatcctttgcttttcctaataagtgcacagaactctatagtatgaataggaaccaatttacttatcttgttccctgttggtagacactgggtttttactctttggttccacagcaatgctctagtgaattttctattccacattttgcatctgaagtcatcttgcatctgaaggagtaaattattacaagtaaagtatgggtcaaatgctatgcacattaaattttaataaacattggccaggcgcagtggctcacacctgtaattccagcactttgggaggccaaggcgggagtggatcacctgaggtcaggagttcgagaccagcctgaccaatatggtaaaaccccatctctattaaaaatacaaaaattagctgggcgtggtggcatgtgtctgtggtcccaggctactcgggaggttgagacaggagaactgcttgaacccaggaggtagaggttgccatgagttgagatcgtgaaactgcactccaggctgggcacagagcgagattctgtctcaaaaaaataaaataaaaaaattaataaacattgccaattgcttttcatagaatgtgtaccaatttagacccccacaggcagctggacagtctatttccccacatcctcatcaacccaggacattaccaaactttctgatcttggccaaggggagaggtgaaaaatgtcaagtccttgtggttttagtttacagttttacaagaagtgagggcaagtgtcttttcatatgcttacaagtcatttgtatttctggcctttctcttattgactcgaggaagcttttcctttattgaataaattaccactttttctatgatatgaagttgaaatatcacttatcatttgtctttgtttatagtaggttttgctgcctagatttgtattttatgttatcacatttaccttcttttgtggattctagtgttggggttacatatagatgcatcttctccagtctgtgtaggagaatctcattttattgtgcgttctttgttgtgattcacagatatcacatttttttacaaattgaaggtttatggcaactctccattgagcaagtctatcagtgccattttcccaaaagcatgtgtttactccatatctgtgtgtcatattttggtaattctcaaaatatttcaaactttgtcattatcattttttcttttatggtgatctgtgatcagtgttgtttatgttgctattataattgctttggggcaccatgaaccacacctgtataagatggagaacttaataaatgttgtatgtgtactgactgttccaccaactggccattgcacatctctctccctctcttcaggcttctttattccctgagacacagcaatattgaaattagaccaattcataaccctacaatggcttctaagtgttcaagtgaaaggaagagtcatacatctctcactttaagttaaaagctagaaatgactaagcttggtgaggaaagcatgtcaaaagctgagacaggccaaaagctagacctcttgggcaaaataattagccaagttgtgaatgcaaaggaaaagttattgaagaaaattgaaagtgctactccagtgaaaacaggaatgataagaaagcaaaacagccttatcgctgatatggagaaaattttaaaaggtcaatgcctggcttcaaaagacaggctgactctcttgttaggggatagtgcagctggtgaagccaatgctcatttaccattccaaaaatcatacagcctctaagaatgacgctaaatctactctgcctgtgccctaaaaatggaacaacgaagcccagatctgtttacagaaggatttattgaatattttaagaccactgttgagacctactgctcaaaaacaaagattcctctcaaaatattgatgctcactgacaatgcacctcatcacacaagagccttatgaagatgtacaagaatgtgtaatacaaggcatgttgttttcatgcctgctaacacaatatccattctatagccctggagcaaagagtaattttgatttccaagtcttattatttaagaaatatactttgtgaggctatagctcccatagataaggattcctcttggatctgagcaaagtaaattgaaacactcctggaaaggattaacagttccagatgccattaagaacagttttgatttctgggaggaggccaaaatttcaacattaactgtagtttagaagcaattgattccaaccttcatggatgactttggaggggttcaagacttcagtggaggaagtcactgcaaatgaggtggaaatagcaaaagaactagaattagaagcagagcctgaagatgtgactgaactgctgtgatctcatgataaaatttaaacaaatgaaaagttgttccttatggatgagtaaagaaagtggtttcttgagatggaatatgctcctggtgaaaatgctatgaacattgttgaaatgacaacaaagtatttagaatattacataaagttagttgataaggcagcagcagggtttgagagattgattccaattttgaaagaatttttgtgtgcatgtggaggtaaaatgctaccaaacagcattgcatgctacagagacttatttcatgaaaggaagaatcagttaatgtagcaaacatcattgtggtcttattttaagaaattgtcacagccaccccaaccttcagcaaccattatcctcatcagtcagcagccatcaacatcaaggcaaaacctcccaccagcaaaaagattacaacttgctgaaggctcagatgatccttagcatttttagccataaagtattttaaaataaggtatatacattgttttttagacataatgctattgcacactcaatcaactacagtataaacataattttatatgtgctgggaaaccaaaaaattcatgtgacttgctttattttgatatttgctttattgtggtggtctgaaactgaatgcacagtatttctgaggtatgcctatagttgcattaaaaaaaattctcctgatgttattgtcaagattttaatggcttcacttttacatttaaatatttgattcatctggaatctatgctgatataaggtatgagataaagatctataatttgtttttacagttgattatttgacaataattcttttttccattaacatacaatgtcatatttatcaaatactgagagactgtttctgatctgtgttctgttccatggatctgtctcttcatgcacaaaaatgagaatgttttaattattatatatttaaaatgttttaatattgattattatgtatatttgtcttttccttattcttgtttattttgttttccaaatgaactttaaaatcatcttgcctatgactccatgaaaaaattatattgctgtttttggattcttgaaaattcatatactaaagtaagaagaattgaatctttaaaatgacaaattttccaatcaaagactgtgacatgcatgttatttctttaaaggtcttcatgccctgatagtgttttagagtttagtttatatagctcttccacatgtctcattacatttattcctaggtatttaaatagtagtctttccttcctttgagactttctgactagtggtaatttacaaatattaaggctgctgatttctagatatgagcttcccccagccatctaattaaatgttttattattctaattttccaggtgtacagtgatatcatctttaaatatgatgattttacttcccttgcttcaatttttgtagtccttacgtctttctcttgtttattttgggttggccttcagaacgatgctgagtaaaggataaaggatgtcttcatcttattcttgattttaacaaaaatgcttctgtagttcccctaccgcaaatattgagtatccatgatgttctaggcaccaggatgtagcaaatacaactgtccttcaggactcaactcaaatccaccttcttccaaagccccctgtgatcatctcaaacagaaattgtctttgcctcctccaaacttcatattttccttccctttactgtcctactttttatcttgctttagaattatcagtatacttgtcttaaatagtccactaaaaatcggtatgctcagagaaggcaggatctttgacaaatcatctagtcatcctcagaactctgccttgcccacagcaaatgctcaacacagtcctgcttaattaattataaattagttagtatgaaaatttgttcaaatatatttgagcaaatactaagtaagcatctgctcagataaaaatgcaggattctcatacagagcacttggccatgagtaataaatgtaagtccggctctcaaaatatacatgtattcctatttggcactagccaaaagggggtgcaatatttacctttaaattattatagagagaatgagctagaaaggaaaaagccagttggagccagaaagcttggagtctttgaacctccctcagttctctaaatctagatgaaatgatatgaatcatcaagtcatttcatgccttttacacttcactttaggatctttttctctaaaaagcctctctcaacagggataatagggtgagtggccttagtatcagtgtttggtttctttgcgatgtgtaattggttttagctagtgtggaatgtcctcttgattttaaattcctatttttagctcctctgtatattgtgttatgtgttcactgttgctccccacacccctccttgcaagtctatacagaagcatttcatgtggaaccggagctgttctagggaagcctgtcatcaaggctgccctttgctctgcacctccccagcaccctcagaggtcagagcgaggctggtgtacagggcagtggatgtgagagcttgaatttcttgccaccttgttacaagccaaagtaggaagaaagtgtatccagaccaggaaacatgatttgtaatcgtggttgcaaatctagcaccctaaacctagcacaccatttggcacatactcggctcttaaatgtccatttaatgcatgaatgactaagcagataagtgagtgagtggatacatatgtgtcttattgggagacggctcatgaactgacattcaccatgggcttttctaagtttttcagtgggatcaatgttggtagtttgtatatttgcacttggtttagaaaactttcctttacctaatcctcaggcgatactgtgaactttgggttgcttacttgataaatatagttttattattaattcatgcatttgaaataacacatgcattgaaagcagcagcaaatccttttaagctctgtgctcttttaaataggttctttctctcatgctcaggaaaaaattcagtggagatgatggcaacagactggtccctcaaatctctggccatagcccaaggaggagagaacccacaattgcaggccatatgtattgccctgtatgatcagtattaaactcaaagtatgtctttgtaactagagacatattctgggtagtgtggctgttagtttgtcccaatctttattttaaggcactatccacatctctttctcttttcctttgcccctaacattgatatcaactgagttttcagggtgccagctgcccatgtcagctctttgagagagcagcctctctcctccttctgcctctcaatcctttcctctccgccagctcttctcggcatgttggtcattcattattgatgaccctccagcaccttctccaccccggtgttcccatagccctgtgcactgctgagcagagccaggtgcaggatctagtcggggtccaggactgctgctccaaggccgccaagactctttcccttcctggctgtcagagaggatgcctggcactagagatacagcagcagcggcgtcagccgctggtcttgaggagggtttgtttctctcctctgtcttctaggaagcaaaaggttaaactgttcattttaagagcctccctgggtataaaatactgagctttgtctttctggagtgagccgattcctaggccccttgacctttgctccaacatgtctgctgcccatcccttagagtgtttttctttgctttctatttagtcagaaggaatgaggctagtgtctgccgttagcttaattattggggaaaagcgttggaagaaaagaaactgattctctccatttttctaattgttacttaaccaagtcttgacaagatacaatttggtggctaatatgcatggagtgccctttctgaaagcagaggctctgcttgtggattctgcagtgaaggctggagtcacaccttggaaatgactgtccaccttcacatttgcacacatcacttacacacatggagctccttccaccaccagcctcccctgagccttcataagacacaggctgctgctttaaggaacattaacaatccagacccttccagggacccatgtgactccagcttctcccacaatagtcagaaatcgtaattgagagttcagaattcataggtaccaggataatattgcagaaagataatcaggcacctacttcccagttccctgaaattaaaacaggtattcatcttgtcagaataagaaaacagggtcctgctgtgttccagccacctggcaaccttgttcttagaatacagaaagggagggaagcaatgtgtgcgatcactctagccgaagaatgtagagagaagcgaagaccatttttttagtcctaatttcctacaagggacaatgcacctaaagtttttcaagccttgctcagaatcatctcacaaaaggaaaggccctttgcttcacaaaatattttaatgaaagcaaaacagtgactaagagcctcatgtactgctggttctgcctgtttcaaatcttgaaaggcctttaataacctccattatgtgactatgtgatttttatcacacaatctcagattcttacattttttaaataactcaccagcaagaaccaatgtcagaactaaatgctaataagatttggcctgggagagtaacatagtaagattgttaatgtttaatgcactctcatcaaagtgggataatcctacggctgaaggttaagtgagccttttgtaaaaaaaaaaaataatagggaagaaaacattattgtagcttttccattttactcagtcaaatgaattcaacataaacttgttatagccaagcccaggctagacatttcctggtgatctggtaatttcccttgtattgttcatgtggtttgtctctttcctcttcctctttgtttctaatgatgatgatgaacagcatctctgcaataggccacattctcaaagtgctccattcattgtcacttgaaaagaccactgttgggttttattgccatcattgatatacaaggataatttacatacaaaattgtggtttggttttagagccatggcaaccagagtatcacttctgatgggaaaaggaagaatggccttcagtgatggagtaggcaattgcaaagagttctgctcccagttctcttgctaaatcaaaagattgcaagggtcaagatcgatttcttcattttctttaggcagcaatctgaagaggccccagcagaaaactccagccttaggatttctggtaatcagaaaaagaagcaactgttcttgggtaacatgtggtgcccataaaagggcatcagctcttgggggcagcctgaggttaccaggttcacctttgctcattctgcgcaaggatcgctcccctcagagtttctgcaggggaatgtgtactctggtgttcggtattaaagcttctacatgaatttatagagttgcttacattggctgagaaattgttttttttttttttttttggtactcagccctaattttccctggcaaatattgctctgtaactttgagatgaatgtacccatcaaaaactccagaagaaattctcatgcagttctattattgctcatcattttgccaaggaacgttagtaaagagagctatgaagtggctaaagaagttgtgttttttgtttgtgtgtttgtttttccttttcatcgttttatgtcttagtaggagaagaatccaagatgaaaaggacaggctctggttttagctttgccactaatttcgtgtgtttccttatgcaagtgtccagatcttcttgggaattaatttctttatttgtcaaagggagctaataatacctgccctggccaacctgtaacatagttatgcgtaggagtaaaatcacagatgtgaaagtttgcaaaattctaagatccttaggtagctcatgcgtcgacaggagtaatgaattatacacctaccgcaaaaggtgattgtggggatccagtgtcaaagggcttagaagagagtgtgacacataagtagcatttggggatggtagctggaagaccaagcagcaagggtgttaccatcaaatcccttccataacccctctcccatacaaagcaaaggggtctaaatagccccagtgctcacttcaatgctactcatattctttggctttggagactttgcttttttggagcccctcattcctactttccagacatttgcagaattcagctgtgctttctaagagattctctggcattaacacagaatgaccttgcagtgggaatgaccttggagctgcagcgacttgagtttaaattctagctctgccccttactagctgggtgggattgattccaggtaactgtcagtaccttgtgtctcaacatcttcagttggggatagcgtcctaccatctccctcatagaggagttaacgagttgaaatgacacagatgctacagtcaggagatgctacgtaattttctgggcccagtgcaaaatgaaaattcagggccccttgttcaagcatattaagcacttcaagatggcaacagcagagcatgaaaccaaggtctaggtcttctgagctcagggtcttgtgcaactgcataggtcacatgcccttgaagcccaccctggccactgatcccatagtggcagcttgccacttagtgggcactcagtagagaccgcttgcttttctttcttcctctttctctcttcttctcttgatagccttaaatccctgggagggggggcttgcatttactcttacacttcctgccacagtttctccccttatgatcgttccttctgctggttaaattgccgcttctcttttgcccctgaaatcagggagccaagtgattaagagaagctagcttatctacacgagcctcccatctctatgtctgtatttcccaagttctttcaaagataacccaataaaataaagaactaacagcatcatgatacatacaaaggggctatggtgtatgtgtggcaggctggggagtaaggatggagaaggtattttgaggcaaagaagaaagaacaaaggaaaatgaaggtattagaagataaaagcttgcacttcacagaagatattattttgctgccatgtatctaagcacaattgaggcagattagttgtaaaatcacctcatttacttttcccagcttttttcagccactttcactaaatcaaccaaccaaaccttttctgtgcccttatgtcccttgtctctgaacttcatcaactaaatatttgttatgcattattttattcagcattcacagtatctgtgggtttgggtatgctacttctttcttcattttatagagaaggagatgatagagtaaccgtccatagttactgtgttcattggaaatgttttgtctccaagtagcagaaagcccaacttacagtgtctgtgttcggggttggaagttggggagaggttcctcctaatgagatgcttggaggcagaccaccgcctcaggggttagacagctcactgacatcctggctcctgtctgctgctctcttggcttttccctcataatcacaagatggctgctgtgggtccaggcatcacaacatggtcaggagaagaagaaatgagggaagaaacagtatccagcctattgttgtcttttcttgggaaagttacactttctcaggcatccactggcttacagacttctacttatgtctcattggccagaactgtgggagtttctagctatagaaatggcggagaaggtgagtgtttagcttttcccgcctttttcctggttgggggagacagctctagagtgaagcacacaacagtatatactttatagtgacaaagatagcaaggggcaaagacagaacctgaacccaggtcctctaatcttgagtttagagattttgccattctgccacattgctcttcttttaaaaatactttcagcaacatccagcttgtccacttcctgctgagacaagccaacaggtataactccaagttatggaaatttaaaacaggaaatatgtttatactatgccttcccttaaggttcctgagagagaactttctacaagttatgtaaaacagagataatgtggcttatagaaaatttattcctcacatgataaattctgtgcatgtgaagtttcgtagaactcactgtagcgcatttagaaacacacgaccagaaattgtgtgaaacattgctttgggatggatggtgcccgtctgaccttaagctatccttcccccactctgctgctcttcaaaccacagccagtttattttttggtagaaactatttacgtatgaagatcgtatttggatgcctttagtaatttattaaactcactttcctaaagcaagatcagagtttaaaacatatgtaaatatcagctgagagattagaaacaaaagccaagaaggaatttctccactgcaattaccacatgcagttaccatggcagggaagctgtgcgggataattcagtccaaggtagagaaataacagagtctggaaatgtaaatatgtttctgttagagatacttgaaataacgtttacactggcttcttcctttttagctatgggatattgtgcaaaacttttttgttgtgttttctttaaatgctccgggcagtaaattggaagtatatagcacctgctacatgtttagtcagtagtcgaaacattgaataaatcatgaaatctgtaggtgaactgaataatagctgccctggagagaactgtaattcactgttgacaaaataaatccccctgcatttttctggggaatcttttatttttagcaagagtgtttgatactcctaagttaattagtagttttaacagagtggaatgttattgaacctaccagtgttgtttaagagctaatgtttatgtgccaggcgccagattaggtaattttataagcatagatcattacattctcgcccagccctgtagggttcctagctctgcttttccagatgaagagccaagacccttagaggttgtaactagtccagagccacatgggctaggaagaaaggaagacctttcaccacttatttacacaagtaagttcttcccaggcagtgtggcagactcagcagattggcccacttaactcttgttccacccccactctatcttgtctacttctaccacagaggccagaaaccacaaatccccagcctcctgtggcttggcttggggtagcccaaatacacagttctgtccaaccatgcataggcagaattccctggggaacatttctctctccccaagtaggtaaagcttctttgccctttaccgtttgttgttccttttcttccttcatggaaagaagagtcactttcaagacatgcagcaaccaccctctaacaatcagaaggaaatacatggttaagattgttgaaacaagaagtaaaagaagtcaagttgcttgacgatattctcttttgtctttttattttttttattttttaaattatactttaagttctagggtacatgtgcacaatgtgcaggtttgttacatatgtatacatgtgccatgttggtttgctgcacccattaattcatcatttacattaggtatttctcctaatgctatccctcccccatgcacccaccccacaacaggccccagtgtgtgatgttccccaccctgtgtccaagtgttctcatcattcgtgtcccacctatgagtgagaacatgcggtgtttggttttctgtccttgtgatagtttgctgagaatgatggtttccagcttcatccatgtccctacaaacggcatgaactcatccttttttatggctgcatagtattccatggtgtatatgtgccacattttcttaatccagtctatcattgatggacatttgggttggttccatgagcttgatgatattctcaaatagattccctagccctaggctgcctgccattgcattccttattacacaagaataatcatctcttattgtattccaatcattgattggcattattttttttctgcatagcaaaatacatggccaaatcagtaaacctgaacttctcaaagtggccatctggtagctactagcttataaactgttccctaggtatagagaattgaaagcaggtgaagtgtgtgtgtgtgtgtgtgtgtgtgtgtgtgtgtgtgtgtatttcacatatcactcaggtcaatgttcctttgaaaatggagaatgcaactctattaagataatagtgtaaatttggtaactgatcacttacagcaattacaacaaaagatgcaaaagtcaggcagaactgggttctaatgctggctgtagcactggttggttatgtgaccttgagctcattagttagccttgcacacatttcctcatatatgattgaggataagagtagttttatctcatagagatttgaggggcatttggcacaggatcaggcacaaagtaagcactcagtggtattgctgccaataataataacaataataataataatagaattatttaagacttgcagattgagggaatttgatgaaatatataacaactgaggttaaagtgttctaattttctgtctagattcatcttttatggtccctttttaatctcacaccagtgtccttccagaattaaaaggtcaatgattttacttcctagagaagcttccttaggggcttatgaatggtgaaaatgtgcacgtttgcctcgactctctatttccattgtcgaaggccttcgcaaatttacctagtgattctagccaagtgcttcctgacattcttaggggctcgaaggtcaatacttgatttggattttttgttgttgtttctttttccctccagcctcctgtgttgtgttgatttgtaaaatggccattgtaaatgttaaaatggaaagaaaaccgagtctgttataagctttgatgtagtaaaaacagcatggagcatcttaaattttaagatgtcatcagaaaagaagctcttcccagtttcctcttgaaaatcattgtattagtcagggttctctagagggacagaactaataggacagatatatatagaaaggggaggttattaagtagtattaacttacacgattacaaggtcccacaataggctgtctgcaagctgaggggcaaggaagccagtccaagtcccaaacgattttatttgacaaaagacaaaaacagaagttatttacaatagtttttgctcaaataattcagtgggggcaactgtacttttcctccaggtttatcttataaccaaacccaagcagaggctgccccaccccaacaccccattttacacagctgggaatgccaaccagaattcagcagcgtggctccctcacccctcaccaccctctattgctcagtgtacagtggggagggaaagatcccacctcagcccaagaacttggagctgaagaacttggaatctgatattcaagggcaggaagcatccagcacagtagaaagatgtaaggtgggaggctcagccagtctagccttttcacatttttctccctggtttacatgctggccatgctggcagctgatttgatggtgcccacccagattaaggatgggtctgcctttcccagctcactgacttgaacgttaatctcctttggccacaccctcacagacacacccaagatcaataatttgcaccctccaatccaatcaagttgacactcagtattagccctcacaatcataaaacagaaaaatgagtgaaaagcataaattttgctttcaaaaagctgggagattctatatccatgaaccacaatatatgacgtaaggctggccaaatgcagtggaacgaaagctcaggaagggctaagagacaatcactatgatcaggttatagattttgacaaagcaagcaaaaaacacgtctccaaaactggtacttcagagcaggcataccctaaaggatgacgccaataagcctttgtttggaaaatggcaagggtattgcaagactggaagtagaaaacctccctggaccctacctgctaccatgtagtagcaaatgaaactgaaagggaaatgcacagtcatcctgtgtgtataggaagcagtccattgttgtggcactacggcagcctgttggccgagaagaagcagtggctaaaataactcatcagcacacaaccctttgtaataagacttaacagtaaatcaggtaaatttttaccaactcacaacatcctgactcctatcccacaaaactgtcctctaaatatctgaatcaagaagtttccacattcagaggaaagtaacaataaaaaggaaccagcacaggatattgtaatatgccatacatgacactacaaagatattataatataaaaggagaaaaaactggaaaatagatggtaaatgcagaacactcactataggtgattccaacagacaaatcaaaagataacattaccatgatcttgacgacttaaagaaaccaccaaagagctcaaaacagaaataaagaggtcaggggtaatatggtgacgtgagaagagaagaaacatacactgatgtagctctccagagaactgaagggggaaatttttttttttttttttgagacggagtctcgccctgttgcccaggctggagtgcagtgacgtgatctcggctcactgcaacctccacctcccgggttcacgccattctcctgcctcagcctcccaagtagctgggactacaggggcacccaccaccatgcccggctaatttttttgtattttttagtagagatggggttttactatggtctcgatctcctgacctcatgatctgcctgcctcagcctcccaaagttctgggattacaggcgtgagccaccgcacccggcctgaagggggaaaatcatcacagatatgaagatgattttgaagcagccaaagtaaaatagacactagacactgccgaacatagaatagaggatatgatgggcaggattatcaaagcaaacaaaacggaaacaacagcttaaaagtattagaaagaaaatagtatatttgggtgacgaggaagatcccagagatacatcacaatatatccctgaagaagagaattaaacaaatgaaacataaacaaagatataattctacgtaactttcaataaataaaagatttgaatttatagattgaaggagtctactatgttacagaaaatttgctaaagaacaatcaatactactctgtattatagatgtattgatagatcttggagataagaatgatttggtcacaccagcaggaatatcaagtaacctatacaagaccacagtttaaaaaaaacctcaggctaacctaagccttccttacagcaacattccaagattgcagagagtaatgcccatgaagccctcagtgaaaaagtatgtggccttagagttttatgcacagccaaactgtcattcaaatgtaaaaacaataaataaaacgtgtccaacatttaagaacccagagaagatgattcccatgagttattctttaaaaaactattggctgggcgtggtggctaacacctgtaatcccaacactttgggagactgaggcaggtggatcacgaggtcgggagatcgagaccatcctggctaacatggtgaaaccacatctctaccaaaaaaattaaaaattagctgggcgtggtggcgggcacctgtagtcccagctacttgggaggctgaggcaggagaatggcgtgaacccgagaggcagagcttgcagtgagcagagatcacaccactacactccagcctgggcaatagagcaagactctgtctcaaaaaaataaataaaattaaaaaataaaaaataaaaaactattaaagactttatctaagagatgaatgaagaaaccatggcaaaaggattttcagtgaacactgagtctgttttgcttttagactgggtctaaataagtgcagaaacttttgttatagaaaaaaaaaactaagctctgaatgttcataaatattttaactaatataaggataaggtggaaggtggtatgtagattcattcatcatctcatttaaacatgataaatcaagtatatttaaatatacttagcatacttactaaagtatattagtaaattaatatatttactgaagtatattagtaaattaatatatttactaaatatactaagtatatttaaatatacaaaaataagtgtaggaatgaacatatatgttagtttgaaatatatatgtaatatataaggtacatgtttaatatgtaaacatataatatatattaaaccaatgtttagtgcctattaaccaaattcaagtgatagaaggaagagaaaataaagaacaatttgtattgcttttagtggaaagtaaaatgtcagtgtttcaagaaacagagaagttaaatagctaaataagggttagttacaaaggtgatcactggaaaaattaaccataatacaaacctgcccaaatagcacaaggaatactcacaaaaagaaaatatagaccaaagagtagaagatttttttaaaaaagcaatagaaacagaaatcaaaatactataaagtaagaccaaacctgtttctcatatcaacaaataaaagtgggctaaactcccatattaaaaaaaaagattctgaaatcgagtaataaagtaaaacttaaccatatgctataccccatatatacctaaagcaaagtgtctcgcaaacttgaaaatagaaggatgagcaaaggaatattatcaaatgccaacaaaaaggaaagtagaggccaataatcttagaataaaacaaggttgaatttagaacaaaaagcattaaacaagaaacataaagacaattgtgtgataagatgtatcattcacaaggaagatctaatagtcattaagtgtttctgtatcaacgtagcctgaaaagttaagcaaaaactaccaaaaagataaggaaaaatagaaagactttaattataggaggcttaacagacaaaatagacccaaaagatgacatagatggcctaaataacataagtaagtagtaaagttacatatatcaatctatccctgaaaactaaaaatatgtcatcctttcagatgtccataaaacgtttcccagaactgactatactttagaccacacagaaaacctaaataaactccccaaatcagaaatcacactgatattgtcctctaatcactatgagtcaaaaaggaatccatgtgaatgtatagaatatttaaaattaatgataatgattataaccacattacatatcctatgggctcaactaaagcatttgctcaaaagaaaatttgtatacgtaagtacttaaattaatgaacaaaaaataaaggaaatcagtgcatatgtcttctactcacgaaattaaatataagaaaaataaagttaacctcaggaaaatataaggtagctatgataataaaagcagaaaataggaaaaaagaataaatctttaagttagctctttatgaaaaatcaataaatcattagtaaacaaaccaaaatggttgccaataagttattttctaggaaaatataaaattaccaggcatgaccccagatggagagaaaacaacaatctaaggaaatgaattagtatagaagaaatacagaatgtggagaaaaagcaaacctcttgaaagaaaacaccagtcctggaatatttcacagattacttctaccaaacctataaggaaaaaataggtccaatattatttaaaccaagtgaaagcatccaggttatttttctgaagctagcatgcatcatgcatattctgataaatagagcacacaaaaaagcaaactaaggaccaatattgcttatgaatatcagtgtaaataatcctaattaaaatattagaaaacaaatctaagagctcacaaagacaagaatttgctatgttcaaatgggatttagtcttaaaaaagtaagactatttcaaaattcacaactgtattaatttaattcataaaatattgtcaaaattaagaatcactttatcatctccataaatacttgaacaggtgtttgataaaattctctaatcttgatgaaaaactcataataaaatgctattttattatacagacagagacatacacacatacatataccaatacatacttagtaacatggtcccaaagctactgatacaactgctgaagaaagtgtcattaatgtcggctacaaggaaagataccttaatcaatagcattaattaacattattgctccagagagcctagctagcctaagtaaacaaaagaaaaaaataagcagagtaattttaaccaggagttaaaattatcatatatgcagatgatatgattatgtactgtaaaacacaaagaatcacatggaaaaaatagtataaacaataaggaaatacacttaggtgattgagtacaaaaatactactcatgttaatctttccacaaacagaaactggttagaaaatataactgaagagatcccatttacaataagaataaatttaacaagaaatgtgcccaaattacacaaataaaatttttaaatgctactgagaaacatgaaaaatgacttaaacaaatggaaaggcatactctgtttaacataaagatgtcttatctaaattaagttatacaggtaatgcaatgcaataaaaaaaaaaacaatagaatctacaggggtagattctaaagttcaagaacaaataaggaagcccaacccaaaagtttctgacaaaggaaaattaagaaagggggattagccctatcaaatattaaaatgtattgtagtccgggtacctgaggtcaggagttcgtgacctgcctggccaatatggtaaaaccctgtctctactaaatatacaaatattagctgggtgtggtagtgggcacctgtaatcccagctacttgggaggcttaggcaggagaattgcttgaacctgggaggcggaggttgcagtgagcccagcggcgccactgcactccagcctgggtgacagagtgagactccatctcaaaaaaaaaaaaaaaaaaaaaaaaaaaaaaaaaaaaaaaaactattgtaaaactacagaagttaaaatatatatgtctccatatctttttttatttttaatttttatggccacatagtaggtgtatatatttatggggtacttgagatattttgatacagacatacaatatgtaatcatcacattagggtaaatagagtatccatcacttcaagcactcattacctctttgtgttacaaacattccaactgtactctctcgttattctaaaatgtattacaaattgtcactgactgcagtcaccctgttgtgctatcaaatactagatattattcatttatatctctatatcctaacaaccaggaagctctatgtaagtgtctagaaatagaccaaactacatatgacaaattttttatttacatatcaataaaaaaatcagtctattcaaaaatgttattgaaacaactgaatacctctttagaaaaaaattaacaagcacaaacaccataaacaaaatcagaaaatgatatactgagaaaaatcatttacaaaggactattcttttttttttaatttaagttctagggtacatgtgcacaacgtgcatgtttgttacatatgtatacatgtgccatgttggtgtgctgcacacattaactcgccatttacattaggtatatctcctaatgctatccctcccccatccccctaccccacaacaggcccagtgtgtgatgttccccaccctgtgtccaagtgtactcattgttcaattcccacctatgagtgagaacatgcggtgtttggttttctgtccttgcgatagtttgctgagaatgatggtttccagcttcatccatgtccctacaaaggacatgaactcatccttttttatggctgcatagtattccatggtgtatatgtgccacattttcttaatccagtctatcatggatggacatttgggttggttccaagtctttgctattgtgaatagtgccgcaataaacatacgtgtgcatgtgtctttatagcagcatgatttataatcctttgggtatatatccagtaatgggatggctgggtcaaatggtatttctagttctagatccttgaggaattaccacactgtcttccacaatggctgaactagtttacagccccacaaacagtgtaaaagtgttcctatttctccacatgctctccagcacctgttgttccctgactttttaatggtcgccattttaactggtgtgagatggtatctcattgtggttttgatttgcatttctctgatggccagtgatgatgagcattttttcatgtgtgttggctgcataaatgtcttctttcgagaagtatctgttcatatccttcacccactttttgatgggttgtttgattttttcttgtaaatttgtttaagttctttgtagattctggatattagccctttgtcagatgggtacattgcaaacgttttctcccattctgtatgttgcctgttcactctgatggtagtttcttttactgtgcagaagctctttagtttaattagatcccatttctcaattttggcttttgttgccgttgcttttggtgttttagtcatgaagtccttgcccatgcctatgtcctgaatggtattgcctaggttttcttctagggtttttttggttttaggtcttacatttaagtctttaatccgtcttgaattaatttttgtataaggtgtgaggaagggatccagtttcagctttctacatatggctagccagttttcccagcaccatctattaaatagagaatcctttccccatttcttatttttgtcagttttgacaaaggactattcttcttaacatgttaaaaatctcttgaataaaattaaaaaacaacccagtggaaatagatagggcaaataatataaataggtacttcccaaaaagaaagaaacatgatgtaaaccattgaaaaaatgcacagtctcactcacaataaatgtatattaagactactgagagatgctgatttaaaaaaaaaagcctgccagatttcacattgacaaggatcaaaaagtttaatcacacattgttggcaacactgtagggaaataaggtaccctcatacatctttggtggacccatgaattggtacaatgttgattaggagcaaattgccagtatttatcatgcaacttgcatgtatctcctgactcagaaatttcacttctaggaattcctcctacattacacttgtgcaattgtgtgtacttgcacttgtgtgaatgatgtatgtacatgaatatgctttgtcatattgtttgtgagaaccaaagattacaaaccaccaaatgctggccaatatacattcattaccacaaaggtctggtcaatttagagaaagaaatcctatgtccacgaaggatataatctctaagaaaacaaagtgctgacagcatcatagagtatgttaccattattgtaaaatggcaatagtaataattattatataaatatatgcttgtgtatgaataaaatgccctgaaagtatactgatagagtttggatatttgtccctgcgcaaatcacatgatgaaatgtaattcccagtgttggaggtgtttgggtcatgggggcagaccccttatgtcttggtgctgtccttgcaatagtgagtgagtgctcacaagatctggttgtttaagtgtgtggtaccacacactcctccttgcttctgctcctaccacatgaaatacctgctacccgtttgccttctgcggtgactgtaagcttcctgaggcctccccagaagcagatgccagcactgtgcttcctgtacagcctgaagaaccatgaaccagttaaacctcttttcttataaatcacccagtctcaggtatttttttctttcttttgagatggagtctcgctctgtcccccagactggagtgcagtgacgtgatcttggttcggctcactgcaagctccacctcccgggctcacgccattgtcctgcctcagcctgccgagtcgctgggactacaggcgcccgccaccatgcccggctaattttttgtatttttaatagagatggggtttcactgtgttagccaggatggtctcaatctcctgacctcgtgatctgcccacctcggcctcccaaagtgctgggattacaggtgtgagccgttgcgcccggccaggtatttctttatagcaatgaaagagtggcctaacacgtatacattagaacctgattacagtagatgcctcttgggaggggacttaaatggccagggttggtgataaaaagtattttttaatgtatccccttttttatctgttaatttttttatgtgtatatgtattacctattcaaaaagttaatcaattttaaattaacttagatcccaattcaaactccacatctgctacctccagctttgtgacctagagcaaactgcaggccagctgccttctctgtggagcagggactgtcagaactcccccatcccagggtgtgatcagagctacatgagataatcatgggaaagtacctggaaattacatgtaattgcttagtaaatgccctccgcttctttccccccagaattaaagtaagctgcatctaactattacaacttaataaggtgcattattgtgctttgctgtgtttttaattttcttgtcatacctgaatggtttaaacatctggcttccttaaggcataattaagtaaaagagagagcagcgtacatcaccagtcaggtgtacttctttccctgttgtaaaagtgatgctttttattcagagccaagtctagatattcaccagtccttggcacgactagaaaaagatttgaaggactaaagctgctagagcataattatgtattggctgtggacttgagatgcctgggttctgtccctcctgactgtgacttagcagccgtttgtcactggagatgttttatgacttctgcaggcttccacagtatcacttgtgaaatgggaataactatttaatagctcacagaggtgctgtattaggttctccagagaaacagaataggatttacgttatatataacaataggatatagcctagatatatagatatatatatataaggatttattgtgggaatttgttcacgtgtttgtagaggctgagaagtgccacatatgccatctccaagctagagaagcaggaaagccagtggtaaaattcagcatgagtccacaggcccaagaaccagcagctctgatgtcccagggcaggagaaaagctggatgtcccaggtcaagggaaggagggaatttacccctcctccttctttttgttctatctgaaccctcaatggattggaagatgcttgcccacaccagtgagggtaatctttactcaatctactgattcaaatgctgttctctttcagaaacacactcacagtcatacccagaaataatgttttaccagctatctgggcaccccataacccagtcaagttgacacataaaattaaccatcacagacactgactagaatgcataaagtccatctagaaaagcacccagtacataataagcactcaacaaatatttttggaaaagtatcaaacactctgtgcaaggagcaagaaatggttcctactttcacggtctacacaaattaatagggagatgaaacaatggcccaaatcactagatcaccaagccatttaggagaagaaactgaagtgaagggggtaggcatgactcataaagagtaatttcctttccctctctaaggccccaccagtgaactggtggccacgttgactaactggagacaggataccaaggaggacagacatcattgtgaggtcccattctacgtaccccaaaccaacagagtcctctggaaggcctgagagctgttaggaacaagacgaaatgggtgtgagattgaagaagtcacaaaatgcagacattttaagctattctcccaaaatacattaaaaatcttactgagaaaaatgtgaaatatatacaatactcacttgcatatactatttcttattttattttatttatttattttttgagacagagtttcactgttgttgcccaggctagagtgcaatggcacgatcttggctcactgcaacctctgccaccctagttcaagcgattctcctgcttcatcctcccaaattgctgggattacaggtgcccaccaccacacctggctaattttttatattttttagtagagatggcgtttcaccatgttggtcaggctggtctcaaactcttgacctcaggtgatccacccacctcagcctcccaaagtgctgggattacaggcgtgagccactgtgcccaaccaacactatttgttattttagatgttgggaagttttcatgaaaattctcttgtccattctcatttacatgcacacacatacatatgcacatgcatgaacacatgcttcacggcgcttcttattaatccttattgggtaaaatcttattgagggacaataaaccagataaaatctccaaccactccctggtgccaagtctcttgggcccctcacactccaggtgggcaaggcagcatgccagtggacacagcatcacctgctcagagggagtggttgtggaaagcacagaggcaggcggcctggtggccaaggtccacaccacatcctcccaggtgggcactgtcctgagtaggcttaaactggcattgtctgtccagtaagtccttttctaaggaaagcaggtatcaactaattagcaacatgcaagtgttttcattttaggaaaagagaagaactctggaattatggggcctggtaaaggttcatttaagcgtcaagatcaagttggctaaacccatagtgtggaagcactctttgcgtagggtgagccaggtggagcagctgtgtgacagatcttggaggcagtctaagggcaatgagcacctggagaacaaagagggaggggctgcccacctgaggaggaagggacatgtgcaactgtctcctagatggggccctgagaactgccgggagacatcacagggcagcccctctccccacctctggctacacagtctcctgcccttctctactcagtgaattctgaggtcaaaggctactgtgccaaactttcaagtagagtgaagcctcctccgtggtgaactataaacttggatggcatcatgtccatttttgtgttcttcacagcacccaacagcaggttcacagtcaacgttagtgagggaccgagattgtagaagcaaatatttctccagcatcaggggtgttgcctcactaggatctaccattgggatcccaacccaggatgatggtttgaaaccttccggtccagttctcccccatttgtcagtctttgtccttgacaattaatgctgtaaatgcatgtactaaatgcccactgagtgtgtgtaacacacaagccggtgatatcagagtggcaccggacagggagcaacacttctgcaaaggagcaggtattccaagtccttctcatctttcctgagcatctgtcatttgggtggacctcactgcacccttcagctattagcagtgactgtaaatggagaagaagttctcgagaaccagcagcaccctgaacactcattaactgagaaaaattggagactcaaggaggcccaataccctcttactgaatacccaccttccttgtgccagggaggtcatagggaggttgaaaaatcaagggttttgccatgtgtctgagtttgattcctccaaaagggcattaacttttcatattacctctgcagagtgggatttaaaatctgtgttagtgacacgatatttcatttcagatccacagggcccacatttaaaattaatattgcatgcttgtcagaatgaattccaaaccctctcacagcaggccccttgtgggacctagagaaggagtggccaattcattatcgtaacactgggatgagggttccatcccagcttttgactgacacctgcagagattttttttttctgagacattttaagtttttggtgtgccccatcttcccagacaagctgcacgtttctgtcactctgtgctgtttccaaagcccagtggtctgcagggtacctttgaggggcctcctctgatccagttaatcagttcctcattgacaacatagacagagcatctggcccaggccagagagggctttcggccgagtccctctggaggatcagtctgtagagggatgtgactaaggcagcagattccgccaggattctgttagacacagaggacacaaggtcacctggccaaaagtggaggtcaggaagactcaagatctgggtccacctgtttcattttctcttagcatctgccctggcctgctgtcgtaaatcatcatcaccgagcttaaaaccaccctgtcgttcaaaaaaaaaaaaaaaaaatgagctatttggtttttgaacactttccttacagtgcgtagcagtttgttagagaggtgggcaggcattaggattttgtttataaccttggaataaactaagccaacagactgtattcttgcagggttaatgtcccctgctttacagtatgggaatgcccaacgaagtttttattatagagggtggaatatggtgcagtattcagtggagacaattgccccgggagtgcagcgcagaaagccacagctgcatctccacttggtgtcggccgggagctgcctcacctggggctccagggtccctttgagaccgcagttccatagcccgtgggtactgtccttgtgtcatcatcctctctctctctctctccattccagtcattcactctctccccctctttttctctgactgcctccaggcactttctttagcacagagctctggtgatacctcccactggccttgggcacccttcttcaaggccactcaccctgcatggaggagaggaagggaaggagtggccaattcattttcgtaacaaacacccaattttgtttttctccgtggactatccagatgcatgcttcttttacagttcatgtctgcgatactttgtcccttagagaaaaaagctgtatacaaatgtgaaattattccaattatctaatctctgttgcattcctcagccctgcaaagagttaaatgatgtgtaaaatcacctgttagcccgcattagacagggctgtatttacacacccagaggtggcctgtgaattatttaaccgaagggactcttggctcagcatctggctagacactgttgagcccaagttccttaggaggtgcagcctgtggccccagagcttcctcttggctggggaaaccgtctgacagacacggtgggctgctgccagaaccaggtctccttgagaacaacttgaactaagctcctcccagctccagatggttcacaaactagagaggagttttgcagagtcctgaacgctttgccaaaaaagagcgttggccatcttccaggccaggcggtaggtttgcctgcatgctgtgaatgccaggattattgttggggttttagagagtccatttcataacacccccagttcccatctgaatttggaaccaatgagagaaaaagggaaagcagtgagatggatggagatcaaaacatcacttttgtcaccaactgacctctcagagaacagggggagagtgacactggatgtcccaactaggaaccccagagtagagacacacttccatgaccagtgctggaaacccatctgcctcatgccaggaggcaggatcttgggtccctgtaccctggtgcagggaacggaaaggagccataccttctgcaagcacccagctcctcacaggaagccagggccaattcttccacctctccttgtctcatctcacttttcaggtgagcttcctttctctcctaccaaggagagggtgggggctgtggcaagagatggaggcatctggggaaaagccttcctcggggaaaacagcattccatatatctcccagggagatgggacctgcatatatttggaggaagaagtcatagagattgcaagagctggagaggattttagaagccactggaatcctctcattttactgaaggaaacagaggcacacgggtgcagcgaaaccctcatggttatatagctagtcaggggcagggctgaatttgtgtggcagtctgcagtttaaagccggtccctcatggtatggagaacacagcagtgggcatttcacacgcataatctcaccacagggggccaggctgcctcttggtctatgggactccaccccactgtgggtttcagggcaggttcccactcctacctcatctatcccttcttgggaatgggagatgcttggaggatgcacagtaattgaaatgctattcctggcaaatgatcatttccgggggaaaatgtgaatatcatgatatcaagtcaaataaagctgttaggttgaggctttgtccttgagctttttagactctgaacaggcagttgggaaggcagtcagctcctgcctgagtcactgggcaggacagccagcccagggaaagatgagggaagtgggggacctgcgttggtatctcactgggaggatgctgtggcctccccattcgatggagatccttgtcaggcctgcttttgcaaatgctcagaactccaggcagctctctggccctcttctttctgtcctctccatgcagctcccactgctgtatttactcggttggcactttccgctgtcagaatcacatttctcccagccactcactgtgttgcagaatctgtgtattgtcttttcttcagctggtgttttgggcttaagccctgaaatgctttgttctgggccccactacagcacccatactgtgtgctagagaaaacaggaaagggccctcaccatcacacccatgaccttggggaggccagcacctttgttgtcatacttcccaaaaccctccatcccctccctgccagaggagctagcacaatctagatgcccactggctgaggtttatttccagcactgcaaggtaacaggtacacacatacgcacaccagatttccattcccattaaatctctgcatccccaaatgagctacctgttggcaaaagctttttatctgtcagaagttctcaagtggaagttgtctctctctctttgctgcacgtgtgttaccacaaatgcggattgtgccggcctttctccatctcacccacaacctccccttaaacctccatctccaacacccccgagtcttcaatgcctcaggagaattctgaagccagcatataattgctgtccagaaagaggccccgtgggaacggaaaggattttgtgtgtgctcacccctacatttaatggggccatccttccccataaggctcagtgctgcaaagccaggagcccacccccaaggctcatgccaaaccccaattatctggagggcaactggccctgggagctgggccaagcacagcccctcctagctgcggaaagagccttcctatatgtctcgtttgacgcctacaaaaacctggggaagctggcagggcagggggtggggaggttaagcccatagggtggacaagccacagggctctgctccctcccttccccctcatttcttcacccctcccccatgaaaccatcaatcaccttgatggcaggagggaggggtgcttggctgaattgacttgaaaacactcagaaacccaaattgcacccacagaggcactcagaattcagggagatgagggatgtccgcctgaaacacttttttgcagtaatgtgttccgtgatggaagtcatctaattcattcatgaggggactgagacctcagaggaaagtggtgtccctgaaactagcaagggtcagaactacttgcagagaagccactaggaaggctttccagatgagactctccccctactcccactaatattagagggactcccctccctccagcatctccccacagggtctggctgcctcaggcttcccttggctctcagagatgcccttccactcaactgctacccacatgcttctacctgctgcacacaccctttctgtctgcagcctctgatatggtttggctgtgtccacacccaaatctcatcttgaattgtacctcctataattcccttgtgtcgtgaaagggacccagtgggaggtaattgaatcatgggggggcaggtctttcctgtactgttctcatgatagtgaataagtcttaggaggtcttctgcacaagctctctcttgcctgccaccatgtgactttgctcctcgttcgccttcctccatgattgtgaggcttccccagccatatggaactgtgagtcaattaaacctctttcttttgtaaattatccagtctcaggtaggtctttcttagcagcgtgagaacagactaatacagcccctcccctaggctttccctccttagagttcatgttgcagaccacttttccttccttctccgctactgactgcccccatccctgtttgtccagggttctcctgttttctgggttccctgatgagagttagttccttttagggactaattcgtcctagggaggactagattaatagactaccaagtcccctttccaaactgacttgcattttaagatggaaaagtgactcccagggacagggcattggctcaacaggtgcttctacagcttggccgtgacagcctgtctctacatagaaagggccaggggctgcagtctttgcttggagctgtgtttgtagaacaagcacactgtttttaacgtggtttatggttttgtttaaatcaggagtgtcgaatcttttgtattccctgggccacaatggaagaagaagaattgtcttgggccacacataaaatatactaacactaatgacagctgatgagcttaatgttttaagaatgtttacaaacttgtattgggccacatgtggcctgtgggccactggctggacaagctcggtttaaattgataagatattcgggaagaagatctaatcactctcctgccagcctctaccctgctgctaaaatgctttcacaggatctaggtcactggctttgataatcaccacagcttgtggatgtcctcctaagtctagtgccggaagggaactcggtattcctcagtgtgaactggaagcagatgaaggaactccacctctcactcaggtcatcatgtttctgttaatgcatcctgagatcaaattcacctttttcttttgctgccatattatattacaatttttcagttgacttaattgcaaagtatcttctatttgggctactgagtcacttatctctcaaattgtgtgttgttctaactatatatctatgccataagtataagggtttacatttattccttactttatgtcatcttaaaacaaatgaaagactactctaatcatgccacttctcactcctgattctagaaaacagtgtctttcttgaccctcctagttttaaatctggactatgaatctggcattcattcttatcccctaacattagacagagtattggctttcagaaagctaagctttgaagtactatatgttgtgtggcttactggagatcagacaatatgcaagaagtcaaattagttagtttggctcatggaaagctgtctaatttggaaataattaggtgtcatctcctgagagagagagagagagagagagcgcgcatagggagaggcagtggggaagaggaagagagagaggacagaaagggaagatgagagaaaatagttttcattacatgttaagcagaaagagttggaaaaaaataatttctatgatctgcaaagtcatttcaggagtacattagcttgctagggctgccatagttaagtatcacaaagtgggtgggctaagtaacagacaattattaactacagttctggagaccagaagtctacgatcaagacagggttggttccttctcggggctgccaggaaaggatctgttcccagcctctctctctggcctgtagatgactttgccccctgtgtttcttcacagtatcttccctctgtgtgtgcctgtctgtgtctaaatttcccctttttataaggacatcagtcattttggattaagatccacactaacaacctcattttaactcgattacctctgtaaaggccctatttccaaatgagatcacattctgaggtactgaaagttaggacttcaatgtctcgatttggagtggggcacaattcagtccataacaaggggattcccaaagagttgtcataggaatatcacccatcaggcaaagctcctggaagcagatggagccaccattaggaaagtttcccatgagactgtggtgcttctgatgtggctcagctctggaactgactcccacccccatcacccatttcaacctctaacccccaccacctaaccaacaccccctcccctgtaaaagcctttcttcttaagtcaggggtaaactttccacattattatggtccgtgtttccaatgcagtggtttctcagatctgcatcgctcctctctacctcctggttccctgcaactccttaacccacaagcagaggaaggagaagagaaggaccctattgtttagagcagaggtgctgggttctccctctacttacaaccttgccctctctcatttctcctgatgaccaggtagggtagacagcaacatccccatccaaacatgagcagtgaggtgacctggccggttcgatgagtggtaggcagcacagccacaggccatctccctcctaaatggggctgggcccaggggttttcctaggccctgcctgactatgctgcaggctctgccttacacttgctcatcctcctgttgcagaagagctacagggagacaagctacaaaaaccttttaatctgtatgattaacagaagcaattggcaaatgaccctgctgctctcccaaggggaataaggggtttattttcagatgctggtatttatcccactgaatttcattgtgcagcctacagtccatcaaatgcttcccagagtcacccagggtttcttcttagattaaaatcagaattaaatcagatagatacatgctttatcaaatctcattttcttggggatgaaaaataagtttctctttcagtctgtgatttcaggaacaggaagcaaagaatttggaagtttaaaaacacctttgcctgagcctgcatagcttattttttctccaggcagatatgggcctccccttgacaaggtgctacctgtaggcaggaaagtcctgctgcttgtcctgccatgtaatggaacttgggccataaggtggataaagataaggctgctctgagaagctgtattagttttcacaatgctgataaagacatacccaagactgggtaatttataaagaaaaagaggtttaacagactcacggttccacgtggttggggaggcctcacaatcatggcagaaggcgaaaggcacatcttacatggtggcaggcaagagaaaatgagagccaagagagtgagagccaagcaaaagaggaaacccctttaaaataatcagatctcaggagacttattcactaccatgagaacagtaggggggaaacccatgattcaattatctctccactaggtcctcccgtaacatgtgggaattaagggagatacacttcaagataagatttgggtggggacacagccaaaccatatcagaagcacagaattagtgcagagttggttaatgaaataatcattttctacataggtaggggagttaaatgatcatattttgccttttaagagtatcatataggaactcttacaaacctatacaaactggggcttgttatgtgagaagtgacgttggtgatacctgcttggaaagcataggtctccaatcccagctgctgtcctctgggagctgcacaaaagaaggtctatcacatgcttctgaagggagctgtagaagcttctgtggttattcatttgctacagatagaagaagaaattaaaaccaattgtgaaggaaagggaaatgaacattattgaggagtgagtaactgtgtggcaggcactgccctgagagattttgcctgcatgctcacctaaattttagaaataggactagctttaaaaaaataaaaaataaatttgagaaataaactattatcctttagaattgataaaaagtagttcatggatattagagatattttggtaaatatcactgtaaagcataaagaaaagaataaaaagtacccatttgctatgatcagaatgttgtgtcccaccaaaattcatatgttgaaacccagcccccaatgtgatactgttaaggggtggggcccttggaggtgattaggtcattagtgttctacctccatgaatgagattagatttgaggaagcctgtttggctctgctggcttatcaggacacatggaaagtgccgtttaagaaagcagaacaagccctcaccagacaccaaatctgtcagtgacttgatcttgaacttaccagcctcctgaactgtgagtaataaatttctattgtttataagttaccccggcaaagatattttgctgatagtagtccaaaagaactaaagaactaaaatgccattgtaccttagcccattctgttgaatcctttggtggctggattgaagagctgggcagtggagagaccagccaatttagaaagactagggggtgcctggtcatgctgccttctatgtaaagagtgggaagtggggcaatgcagaggacattttttggtgcaggaacaccatgaggggaaggactccaagtcttcagatgagatgatggtctctgggcagtcagttacagagcaggaacagcactctgatgtcacttggaaaggcactcatgaaagcagcagagcctgagctggtgtgttcggaggcagcattaaaaatcagcaggaaaggcatgagacatgaaaccaaaaaagggatctttgctgctgggtctcaggcaacacaaggaagaggtttgtcctgggaccccctgtgaggttctaggacctcaggtgctgttgggatcaggcaggaatttcctgaagtcagccttgtggttgcacctccttctttgcggccctcctggggactgttcttcttttttagactcatttaaaatcctcaaggggcccctctgctataagaaagcaccaagggaagggccctgcctttccagtttcccagcacctagcatgcagtgagtgctcaaatataatttatatttggaatgagtgatgattctctctgcttcccctttgggactgaccttgatgctcatttctacctgattttgcttataaattgtgaggagagttctctacactacaatttatctcagtatccctccccagctggtggctctcatgtgctcactggagcagtctgggacatcaaacatgaacaatgacatagtgaaagaagaaaatgcctggggaagataatggcactatctggagcagggagcctgccatctaaggaaatggtaaaaagaaggaggctccttagggcaggtttcaaggggccagaggaagccccaaatgcgtagaatcacagccaggtgctcaggaggggcagcagaagcagccctcaggacgaagggtagtggtcatcgtgcaaggcagacaagggccctagggtgcaggcaggctgggaagatctccagagaatgaggtgggccatctgggggcatcactttgacctgtagacaaagtgaagggagaggggagggtctggtgatgacagcctcagatgcagactctttaagccttctcaaggctttccagtttttgcagctgctgaggaaacttcattctcacccttcttgttccatctgaaaatgcacttctctccagagctctgggagactgtgaaaggctctctcattgccctgaaatatttttttaaggaatgagtatgatcttttctattctctacttctgtcccatgcagagcagatgtagaggaccaggagtgattcagagatgagaactgaatcttccctccagaaagttatgttccagagggaaagaagcggaacttcagtaacagagaatatgaaattggtcctaagtagaggtatgtggctctcgtgactggagcagagggagaaagacttgattcaggttcttgcctcgcagccttggaatgggaaaaaggaataaaaaatatagaacatgggtattagttcattctcacactactataaagacatagctgggaatgtgttatttataaagaaaagaggtttaattgacttgcagttccacaggccgtacaggaagcatggctggggaggcctcaggaaacttacagtcatagtggaaggcaaagaggacgaagtcatgtcttacatatctgcagaaggaggaaaagagcacaaagatggaagtgctacacacttttaaacaaccagatttcatgaaaactgactcactttcatgagaacagcaaaggggaggtctgccttcatgattcactcacctcccacgaggcctctgctctaacactggggattacaattcaacatgagatttgggtggggacacagggccaaaccatagtaacatgtataatacatatgtatgcaagtactggaatatcaagtttcctggaggaagtagcttttgagcagggcctagaagcatgccaaggatttggatgtgtttgttgtgggtggatgaagtccatgaccagcaagcagactcaggagagttttgcagataagtgtgtccagaagcaaaacaggctgggaggagtggtggtgctggaaaggtggcagatgccgaatgatggaggaccttgaattccatagtagggaatttggcatttattttgtagctgtgggaagccatagcagtttttcaccaaagagataatttacatcaattattccaagccctcagattcactccagttgctagttcagttgtttggttcaaggaagcgtcagaaaggaaatgaaccagaaaggatgagtgatcctagagtccagggtgtccttggggtcagagggaggacaaggccttatgttccctgccttttccaggaggaagaaattgtagtaatattccaggacactggatggacttgtttttctttggaaacaaggttattgacctctctgccgcagtaagagaaaaatgatatatatgttagaacttgaatatttttgtagaaacttaatattaaaggccttatgttcaaatatgcagcatttcacagtgctggttgaattatttgggctaggttgccacatggtgttccatgtacaattctccttggtaggctgggttaaaaaatgtggctaggtaaaatgtgagatgagaaataaaaaaggatctttgttttttcatgcttgtgatacttaaataggctactgtgacccaattaagaagctcccagaggccaggtgtggtagcttatgcctgtaatcccagcactttgggaggccaaggcaggcagatcacttgagttcaggagtttgagaccagcctggccatcatggcgaaactccatatctcccaaaaatacaaaacttagtcgggcatggtggcacacacatgtaatcccagctacttggaaagctgaggcaggagaactgcttgaacccaggaggttgcagtgagccaagatcaggccactgtactctagcctgggtgacaaagtgagactgagactctgtcttaaaaaaaaaaaaaaactatccaggcgtggtggtggatgcctgtaatcccagctacttgggatgctgaggtgggagaattgcttgtacatgggaggtgaaagttgcagtgagccgaggtcaggccactgcactctagcctgtgcaacagaggctttgtctcaaaaaaaaaaaaaaaaaaaaaaaaagttcccagaaataacctctaagccacccatctaattggtcccagagagatcaaaaaaaatgcagcattgaaaatggcgtggaggcaatgacttagggtttatagacaggcatcttccctgtcgtcatccctgacatcttccccaagtgggctaccacaggtcctaggtgatgactggttaggccatgaagctgttcagagggacagagagctgcagagtttggggaaatccaccccctgcttccccagaaggagaagatgcatactaatctgttttggagacaatgcagaatactgattagccaaatatttgctggtgatggggatcactgtgtgtattcgttttctattgctgctataacaaattaccatacacttaatggtttagaacaacataaatccattcattatcttatagttctgaaggtcaggaatctgaaaagatctcactgggctaaaatcaagttgctagcaggactgtgtttctttctggaggctctaagggataatcttttttcttgccttttccagcttccaggagctgcctgcattccttggcttgtggccccttcctctattttcaaaatcagtaaagtcccatctatctgaccccttttccatcatcacatctgtctctaaccaactatagctgggaaaggtcttctgctttcaaggacccatgtgattcactgagcatacctggataaccagggtcatctcccatcttaagatccttagccttaatcacatctacaaagtcccttttgccatgtgaagtcacatattcacagattccagggattaggacatggatctcttttgggggaacatttttctgccttctatagtgtgtattaaactttgatgcttatggcatggccccgttttcgtatcttcttccactcagctaaagccttaggtgagcccgggccaccctggcagctgccctggccagctgatgtggtgatccatggagccagctctggttcatgccaataatctcatttatccagcagtctcacttggccttgaacaatttaccgttcccaaatatcagcatgtttttctgtaaaggagtgatggttcccaacaagaagaggttgacacactcaaattcaggtaatttgaggagattagaataaaaggattttaggtcttctgcggttgctagaatatttcattggccagtatctattgtcctcatccgcactgttgctggccatctgcggtcagagattcctcagtccagggcctgaccaaaaggacttgctccacttacattgcaaagcaaacaacagattcttaaacaagaaagatgatgccttctaaagcttggctattccagccaagctcaggggaaagacattttccctaaagtatcaacaagccatttgatctcagacttagaaggtcattcttgtctgcttttttctcccattagatgaaagaaaatgaaatgttttccgtaaaagtaatttatgaagcactccatatggcaatattaaaactgtaaaagtaagcctccaggggacaaaacaaataatgctgtgtcatccgtctgccctggtactgtccctgggtaatgtcaggcacagaacgttggggaactggctccccactcaactggtacttggatgcctttggagcttttccttgaacattgttgctaaggttcatgaaatcttcagatttttgttatggaatccattcgcaaagcaaaatgatcttaagtgtaaatactaaatttactgtaaattgcagacatcactacctccaagacccttttaatatattgagtcccactgaatgctggaatccaagataaagttctttaagaatatagcactcatgtcattcatgtattcattcgttcattgatgcagtcattcaagaaatatttactgagtacctattaggattcagtggtgagcaaaccactctaatgggtgatacaaatgcaaattagagcgatcgttgatatggagaaaagatagagggtttaataagagcttataacaggataagcactgggacaccatggacagattttaggtaggggagttaaatggtcatattttcccttttaagagtatcatataggctgcagtgtgggaaacagatcagagaggcttcagggcctgcccaaccatcctttacgagtgttgtttaacgcaaggtctcgtggtagacagtgttacatggttaaccccatttccattctcctcttgccctgcttccatgtggtatagaggctggaaaagttaaacaccttcttccccacctcctgtgcagctcagtgtagtcatgtgaccctgctctggcctgagacttgagcagtgatctgttgaggtcttctgggaaggaatatgcttttcctgataaaaggaatgagtgcagctgttccccctccccctccttcccacctttcacagagaagggatgactagagctgggcagccatcaggcaaccacaagggaaagaccaagatgttggtgttcatagaatagagcctctgcagcaatgtcagcaccacacacatatggactgcttgttatgtggaaaatatcagcccccatctttggagattggatttttttgttgtggttactttccatgaaaagcattctaaacagatacagtgattcaaacataggcttagccgaaaacaaattaataggcattttgatcattgtcatagttagcgggtggaatccccaaattccacttgtgccattgaaattgcagcctttgaatgggatgataaaagagggttggaaagaagaagggagccgtgatggttttcttccacaggcctgtggtggcattcctcagtgtttcacttccaacctccttggaacccatgcttatcttagcttcagcctccaacacagccttaactgtaagcctagttccctgagtcactctgaaatgtattagtccatgaggaaggagaacagattctgtcttctacctgttttcataactgtagaaatgaacacagtgcatggcacttggtaggtgctcagtgaatgtccactaagccagtacgtacacacaaatacatgcaaaagttgaaaatcgcaatgcattgtgtctttaaaaataaaaaagagaaatagcctgatcttttggaacacatatggggcagagcctgctcaatgaagcatgcacattttggattaagaaatatgattatcatttgtcagctctgatttctgcctctgggctgataagatggtgtccgaggagtcattttcactcctttgcagacaccaaaacagaaggggtctttgctgaaaggtagactctgacgtgacagtcattagtagctagaaacaggcaactgattgcaaagtcaagatgaagtgcttcagtaaaaagaaccttcatgcttgaggcatactctttgcttctttgttgaagttgtggtagatttttttaaaaaacaatcacaatatagtttgctatactttaagtttttaacatctccactggggaaaaattgaaggagctaagtaaattagctcattggatcatgaatttatagaaaaaaaattaatattgccctttgtcgtttctgttaggagtgtcacgggtcaaagcagagacaagaggcatggagaaggagcagtgtgagggcctctccgggtcatttctctgtctggcttctgatgctatctgcccaacacagtttctgaaaacatcagaaactccccagttttgcccaacatgcttcccctaccttgcacctcttagtgcagagacatgttctgtgagaatccacctggtaagacagacaacatggagaggaagatctcagagacctggcttcctttcctgcccttcccttgcagacagagttttactttgtgaagtctccagtttcagaatgagaaacctctgttaagcaaccaggcctatcactgtagggatgagaaaagtgaagtccagataggtgaagcaacttgtcccaggtcaacacagcatgtcagagaagctgaggccagccagtctcctgggttctcccccatgttcttcctactgcccctctgcggcttccatttgtaaagagaggattgcttctcctcactcctctcgcacactcttgaggctatttcagtgaattgtgtctatctttttatatttcccatttaaaagaaaacccactctatggcataatggtttccagtgtcctgctgtttggaagaatgttttacctgcctgtcagtgctgagctttgagctccttgaagaaggacattctcgtggctgtggcccatccaggcagaaccagcctagctggccaagtggtttctctgcatcgtttggctgtcagataagggccacctgcttattgattggcacagtgacgcttaagtccaaacatcctccctaatgacacagaacttcatattaaaggatgtcagggaattgattttgctcttctttaggaacaaaagatgtcagaagttagaaggaactgaacagtcaggaaaacgtaagtctctataccttcccatcaccccatccctgacccacaagccatgatcggccagtggaagataaatctaaccaatcccatgggacaaagggagagagccctgcacagcaagacagcagcagtcattgggcagaaataaatcatgagatggttgagaatctgattctctgggtcaatttctctgcatcctcctctgcccttttaggcctgtgctaaactttccctttgatgcaaatggtattaagtgccttgtgtctgaaaaggttgttggcaggctttggttgagaacataaagatgaatctttgttctcttgtctataaaatggggatataataatctacctcctgtgagaattcaataattttataagataaagctcttagagcagtgcctggcccagagtggatactcaactaatgttaactaagaaaatgaaaatgaaaatccaggaatagtctctgcctgcaaaatgttttgaatgtaaggagggagatgagacgctgtgtatatatgcctctgttctgtatttttaatcaactactaaggccatagagaacaaagagttacccctttttaaggtaaaataaattatactcattgtccagcaaggaagaaatgaattgaaaatcctagaggcagaaaagtgcagagtttggagactaccaggtggcactgagactaaaagctttatttgccatgttcagctcaagatttaatgggttgtatagtgtaaggggctaactccaggatctgctggaactcactctgggatccacagcaaacaaagcactaaccttggcatatggcgctgcgagaagtttcctaggatcagccaggctctgggccactcactgggttcatgcctctgaacattaccttccaggagctgcccccattactgaacctaatacgctactcagaagttttgtaaccaaggttttctaaaagtctgagaaatagaagatgaactttagatttgataaacagggctgtacactggagtcaggtagaggtgagtaggaatcctggccttgccacttactagctgtttgaccttggataaattgcttaacctttctaagcctcaatttcaatgtctttattaaataacttttatgaccgggaaatcaattaaataatttatttaaaatacttagggcagtattgatcatgaaatagatgttctgaaaatacttataatgattttgatcagttcctgagagcccacttgtaattttcattgggtctgtactcttgggacttctccagaaaccatgacaaggaattttagagagtattacccgatattgtagtggactgtgctcaagaatcaaatacaacaatgtcaaaaatttgtctgacacaacaaagaaatggactacctgaaatagtatatatagtccctaagagttttaaaatagatggtggatggtaataaattgaatttctgcgttcttagaaagggtgattcagagataccccaattctaagagtcactgacactgaatgtcaagtattttttgtggcttcagaaatttctgataaatgcattttttcagagtgttgttgtatcataactttgctgtagagcaaaccacttcaaacttagtgatctataaaaataaacatttatggccgggcgtggtggctcacgcctgtaatcccagcactttgggaggccaaggtgggcagatcacaaggtcaggagatcgagaccatcctggctaacatggtgaaaccctgtctctactaaaaatacaaaaaattagccaggcgtggtggcaggcgcctgtagtccccagctactcaggaagctgaggcaggagagtggcatgaacctgggaggtagagcttgcagtgagcctagatcacgccactgcactccagcctgggtgaagagtgagactccgtctcaaaaaatatatataaaataaaaaataaataaacttttattgcttgctcatgagtctataggccagcttaggtttggctgatctagcaatgggttcagtaccatttgctccagatgtctctcatcttccttgaaataacaactattctgaggcgtgttcttctcatggtaagagggcaagagaagggagtaactacagccatgcaggtacatagcaagtccctgttcatatcacattcaataacaccccagtagccaggcaaatcatatggccaaacccgaaagggaaaaggtagacactgctcactatgaggccaaggcaagtattcaggtgtatattaataccatgggggagtcaggaactggggggcaataattccttcttccacacctgtgatgttgcagactgttgctggagtgtagtcttctttctgttagttgaggggattgtttttttgatctagctgtaacccctgatgagtgatgtacctcttagtaaattgtgggcaaacataaggaaaaaggacctctttagtaaatgagccttctaagattcagtcgtgtggtgaaataactaaactgagtggaggacaaagaagtcacagaaccaatccttcaaatccagcccgcagcagcagaggtgtaaacagttactatctaatgtccactccggggtctacctgaattgaattgttggtttccttccaattctcaatgattttctggccattttcatagaaaccatcaatgtaactgatacttctggtttcaaataatatgctagatcaaaagcataaattaccttgaaaatgtgaccatttttctagctctccttggctatcaataaataatactcaaattgctctaaattgttggattgagtttaggagacaaaggccagcagtaactgagatgattaacatgaattgggataaaactccctcttcagttttcatctaacagaatgcaggtcttcagagaatgattgtcttttctagcataatactcatctacctcctgaagggctgggagcttagaattctttctcactctcagtacttcttagagaaacccagaagagtccagtgagaatggtttccctgtttggctgattttctgggaggcagaatggctcaggggttagatgccattctgggatctatggctggattcaaacttggctgcacacctgggtagctgtgtgaccctgcgaaagttgcaaaggttggttaacctctgcagttgtccctgatgttgatcacagatcttcagttcccctttcctcctgtcacccagaggactgagtccctggctcctttgtggttgggtggtgctatgtgaccagttctggccaaggattgtgagcaaacatgctctatgtaacttctggattacactatttaatacccagtgagaaactctccagaattctctcttgtccccctggcacattgaccagcaacatgcaaggtgatgtaactccaatgagtagggttcccttgttgacctacactagacatgtagcatgacagagaaataacctttgtgctaagccactgacatttggggggttatttgctgccataacttaatccaccctaccctgattgatgcacctcactatatctttgtttctttatgtgaaaaaatggagataatagtagaatctatttcatcaagtaattatgaggactaaacaggataatgtgtgtataatacttagaatagtacctagcacataataaatttttaatatattttagctatttatgatgatgatgatgatgttatgccgtgctctaactttgcctctaacaagttatctatttctatcaaacaagttattagtcatgtgtcttcaagaaaatcacttatcatcaagttgcaatcatagtatgttagaataagtgagctgtaagactaatttctagccttatgatgtgagcctctattaagaactcactcagagactccatcctggtgtttcaaagatatttctattggttaggaaaataaaacgtgataatactaaacattattttctccccttcagttgctctcccttccccaaacaaaaagatgtatccttattacagaattctttctgtatcctgttctgaagatttctgctcaggaaattactctggctcgtaaattattaactacaaattggttttccggtttaggcacctacaccctcatcagtccatccccattctctgttctgttttcaccagtaggatgtcaacagtccactatgatcttttttcctgatagcatggtcttaccaaaaggagaagttcctgtccttgaccaccttagtccaggctaaaatagctatccacataccaccactcatgaccactgagacctgttttccaacttcttcagatcagagctttccatatctggtttttctctcatgttactctagatgtatccttctctagtcccaaaggtagccctgtctgcaattcccaatagcagcatgttaatctatgttaacatattatattgaaccataagaaattgcctttgtggaaggggtgggggttgaatatagaaatttcatatggttcaacctatatgtaaacccaatttggaaaagaaggagactgtgatcacatacctattaaattacatgttggatcccatcaagaatcctaatgtatttcttcctccataccttgttgaactgggatcttgttccaggacatgacttatgctctgtatataaccttcagacctccctatacccagcacttggtagatagcagatactgatgctgtatttattgaccaactagatgggagctttttgtgatatctattgttgacatccatgtttatacatttgggctgtttaaaaaggtaccatttataattacattatgggagaaaataacacttcttttctttaacctctttcagattgaagacatcattacaaagatgcaagatgacaagacagggggtgtgcccatcagaacagtcaagagctttctctccaaaatccccagtgtcgtcacaggtaacaccctccttgcaaggtgttggtaacagtcagaactaccaaagagttataagtctagattgcggcctgaggggtgtctgaagatctgtgaatagtaaaaatgaaacattcagtgtgtttcttgactcaggtcccatcctagtcttagtttccaggaagaagctacttgttgcccatcattaagaatgaccttaccatgaccagcccttcaagtgcatgtagattgaggctgctgggaataaataaacccattaataaagtggcgcatcagcaactttgcctgtgggatacacacaagcacagaaatattaaagaaattaaacaggtttttaagaaagtgttatattcaaattctacaaaatgcttttattttcagttttttaactcagtgtacttgacctcctgaaagagaggttttaaactatttttcttcattccttatattgtgctttgtgtgctcatctttcttttaaaatattttattgtgaaatatattaaaacacatgggtagttcaaaaataataaaacacagtacatgtacctaccatcctgccttataaagaacattattatcaatatcttagagcccccttgggtacctactgtattgcatccacttccctaaacactatctgcttgtatactaatcaattcattgtttttcttcatagttttactacctaggtatgtatcttttgctatccaaacaagtaaccaaataaattaagataaaattttagatgattctcttaatctgcctatatgcttttcaaaattcgggaaccaaaggacttagttttcactatataccttttagaatggctaaaaataaaaatattgacagtaccaagtggtggtgagcatgtgaagcaactggaactctcacatattggtgatacgaatggaaaattgtgcagctactttgggaactagtttggcagtttcttacacagttaagcaatgcttaccatatgaaccagcaatcccactcctgggtattcacccaagagcaatgaaaacttgtgtttatacaaaaacttgtatgtaagggtttatagcaacttttattgaagtatactgaagaatatagcaactttattcatcatctccaaagactggaaacaacccaaatgtccttcagtgaacgggtaaatggataaacaaactgtagtctctccacaatcagcaacaaaaaccagggaactattgatactggtagcaacttggattaatctctaggtcatttttctgagtgaaagaagcagtctcaaaggttacatgctatgtgatttcaggtatacagcattgtatacatcacaaaaccgtagtgataaagattagatcagtggtttccagcaactggcatttgcagggcgagtgtgactgcaaaagacaacaggagggagttttatgagatgatgatgatgaacagatgaacagttctgtatactgattatggtgatggtaacatgactctatacataggccaaaattcatggaacaggccaggcatgatggctcatgcctgtaatcccagcactttaggaggctgaggtagggggatcacctgaggtcagggggttgagaccaccttggccaacatggcaaaaccccatctttactaaaaaatacaaaaattagccgggcgtagtggtgcgtgcctgtagtcccagctacttgggagactgaggcaggagaatcacttgaacctgggaggtagaggttgcagtgagctgagatcgtgccactgcactccagcctgggtaacagagcgagactctgtctcagcaacaacaacaacaacaacagaattcatggaacagcacacacacacacgcacacacagggtcaatattactgtatattaacctaaaaaataagtagacccagttgaagtaagtatcccagctcattattgagactgtcactctttgaactcaggtactgtcttactcagctcaggctgctagaacaaagcaccctacactgggtggcttataaagaacagaaattcatgtctcacagttctggaggctggaagtctgagatcaggtaccatcataggttctggtaagagcccattccaggttgtagactgctgacttcttcttgtatccttgtttggtggaaagaaagctagatagggggccgggtgccgtgactcatgcctataatcccagcactttgggaggctgaggtgggtggatcacctgaggtcaggagtttgagagcagcctggccaacatggcaaaaccctgtctctactaaaaatacaaaaaaaaaaaaaaaatagctgggtgtggtggcacgtgcttgtagtcccagctacttgggaggctgaggcaggaaaatcacttgaactgtggaggttgcagtgagcagaggtcacgccactgcactccagcatgggcaacagagtgagactccatctcaaaaaaaaaagtaagctaaatagctctctggcctctctgtaaagggtaataattccatttgtgaggggccctccttcataaactcccccaaaggactcctaatgccatcatgttggggattagatttcaatatatgaatttggaggagacacgttcagtccaaaatagagcccagatagatttgggtaatgaaggatacttgtattgttagtgttctctaattttaaaatttatgtaaatgaaattttactatatatattattcatgtataatatacagtataatatagactatgtatgtaattttactatattatttttcacattcctggattttgttcaataatgtttaagatgtttgtatctatttcacaggccacactgatctgttgtttttcttaccattgttgctggtttgggtatcaaatttatgctagcctcataaatgagccatgaagtatctctcttttcttgatatcctgcttttctttgaaaaataattgtccctttaatccaggttttaagtatgtaatttcaattattttttatttttaaaatttcctctggttctttttttttttttagacagagtcttgctcttgtcacccaggctggagtgcagtggcatgatctcagctcactgaaacccccacctcctgggttcaagcgattctcctgtctcagcctcctgagtagctgggattacaggcatccgccaccacacctggctaattttttgtatttttagtagagacagggtttcaccatgttgcccaggctggtctcgaactcttgaccttaggtgatccgcccaccttggcctcccaaagtactctggttctttttacaatatacttggtcattcatttttttaaatttattcatttagatatttattgagtgttcactattttctaagcattgttaaggacttgagattcagaagtaaatgaaacagataaaaagttctaccctcatggaatttatattctagtagaggaggaaataagtaaggaaaacttgcagaattttagattgtgataaaggccaaggagaaaaataaaatacacaaaaggatgggaagtgttggagtgttgcagctttggaataggtgctcaagaaagagctcctcgagaagatgacatttgagtaaagacggaaaggagatgagggattgaatcatatggatattgagggagagagcatgccagacagccagagctcagtgcccaaggcaagagagttcctggaacattgaggatctgtgaggaggagccagggcagctataatagagtcaagaaaataaggagagtggggatgaagccacgtgagaatggtgagcttgatcacttagcctcttatcactgcaggattttgcacatggcctgacatgctctgacttacctttcaatgagatcactctattatattcagaattccctgggggattgaggggttaggtgccagataggaggctattattaaaatggtgcctcagactaggtgatatggtttcactctgtgtccctacccaaatcgcatctcaaattataatccccacatggcaagggagggacctggtggtaggtgattagctcatggggaaggttctcccgtgctgttctcataatagcgagtgagttctcacaagatctgatggtttaaaagtgtggcacttccccctgctctctctctctcctgccgctatgtaagacatgccttttttcccctttaccttctgccaggattgtaagtttcctgaggcctccgcagccatgtaattaactgtgagtcaattaagcttctttcctttataaattacccagtctcagatcattctttataacagtgtgaaaatggactaatacactaagctatcagcactggagatgtgtgaagtagtcagattcggattcaagtctgaaggtagatgatatggtttggccaagtccccacccaaatctcatcttgaattgtataatagttcccataattcccacatatcatggaagggacctggtgggaggtaattgaatcatgggggcagttacctctatgctgttctcatgatggtgagtgagttctaatgagatctgatgatttcataaggggcttttccctgtctttgctctgcacttctccttgctgcttccatgtgaagacaatgtatttgcttcactttctgccatgattgtaagtttcctcagccgtgctgaactgtgagtcaattaaacatatgtcctttataaattacccaatcttgggtatgtctttattagcagcatgagaatggactaataccgtaaattgttactaggtagtggggcactgctgtaaagatacttgaaaatgtggaagcagccaggcgcggtggctcatgcctgtaatcccagcactttgggaggccatggcaggtggatcatttgaggtcgggagttcaagaccagcctggccaacatggtgaagccctgtctctactaaaagtacaaaaattagctcagtggtagtggcacgcacctgtaatcccagctacttgggaggctgaggcaggagaatcacttgagcccaggcagcagaggttgtggtgagctgagatcacaccactgcattccagtctgtgagaccctgtctcagaaaaaaaaaaaaaatagaaaatatggaagtgactttggaacatgggtgacaggcagaggaaggaacagtttgaagggctcagaagaagacaagaatatgggggaaagtttggaacttcctagagacttggagggcttagaagacaggaagatgtgggaaagtttagaacttcctagagacctgttgaatgactttgaccaaaatactgatagtgatatggacaataaagtccaggctgaggtagtctcagatggagatgagaaacttgttaggaactggagcaaagataaccctcgttatgctgtagcaaagtcaggtggcattttggccctgccctagagatttgtgaaactttgaacttgagagagatgatttaggatatctggcagaaaaacatttctaagtgcagagtgttcaagaggtgacatttgacatctctggacacaagagagcataaaagtttggaaaatttgcagcctgacgaaccagtagaaaagaaaaacacattttctggggagaaattcaagctggctgcagaaatttgcataagtaaggaggaaccaaatgttaattgccaagacagtggggaaaatgtctccagggcatgtcacagaccttcaaggcagcacctcccaccacaggcccagagacctaagaggaaaaaatgtttatttttcctcttaggtccagggccccactgctgtgtgcagcctagggacttaatgccctgtgtcccagctgctccagctatagttaaaaggggtcaaggtacagctcgggccatggcttcagagggtgcaagcctccagccttggcagcttccacatggtgtttgtcttctgggtgtgcagaagacaagaactgaggtttgggaacctccatcttgatttcaaaggatatatagaaacacctggatgtccaggcagaggtgtgctgcaggggcagagccctcatggagagcctctgctagaacagtgcagaagggaaatgtggggttggagtccccacacagagtccccactggggcactgcctagaggagctgtaagaagagggccactgtcctccagactccagaatggtaggtccacccccagcttgcactgtgcaactggaaaagctgcagacactaaacaccagctgtgcaagcagccaggaaggaggctgtaccctgcaaagctaccgggtcagagctgcccaagatagtgggagcccacctcttgcatcagcataacatgggtgtgagacatgaagtaaaaggagattatttcataactttaagatttaattagttacctattggatttcagacttgcatggggcctgtagcccctttgttttggtgaatttctcccatttagaacaggtatatttacccagtgcctgtacccacattgcatttaggaagtaactagcttgcttttgattttacaggctcataggtggaagggacttgcttagtctcagatgagattttggacttggacttttgggttaatgctggaatgaattaagattttgggggactgttgggaaggcatcattgtgttttgaaatgtgaggatatgagatttgggaggggctggggtagaatgatatggtttggacatgtccccacccaaatctcatcttgatttgtaattcccatagtccccatgagtcttgggaaggatgcagtgggaggtaattgaatcatgggttggttacctccatgctttcctcatgatagtgagtgagttctcatgagatctgatagttttataacgggcttttcctctacctcactcttcacatctccttgctgctgccatgtgaagaaggatgtgtttgctttcctttctgccatgattgtaagtttactgaggcctttccagccatgctgtactgtctgtcaattaaacctcttttctttatttcccagtttcatgtatgtctttattagcagcatgagaaccgactaatagagtagaacagatattattagcggatagatcagatatggaatgtgagaggaaaaaaaggaattagccatgatccacactttttggcttcagcaactggaaaaatggagttgctattaatttcaatgaggaatactataataggggtgccaggggttggggtggggggcagttgttagctgaagggtaagaaatcaaaacacaaattttaggtcaagttttagcgacctattagacattcagttggagatgacaagtaagtattccagtatgtggatttggattttaagggagtgtctgtgctgggttcataagccatcagcatgtagacagtatttagagccataggaataatgaggtcaccaagggagtgagtgtagatagaacacacagtccaattcctaaaacacagggtactccaatctatagatgtgagggagagaataagaaaacagcaaaagaaatagaacaagtggctggagacaaggaggaaaaatcaagaggatataatttcttggacaccaatttttctagaaagtgttttaaggaagagtagagtgacctactatagctatgctgagaagctaagggctgagaattgatcattgcctttagcaatgctgaattcattgctgaccttggtaagtgcacattctgtgaaacattgggagcaaaaatccttattgggtgtgtccaacctgagatgaggagagtgattcgaggtgctaagacagttaatcttggaaggagtttcccttgtaaaatgaagaaatgcagtcatatctagaggggtacgttaggtcagaacaggtagatttttaatttaataaaaagataatatgtttgtattatagaaatgactcagtgggggtgggggagatgatgtaggagaatgggaaaacttcaaggagttatatcaaagaataggtaagagaggattgaatttaacatgcatattggtgagtagtttcagctagaaacacatacaatttattcatagaaagaagaaaggaggcagccgggcacagtggctcaggcctctaatcccagcactttgggaggctgaggtaggcagatcacaaggtcaggaaatcaagaccatcctggctaacacggtgaaaccccgtctctactaaaaatacaaaaaaattagctgggtgtggtggcgggcacctgtagtcccagctactcgggaggctgaggcaggagaatggcatgaacccaggaggcagagcttgcagtgagccaagatcacgccactgcactccagcctgggtgacagagtgagactctgtctcaaacaaacaaacaaaacaaaacaaaaaaggaagaaaggaggcataatagatgcacagaggtacaaataagtgggcagatgtgatgggaggtggtggaagcttatagatcttctcattgtctctatgttcctagtaatctggaaaccaaaaatggtagagattttgcaagttcaaggagagatcataagttataaattagtcaactaggaaagtagagattgactggactagggaaatagaactttgattgtgactgatatggtttggctctgtgtccccactctgatttcatctcaaattgtaatccccataatccgcacatgtcgagggagatacctggtaagaggtgattggatcgtgggggtggtttcctccatgctattctcatgatagtgagcaagctctcacgaggtctgatggtttttataagtgtttgacagtttcttcttcacagactctcttgcctgctgccatttaagacatgcgtgcttcccttttcgccatgattgtaagtttcctgaggtctccctagccatacggaactgtgattcaatcaaacctctttttttttttttttttttcataaattacccagtcttgggtatatccttatagcagtgtgagaatgtactaatacagtgaccttcttaggatgattaatatttttgaatttaaagacaggtaatttttttccccatccacatttagctctgtggatttgggcatgcctcaggtagaaagtggacttaattgatgttatagcaagtttgaggttataatagatcaagacagaggcacagtaactaaaatgattgcccattacatttaattgagtaaggatgaaaacaagaacatgagatggatgaggaaccatgaagagtagtaattaccacaaattgtaagtcaagtggcaaagaaattttggagttttcagaggcaagagtaagagagctgaaaatatagtagatggtgattagatggtggcatgtttgaaattgagattctggaaagattgtgattattggcagggacaataatataagatataaccataggaacaaggcattgaaatgggataaagtgtaagatttttggaggagaggaggttaaggaactgagaggccatgatactggaagactgagctgtgtgaatattgaaatcactactgggggagtgttagagaaggtggttgtgagttaaaatctttatggaatgagaagcaaaggaccagggatcagcagatgactttcacaataagaggtacaggtggtttaatcagatggtatgggagtcaaagctgagtgtgttttagagaagagggaggggatgaaggtgatctgaaagcagcagttagtagcaggacagtcacttatctacctgtaaaccccatggtatataaagtgtgggagggaaaatagccaccacgtaagagggctgcagggaagcaggaccactggggaagaatgagaagatgaaaggaatattaactgattttatttatgattcatcatgagtccaagagggcaagtggaagggtttcaggaggagatggtgagtttatgacttgagtaataaatgcctgctgttgctatgtgccaggctctagagtagtcacagacgatataaagatgaacaaagacttgacccctgctcttaaaaagctattaatctagtgagagaaacagacacaggtagatcaatgatttatatgagctatgtgccataatagaagaatggacaaaatgctgtttgagtccaggagagagaatcatgaatttttattgggtatgtctagaatatttctctgagaaggtatatcagttatctatttctgtataacaaacccacaaactataattgcttacaactacagtgatttattgtttcttatgattatgattccatgaaccggcaatctgggcagttctgctggtctcagccatgaggccatagtcatctgatggctcaactgaggctggagggtctacagtggcctcactcatttgtttggccttggtgcttactcttaaactcttaactggggtctcagttcttctccatgtcaccttgtatctgccaataggttagattgggcttcttcacagcctcttggtcttagggttccaagcaggacaggataaaaactgcaagacctcttagggcctaggctccagaactcatacaatgtcaagtgtgccacgtcacgttcttcaaggcaaattacaaggcaaagtctggattgaagaggatggagaaaccaactccacctcctggtgtaggagtggcaacatcatgttgacattgggagacacgattcattggagggcattaccataacaatctaccacagacaataattgagaaccggaccttaaacataagtggaaacccaggaaaagtcattccacgtagagaaaatagaattttcatagcctcaaatacatgacaaacatgccaggtttcagtaagtataagcttgtttgtgtggttggagtttaaaacacatttatgtgtgtatgtatttgagaagaggagcatattggcagaacagccacaggaatgaaaaggatacaagaattacacctaataatatattataaaggaaagctgacttgtagactttgttccaaaggtggggctgcttttatctcaaaggtaacccatctaccctgctcagatggactgccgtcagaggttttaaatatgagggaattcacatccatgaagtggatggaagtttaagcaggaagaaatgaggagtgtggagactagttatggagtctagatgagggaatgtatgtgagaaataaggccatattaacgacaaccacagcatcaactgaaaccatggctgtacagccacgcatcattaaatacttataaaaaccccatgagatagaaaccgttattatctctaccaagtaatggaggaaactgctaattcaagagtaacttttccaaggtcacaccactagtaaatagcaggatctgttcctctgggccacccgtgtaaggatggtagcagtagggttcaaaagatcagaggaaacagtagaaggtatgattgacacaacctgctgacttgaaatagagcagagggtaactcatccaaaatggatacaccttaatatcatggattgaatacattcatttaactttttctcttctgaaaccccacaaaaattatagtaaaagatttttattttaaaagcatgatctaaaagttggaggcctctattacagtgatctaccatgggaaataaacatccttaaaaatcttgaaaagatagtccagtacaaagggcagtcagtgcctcactctcaagatgtgcagatgtgtgaaagactcatggagaatagtcttccaacacaggagacaatagccacaaaactcaagaatctgaaaaacaaatggatgagtggtaactgacaatagccctgaaacaatctaaccatcacttgtcagtggacaaggctaaaaaaaaaaaaaaaaaaaaaaaaaaactctatatttatatgatggagttctcaatgggctcagaaactggtaacatcagcagacttttctatctagttagaatacattttgccaacactctcacctacttaactactgcacagaccaatcactagctagtgtctattgtttagcaatatcagatcctgcacttggccagcacagctcaggctggtgttgaggtggttcctaagaccagtcaagccccaggacagaagacaaatctcatgcttacctctagttgctggcactagagtagagaattacatagagaaaaaacccaggtcactgagacccatgggtaccaaacttaaagttgaaacgcattaatacatggccaccctgttactgtggcaagagaagctgtatctacatgggacagtaatcagcccacacttcagcctttccaccagctcagcagcctccatcagactttctagccatttgagaaatagccagtttcccatcacaaaccagcagataccagcagatactccaacattggagcttccatttcaacagcaacagctgggggaataactttttctcttctctattgggaccccagttctttaataaaaattgaaagtaaagatgaaagaataatggacattataaggctggttaatcagcagtgtctttatttcttgcactgctacataacgtactgtccatacctacatgtgactttgctaaataaacagcaagtgatttcaatggaagaaggcaagaagatggagaccaatggcacgatgatgacagtctgctggtgaaagcttctttccaaagatgatattgatgaggaatgcatgagcatgtcccagtgcatccaagactctgtcactctcagaagctctgggaagctgcttgtcaccactttctcagcaacacagtgaaagtcagagaataatgttgataaaaagtagtatcttgctgcaaggcccgtctctacactgtcaagttaccacattgagttgaaaattttgccaacatatccagatcatcccaaaggcgaaaagagaagcaactgttaatgacctacaccaaataaatcaacaaacacatagcaatatgcggatgtgtacctttgtagtggatcaaatgagcctggacaagaaactctaaatggaaagttttagagcataaagagaacattctagaaaaagaatgtacttgccaaaaaagtcaaaactgagataaaggaaaaattgtagacctggggaatgtgaatttggaaaaataatttatgggtactgaggatagagataacaggggaggtatagctataagcagagcagaaaattgatatccagttttccagaattcacaggtgacatagaagggaaccattgtaccaagtgatacacaaagatcagagttgaagagatgtgatttcgtccacgagtccctttaaagctggctttgtggtgtgtttgtttacaaccttcctaaggtgtcgatgtctaccagttggaacagtgacacaagagatggtaggcatttcttgactttccatctcacaaattaaatttgtttggtgaattcctgaaggatccatacagagcctggactgaaagcacctgtttcgatcttatgtgctgaaagcaaaaccttttctcatcaaatgtttctcttctttgtctttctggctttcatatgtgtgatctaacttcattggttacatctttattaataataaatatctaataaaaatgttaataaatttaaataaatacattgaataaaaataacctatattcatctaacctgttttgggtaaaggaggttcctatacccaagataaggacttgaggaagttatgggtttgggagagaagacacaagatcagtcttgattatgctaagcttgaggttttgaagggttatttgggtagcactgtttaggagaaacttggaagtgaggagccaaagtcctggagaacattttatgtaagagatatgtatggatttgggagtcatcagagtctgagtgacccgggactccagggtcatgactgggaactataattttcacatcttcttctataagccatgtattagtctatctgctacccagccttgagataacatgctcacccaccccacatcttctatgattttgagtttgaaattttcccaccaatatgtaagggaaattatcttccctgctcagatcaggacaaactcataggtgaattcacaggtattgctgggatgaagagggagaaggaatgcctgttggttcacctgtgggttcgaaatgttgggattgggaaggttggcccagggagtaaatgcactgagttaggggatagatatgtttgggagaaggccaaacacaagagataaccattagaatataatctctgtcttagaaagtgaaaaattaagagctgtaaggggtgaggtttagcaaataaatatttctgagcaaaaatagagaattggagagagaaggaaatacggaagaaagaagaacccaacatcagatcaaagtccaaggctcattggctttttgcaggggaagtcacatacaaaccatctcatcttccagaagcttaagatttctgagcaaggtgcccacagaaagggtacttcagagccaccctaccaatcccttttcaggactacagaccaacctcctcagaccctctttgaatagtaagtaggtaacaaagatgatcactggagccaagatggtgagtcttcggagtttccaacctcagcgtgccagctctatccacgccccacctgccctgcaggtgatagacatatcctgggcagaatgcctgccagccccaggaaagcagccagattgtgcagctttgcccagctgtcatagacagtcattccaggataattctccatcacctgaatgtcatgaagaattttccagggactttggagatttatttcttccagaccaccctcagaaacacaaattcctagcatgtaagagccataagatgcatctagtctcacttattcttgcagtcaggaagattgagtaccagagacatgatgtaatgtcctcaaaaatcacagttaaggacagaaccaagactggaatctggattcctcactaccattgcaaactgttcccatgatctcatgcacaaaattatagactcttggattgcagcagtttcttaaaggtgtttgatgcgttctccctgaacatgagaatcacttgtgtaacttgttaaaaatagatttccaggacatccccatgggtctggactcgggatcctctattttcagcagcttctcatatttatctcctacagcctgtatgaatttgggaatgtgtaagacccctacagagtgctctctagcctctgttttaacaatctgcaatgatggatgtcatctctccttccatctttggacaactttgaccttgagaaacttttttttttgtaataaacctaccagcctcctcttgcttcactgcattagtcccaattctacctctgtatcacaaagaatagaggaatggatttgattaaaattatgcccacctagctcttccttatgaaattttcttgcacaaataattttcagaaaatatccaaggtatatacatgcatttttattttacttaacacatttttttatgaatacatttctgtcttttcattatccacaaatttatttttaatagctttatgtttacctaaacatttaaaagtattattcttacagtttcttggcaatacagtttggagtctaggctccaaacagcctatgtgacctgggttggtcactgtgtgaccttgagctagtcaccaacctctttgggcctcagttttctcacctgttaattgataggtttggattaaatgatatttgtagtccattctgactctgatcttctgagattcttcacaggatatgtataaaggcctgtctgaagttaattcttttcactttttctcacgatgttctaactgaatctacctctgagttaatttaggccaccagttttgtcttaagatgtgtgtctcagtctgtcttctgctgttgtaacagaatgccacagactgggcaaagaagagagaaatgtatttctcacagttttagggtctgggaagtccaaaagcatggtgccagcatctaatgagggatatcccatggcagtaggcagaaaatggaaggtgcatgtgtgtgaactggggatggggggtgcaaactcagcctttttattgggaacccactccttggatagctaacccactcctaggataactgcattaattcattctgtagttaatgcttctcactttttctcaagatgttctaactgaatctacctcatggaaccctcatgatctagtcattcattaatgatcccatctcttaatattgttactgtggtaattaaatttcaagatgagttttggaggggacatccaaaccattgcactgtggtacttccagattagaaaaccaaagaacaagaaacagcctctgttttaataacgtgcgatgatggatggcatcatcactcattccatctttggacaactttgacctttagaaactttttttataatgaacttccctgcctccctcttgcttcaattcattcatcccaattctatctctttctcacaaatagagaaatagatttcccaaattagtaattccctgagaattgcccaaagttaatcagtattcttagtctttgttactcttcttctgcttctgtatcactggaaggaagaactttaaaaatgcctcaaaatagagataatttgttggatgcatgtagagggctgaataatggccccccaaaatatcagcttctagttctttacatctgtaaacatttgttgataaagggtctttgaaggtatggttacattaagtatcttcatatgggtaggttattctagatcagggtgtctaatcttttgacttccctgggccacactggaagaagaattctcttgggccacacataaaatgcactaacactaacgatagctgatgaactagaaaaaaaaatcacacacacacacaaaaatctcataatgttttaagaaaattgactaatttgtgttaggctacattcaaagccatcctgagccacatgtggcccatgggccatgggttggacaagcttgtcctagattatctgggtgtgccctaaatacaatgacatgtatccttacaaatgagagtctgaggaaaatttagtatagaaagaagaggagaaggccatatggcctcagaggcagagattagaatgatgtggccagaagccaaggatgccagcagccaccagaagattccttagcacctccagagcaagtatggccctgccatcaccttgattgtggcctggtgaaaccaactgtggacttctggcctccagaactgtgagataataaatttctcttgttttaagccacaaagtttgtggtgatttgttgcagcagccatagaaaactaatacagtgccaaaattacactaagcacattatagtttaaagtagatgacacaatgattttttttagaaaaattgtgattcattaactgaaaaaagaaacaagcaaaaatttagttttcttccaaagttttatttgaaaaaatatagattataatattaattttgaaagcaaattatactaacatgaacttatgtagtagaattatttaataagcattcagcttaaattgcttaataaagttataaattgtatttgtccaggtctaatgtagtttaaaatatcttttggatatcataactaatcatattatttccacgttcgtgatggaattaaatcaattagttataaaataaaatttattcttaattagtatgccaaaatttatacatacataaaataatctcttaaaatattcacttcgaaaagtggtatatttatttcagtaatgcttccattgctttgattttttcagatttttttctccagtaagagcttttagaacttgtttaaatatcctcaacagaagcaaagccatgaattcataaccatatatacatttatataatcaaaattgatttggagattctgctttggagaatggtagactagcctactcagaccaactgtctgaatgagaacaattacaaaatctggtaaaaaaaaaaaaaattcacttgatgtcactggagagttaacaagagaataaagagttactgggccaagattcatgctaacataaacatccatagatatgatggtggccttgggtgctgtttttgccctggggacatttggtaatccaagagagcacctgtcagacgatgcctttattaaggcccatggacattatctcctatgccataggggttgtggatttgctagtttaaagaaaacacatgcaaagatgagagcttatttacctgactctggtattgactattaggttttaccatggtcagcagctgtgggctgtgtcaggtttgggtcagggagatgaggaacaaggaggctacatcttaaccgcacggggaggggacgttttaacaaggccaaaggtgatgaggtacatcagggtaaacatgtgttaggcctaaaaatggatgtcaaggcagcaactatattaaacaaatttatgatgggcagtgattactgtttacctctaaggggcagggagtatattgtgattgggacagtacctgcaagagactaccagagtgttgaaaaaaaaattttttaacatcaatcatggtaacatgattaaaataatgtaaactgttcccacagtatttcttcttagcacttttctgtttgtataatatttcacaataaaaatagctttccttttcctttttccttttgttttacaaaaagtaatttgaagtcagttcggtgaataaagtctgtaattaaagagggaaatgccaattgtggtttaaataaggtgtgactctgggtaaatgaagtcagttttcttgttgtccttaaaagctgtttcataagtttatttccaaagagcatttccaaaaacatttgtagcacagccaatactgatggaaggaagggtgtggcttttttagggccaactctgaaaatgacagtgcttaattaaatattgattatgctgtggttgccttaacaaatgtaacttcactgtaacatgttttatttaaatgtatgaatttttcttcttatgggattcactttagtaacaacctcttaaaatcctgtcaacttataactgtgaaagcaaaggcatatctctgatgctcctggcctttgtgtcattaaaatcttactctaaatgtcgcattaattcatcttttcaacatttttccttgtttgatttttttctcctggaagaaaaaatgctaagtggaatgaaggaaggaaaagacaggcagtttattaaaagtcaaaatataccatacaaacccctaattgtactctaaaatttctttttaaacgtttctattaaaaaattctgggccgggcatggtggctcatgcctataatcgcagcacttttggaggccaaggcgggcggatcacctgaggttgggagttcgagaccagcctgactaacatggagaaaccccgtctctactaaagatacaaaattagccagtcatggtggcgcatgcctgtaatcctagctgctcaggaggctgaagcaggagaattgcttgaacctgggaggcagaggttgcagtgagccgagatcgcaccattgcactccagcctgggcaacaagagtgaaactccatctcaaaagaaattaattaaataaaacattctgtttccaataagataaaatttgagaagagaatgaaatccagatttagtgtagctgacccgggatcactgactcttttttagagaaggaactgggaaactgcagtggacatcatgctctggagcaacagtgactatggatttcactgtatcatcggtcgcagcatggaattctatacactaaaatcgctggatgagatgctggtgggaagaccctaacaaaatcgtgtttctgacagaaagtgtatacacattatgagcaaggagaacattagttttcagcttagctccttgtgcagttgaatttgttactctgttctgaagacattggtgccagataaaagctttaaacacaaaacgttgttactgacatgttaatataattatgccacgtattatatatacaaaactttaaaagctaaatttagaagttattgctgtatcatttatataggctttgttctccttaaacacgttgactttaataaggcatgttttgtacaaataaagtctaattctaccatcagttgcagccacaggaaatttgaagtcatttttatataaaatttaaattccaacacttaattcaggttctatgacaccattttctagatccaagaaggaaatcattggctcaggattttctacagcgatctatcctgtatgttcctcagataatatgcccctagaatattattttttataagaattaatggcagaaacatttgagcttatcactgatggcatttgttgactatcaaaattgtctaaaacctcccacatttatccaggtataaaagtaaacttctaggttgggtgtagggtaggttgggagtcaaaagaggacactctatagagtcacagttcataggttttcctaaagaacactttctaaatctaaatttttcctcccactaagccaaatgaggagggctccagggaaatcactggtgatgattaggggtcctacaagaagcagggtgttaaccttctcactgattggattcttgctgagctgttgaacccatagctcatccttgcttctgctgccagagaggaaaatatggaaaagttcatgggccatttgccagagtttgtggatgtatatgaactgagactcttgaggctaagaggctgcatggggcagcccacaccaaaaggcaaatagggcccatattgtagtgtgatgcttaaggagaaatatatggaacactgacctccccacccccaggatccctgtgactcttggagggtcaagggagcatcatcatggagacagaagacagagaaagagaggaaaagaggaagccgagcccacccttttcctgtctaggtcctctagacaaagctgtgaagggaaaaaaaatagaagataaaatgggatttaaattttaaactggactaaattgcaagtgaccagaaagctaaagggtctgctcaagatgtcataagggaaaagtaaaattatttcccattggtacctcatcgagttcatattgttcaagaaactggatataatacctagtgacaaagagactaggacttctgttttgttcttgtcatacagccaaatattgttctggtcacacagccataacaatacccattggggcagaacactgaactggtaagaaagtaagggaaatttttagaggccttaaaatagaaagtgagaattcaggaaagtagactcgttttagattagtcttttctcagaggacatctgtccatcctgggtagtctagggcatgaattttaaaagcctatatgagtatcaagtaaaaaaattgagtagggtggcagtcagttcagagactcctgaagagcaatacgattattagatgagtagggggagaaggctttagagaaggagatgatggaaataatcgttttgtctttggctattaataggtgaaagacaggagaaaaagtctccctagaaaattcctaattccaaattctaagtctattcttgttggcgtgtctcactaaaccccatgtggcccaaaaattcaagcaaaaatttaaattgtctttttttttcccccactcagtaaagatttaatgatgaaaaaatgcaagttttataatacaaatatataaaattatgaaaacaatttttataacaatcatttgatagtctttttttaaaagactacagaaagtttaaaatataattttgtaattatagatataaacaatgaagttttataaaattaatcatttgatatttttaaaaaggctatccaaaggaatttaaaatcagaatgttgttgaaactgaacaccaactgtatctacatttatttctttttttaaaatactttaagttctagggtacatgtgcacaacatgcaggtttgttacatatgtatacatgtgccatgttggtgtgctgcacccattaactcgtcatttatattaggtatttctcctaatgctatccctcccccctccccccaccccacgacaggccgtggtgtgggatgttccccttcctgtgtccatgtgttctcattgttcaattcctacctatgagtgagaacatgtggtgtttggttttctgtccctgcaatagtttgctgagaatgatggtttccagcttcatccatgtccctacaaaggacggcattattcacaatagcaaagagttggagccaaccctaatgtccatcaatgatagactggattaagaaaatgtggcacatatacaccatggaatactatgcagccataaaaaatttaaactttctctatttcagtactgcccccagctaccaggaagaagcaaacacatctcctctctggagaagcacacattaaatacagaacaaaaaaatttccagataaaaacaaaagtcactggaaacataagaaaacaaaacaacataaggataagtcagcaaagagcacaaatggcagaatccaacacataaagattgcagacattgtaattatattcagattatagaataattattagatcatacgaaattgccatttttataggtcaaagctggtaactatctgcagttccatatgcttaacataatgtttttaaagaaataagagagtactggaagtatgttgaagaaaagaggattaaggattctcaaaaaggactagaagctttgataagtagccaaatggaatctctgcaaatgaaaaatataattgaaattagagacttaatagaaacattaaacagcagatttgacacagctaaacaaagagttgataaactagaagataaagcagataaaagtactcagaatgtatcacggaaaggcagaaacaaataatatgaaagagaggttaaaagacttgaagaagagagtgataaattctaacatctaaccaaattttgagaagtaaataacagagaaaatgggaagagcaattcttccccattgtctttattatttccttccaaatttaaagatctaatagttgacagtttttctgagtggattaaaagcatcgggttccaaaagccaaaaaaattccaagcaggataaaatgaaaacaaatctatatctagctacattgatgtcaaatttcagaacactaaacacaaaaagaatcttcaaaatgactagagagggccagctgaggagacttcacctgtgttccaagcctgagaaacagcaccatgggccacccctggcagacacgtccctaggctggctgagcagctgtgcacccatgtcctgggcctgagaaagagccccacagactgctcctggcaagcatgcccccaggccagctgagaaaccatgtgcccctagacagagtaacagccctgtggtcccaaccccagtgagccagaccccaagaaagctgacccactgtgtgcagacatatgcctccaatctgagcaacagctcagcaagcccacctctggaaaagttgcaccgctaccagcacaaactgtctaagcctaggccactgagacattcataaatatcgctagtatggattacagcttaagaaactactggagactatactactgtgtctacccagaagcaaagccaatgcactgcattgagcccacaccccaacacccacataaatgaataaatcttttcctattaaacctactccataaaattggaagaggtgactgtttcatcagatgtgtagaaatcaatgtagggacacaataaacatgaaaaagcaaggaaacagacctccaaaggaacacaataattccctagtaataaaccccaatcataaggaaataaatgaaatgacagaaaaagaattcaaaataataattctaaacaaattcagtgaaatataagaaaatatattcaatgaaatcatgaaaacaataagtcattattttaatgagaaattcaacagagatagatatcatttaaaatgaaccaaattctatggctgaagaactcaatgagtgaaataaaaaatacaattgagaacttcaacaccagactagaccaagcagaatttgttcttacttgaagacaggtattttgaaataatacaggcaaacaaatagatgaaattaaataaataataaaaaggaattaagtcaaaggatttatgggatatcattaagtgaacaaatatttgcattgtggacattctggaagaagagaagggaaaaggtgcagaaaacatatttaatgaaataatacgtgaaaactttccaagtcttgggagaaagatccaggaagctcaaagaaccccaaatagatataatccccacaggtcctctctgaggcacattttagtcaaattgtcaaaagtcaaagacaaacagcaaaagaaaagcttcaagtcacatataaggtaatctccatcagattgatagcagatttctcatcagaaaccatgtaggccaggaaagaatagaatgataaagtcaaagtagtgaaagaaaaaaaataaaacttgccattcaatattatgcccagcaaagccattctttagaaatgaaggagaaataaaaattttcgcagacaagcaaaaattaagaaaattcatcaccactagaccaaccttacaagaaacgcttaagagagtcttacatctagaagcgaaaagacaataaccactgtcatgaaagcatgcagaactataaaacttattgatggagccaatacacaaaggagaaagaaaaagaatcagaccatatcactacagaaaaacacccaactgcaaaaataagagaggaagtaaggaacaaaggatatacaaaacaagtaaaaagaaatcgataggatgataaaagtcctcaccgatcaataataaccttgaatgtaaatagattaaaatctccatttagatgtagactgactgaacagattaaaaatacaagatacaatatacagcccacaagaaactcatctcacctataaagacacaaatagactgaaagtgaagtgatggaaaaagatactccatgcaaacagaaaccaaaagcaagcagagtagctgtacttatatcagacaaaacacacttcaagacaaaagctacaaaaagagacaagggcattatatgatgacgaagagattaattcagcaagagaatataacaattgtaaacatatacacttaacactagggcacctagatatataaagcaaatattattagatctaaagggagagatagactacaatacaataatagttggggactttaacaccccactctcagccttcgacagatcatctacacagaaaatcaacaaagaaacatcagatttaaactgcactatagaccaaataatataaacctaacgacatttacagaatatttcacccaatagctgcagaatatgcattttttttcatcagcacgtggaacattctccaggcttgaccgtatattaggacacaaaacaaatctcaaaaagcttttcaaaatcaaaattatggccaggcatggtgtaatcccagcactataatcccagcactttgggaagacaatgcaggaggattgtttgagcccaagagtttgagaccagcctggacaacatagtgaggctttgtctctacaaaagattaaaaaattaaccacccgtggtgctgcacacctgtggtcccagctactcaggcggctgaggtgggaggctctcttgagcccaagagggttgcagtaaggatgcagtgagccatgatcatgcctctgcactccatcctgggcaatagagtgagactctatctccaaaaaaatattgaaattttatcaagtatttaatctgaccgcaatggaataaaactggatatcagtaacaagagggacatttgaaactatacaaatacacaaaaagtaacctgctcctgagtgaccagtgagtgaaggaaaaaatttaaagtgaaatttaaaaattccttgaaacaaatgtaaatagaaacacaacataccaaaacgtacgggacacagcaaaagctatattacaggcaagtttatagcaataaattcctaggttgaaaaactaaaaagatttcaaatcatcaacttgagatgcatctccagaaaccagaaaactgagaacaaaccaatccaaagttagtaggaaagaaatgataaagatcagagcagaaatgaacaatattgaaactgaaggaaaaaatacaaaagatcaatgaaataaaaagttggttttggaaaagaaaaacaaaattttaaaaacctttagctacacaatgaaaaaaagagaagactcaaataaatcagaaatgaaaaaggaaacatcacaatgaataccacagaaatacaaaggatcgttagagactataatgaacaactccatgccagtaaatttaaaaacctagaggaaataaattcctgaacacatacaacctatcaagattgaaccaagaagaaatagaaaacctgaataggtcaataacaagtaataagattaaatcagtaataaaaagtttcccaaaaaagaaaagcccagaattggatggcttcactgctgaaatctaccaaacccttgaagaaaattaatgctaatttttcttaaactattccaaaaatttgaagtagaggaaatttttcctaactcattctatgagaccagtgtaactaactagataaggatgcaaccaaaaaatgaaaaaggttatacaggttaatatccttaatgaacatagacacaaaaatcctcaacaaaatacaaaccaaatccaacaacacatcaaaaagataatacaccatgatcaagtaggatttatctcatgaatgcaaggatgattcaacatatgcaaatcaataaatataatacatcacatccatagaatgaaacacaaaagttatgtgattgtctccaaagatggagaaaaagcattcaatacaattcaacatcccatcatgataaaaactctcaattaagatggtatagaaggaaagtaccttaacataataaaggccacatatgataaacccacagctaacatggtactgaatggggaaatctttaaagctttttcactaagaactggaaaaagacaaggatgcccactcttaccattcttattcaacatagtaatggaagccctagccagagcaattggcaaaaaaataaataaagggcatccaaattggaaaggaggaaatcaaattgtctctgtttgcaggcacatgaacttatatgtagaaaaacctaaaggctatatcaaaaaactcttagaactgataagtgaattcagtaaagttgcaggttacaaaatcaacatacaaagatcagtagtgtttctgtacttgaacaatgaactaatgaaaaagaaatcaaaaaggcaatcctacttacaatagttacatttaaaaaaaacctaggaataaacttaaccacagaaatgaaagacctttgtaaggaaaactacaaaacactgatgaaagaagttgaagaggatacaaatggaaagacatctcatgctcatggataagaagaattaacattgttaaaatgaccatactacccaaaacaaactatggattcaatgcaatctctaccaaaataatgatattcttcacagaaatagaaagaatcataaaaatgtacatggaaccacaaaagaccatgaatagccaaggcaatcctcagcgaaaagaacatagttagaggtatcacactgctagacttcaaaatatactacaaagctgtagtaaccaaaacagcatggtactgttataagaatagacacagagaccaatagagcagaagagaacccagaaattaatccacatatctatagccaactgatttttgacaaagatgtgaagaacactcactgaggcaaaacaaaacagtatcttaaataaatggtccccaaaaaatcagatatccatatacagaagaatgaaactagacgctcatctctcatcctatactaaagccaactcaaaatggatcaaagacctaaatgcaaaatctgaaaatataaaactagtacaagaaaacataggagaaatgcttcaggacattggcctgggaaaagattttatgaataagaccccactggcacagactacaaaagcaaaaataaacaaatgggattatatcaaactaaaaagcttctgtacagtaaaggaaacaagaatgagaagacatcttacagaatgagagaaaatatattcaaacttttcatctgacaggaggtcaatatccagaatatgcaaggaactcaaatatcttgacagcaaaaaaaaaaaaccgaacaatccaattttaaaatgggcaaataatctaaacaggcatttctcaaaagaagacatacaagtgaccaaaaaatacatgaaacaagtgttcaacatcatgaatcatcagggaaatgccaatcaaaaccacaatgaggtatcattttaccccagtcaggatggctattatcataaagacaaaaataacaaatgctggcaagaatgcagagaaaagggaacttatgcactgttgatggggatgtaaactagtagagccactatggagaacagtatggaggttcctcaaaacactaaaaatagaactactatagcatccagcaattccactactggacatttatgcaaagggaaggaaatcagtatatcaaagggacatctacacccccatgcttattgcagcactattatatagccaagatatggaatcaacctagggtgtccaacaatagatggatgaacaaagaaaatgtggtatgaatatataggtatatgtgacggaatactattaggctaaggaaaagaataaaatcctgtcatttgtggcaacatggatggaactggaggatattatgctaagtgaaataaggcagataccacatgttgtcactcatatgtggaagctaaaaaatattgatctcatagaagtagaaagtagagcagaggatactagaggttgagaagggtagagagggggagagagttgttaaaggatacaaaattacagatagaagtaagttctagtgctctatagcactgtagaataactctaattaacaataatatatagtttcaaatagctagatggagaatattgaatgttttcaacacaaaaaaagataaatgtttgagatgatagactatgctaattactccaatctgatcactatgcattatatgtatcaaaacatcactatgtaccccataaatatgtacaatttttacatcaattttttaaataaaataaaacaactagaaataaaagacagattgcctatcaaaaaacgactgacagctaacttctatgtaaaaatggacgctacaaggcagtagaagaccatctttcatgtgctctgataaaataacaattagaattctacatgtaatgaaactatctttcaacaagagcaaaattatcatgcaaaagaagtgaaaggaatgtatcactaccctatctttaccaaagaaatgtctacaaaatatattttaggaagaagaaaaattatctcaggatgaaagtttgagatatcaaaaggaatgataaatactgtggtaagtggggcttaatctaaacaatcatggactgtataaagaaaaagcaataatatccactatgaggagttaataagaacccaagtgacttctaactactggaaaataagagcatgcaaattgggaaaggatataaacgtcctctattgttcggaaaaatggtaaagctacttagtagttttagactggtaagaacactcactggggcaaaaaaacagtgtcttaaaataaatgttgctgggaaaactggatatccagatgcagaagaatggcttcttaaaaagccattcttctgcatagctttttaagttgaaattaattaaagtcatgtagaatattaaaatttagtcacctgcattaataaaatttaaaacttatgctcatcaaaagatctattaaagtaaaaagaagccacaattggaagaagatatttgcagcacacaccaacaaagcattagaatcatgaatatataaaagacttctaaaaattgagaaaacaacaaacaatgccatagaaaaatgagcaaaaccatgaacaaacatttcatagaagagaaaatatacatgaccaataagcatacaacagttgctcaatgtcattaataatcatgaaaatgcaaattaattaaaactacagtgagatatcattttaattcactaaactggaaaaaattagactctgaccatgccaggtatgcacaagtgtgtggaacaaagggaatgctaatcgaatgctggtggaagtgtgcattcgcaaaccacattggaaaacgttgtggtgatgcctatggaagttgaactcttacatatttatgacttggcatctccactccaaggaatatattatagactagagaaacaattgtgcaagtgattgaagacactcatcttagcagcattgttcgtagcagcaaaattctggaataatccaggcatgacgtttggctctagaatggaaagagaaagcacattatagtcatatggtagaattatacaaatgaattagctataggctttaacaaggatacaattcaaaaacaatattcctgagaataagcacaggatatctcatgatcccaattatgtaaagtttaaaatcaggcaaaagtaagcattgtattatttagtgattcatgcatatttggttaaatggtaaaaatacatacttgaaaaggaggactaacttttgtggggaaagtagacaacaagaaatgtttaggtgtggaggtactcggtatcaatctcaaagtatactcataatgttttcttctttttactgggtggtgggtacctttattattttagaatacatctttatacttttacatatatgcttatgttgcattttgcaattaaaattttttcaagagtttacagttatataaacatatatactatatttacagccatgaaaaaattgtacatatatatatatatatatatatatatatatatatatacacacaaacacactagtatgtgtgtggatgggagagggagaaagattgattttaaaggaatataaaataaaggtgtatcacgaggtgggactaaatgaacacatttacttgcagaagatgaatttgactttactgtgcttttttggattgtgccgactcataaatctaactgggcttttagtagacaggagacgattgaacattattccatcttatgtattttcaaacagactgtattattttgggtgttgtgtgtctcacccacactgtcaagattctgtaaacctgcaacgtgatccattcggctgcgctctagttattatccaattatcatccattctgcttattaacaggcataaacagacagtatttctgcatggagctgataccctccattatgggtcaccggtcccgttcttaagtaggattgtgaaggaaaaaagcagagaacttcatcttcagtactaatttctctcacttaattccttctgttttactctttctcaagaatgggcatttatcctctactggtgaagaaagggcagagttgtaggagccatctacggtaaatgcaggctttcaaagggtggggggggacggtagagattttaaacgtaataataaaactgaacaaaatttgatctgctgtatgttatcactatgcaattctaaacagtgttagcatgaaaatattcctcccctagaaattattttgttgatctaagagtactgaattgctacagttacttttgcattgtaataatatatctgtaagcttcaaatcagcatattatattctacatggacgttaactcagagaaccaagagttgcacagggactgccagcacactcagtgacacacacacgttttgatcgtataataagtgcctaacagggtggaactgggcacagggcatgtctcagacctgtatggtacttttaaaaaaataagttaaaataaacactggggcatggtgatggaaaagatgaaaaaacagaacgtaagttatttcaatgttgtcactcggtgtggccacttggagtttatatttgcattttactgttgcatttgaaaattgttaaagtgaaagtgacaagtgcaagacacactctttttgtttggtaaatatacatttcagtccacacatgagaatagttattgaatgttagaagtatcttttaaaatgaaatgtatgttttttcctatcttttggttttaaaagtgaaagaaaaagaaattttagaaaatttaaccttatgttacttactagtataatttagtggttgcctaaattgtactgtttgcatacgtttcagttttattaaagatcacttattggctgttgtcagtaaagagaggatgttaaaaatgatgtgttctgagtgtcaaatccataggtgtactctgtgatcctcttttccgatcagttccccgagtgtcagtaggaaatctaaacagctaaggaccaagcacaggaggagatataaccaatggacttttaactgaggggacacggtttgcatattttttttatttttattttttattttttgagacagagtctcactctgtcacccaggctggagtgcagtggtgcaatcttgtctcactgcaatctccgcctcccggattcaagtaattctcctgcctcagcctcctgactagctgggattacaggcttccgccaccacacccagctaatttttgtattttttagtagagatggggtttcaccatcttggccaggctggtctcgaactcctgacctcctgatccacccatctcagcctcccaaagtgctgggattacaggcgtgagccatggtgcctggccggtttgcatatttgtaacggtgtctttagcacctgcccgtcatctttcctaaacttggtctgcttgagaacacaccttgcttgccatgtcgtttataggataattttccatgaatggaattatttgaatctcaaagattttgtcaaaaaatatattcaaagcttgggtgtaatagacattacacctgaaattacatcctttgcggttatctcaatgtactttaaaatgtttagacattatgctaaaaatatgttaaaagggggcgtcattttttcaatttctcttagggatcacacaaggaagaaaagtttttcaagactgctgatgtaaaatagtgttatcagacagtgttcacatttggagggattgttggtagccaagtctccttggtgtttcttgtgaaagaattcttgagaaagaaatatcaggcaattggggtatattccttaaacatatagtagggaatggggctggtgaatcagttctgaatgcctgttttcttctttaaaattccagccaatgatatgaagcccaggtatgtgggggccttttgatgacagtgagggtgagactaaggaagctgacctgccctgcccagggacacaaggctggctagcaacagagccaggacattagtcagtgtgtctggctctgaagcccccatgggggacactgtctcccatctcctttctcctgtgtttagccttgactttcaccttcaatgtcatgccagacaaagagttgctatggggcaagtgggaaaggcaaaactttttctgaactgctctttaatttgtcaatatagcccaaatctagttgcaatctggtacacttttagtcatgaacgagggtggaagaaagctaatatcacatgttgacctttcattttgccaccaagaagctctccttgaatattctgaaggagaacacgttcttgctgggggctggataaaccttaaaaatttcatgcccctgaatgagcatttcccctcatcacggacttgtccctggggctttcttaggcatgggcaggatgtggattgaaggaagaaacccagtgtcatgggcagcaaaggttgaatgtcttctgtgtctagtcctaacactgacttggagcccattcctcatcattttatcttactttctcccatctgaaaatatttacaaaatcatgtttgatgtcaaaatactaaatactatttggggggccgggtgtggtggctcacatctgtaatcctagcaatttgggaggctgaggcgggcagactgccagagctcaggagttcgagaccagcctggacaacacggtgaaaccctctctctactaaaatacaaaaaattagccaggcatggttttgcatgcttgtagtcccagttactcaggaggctgaggcaggagaatcacttgaaccctgaaggcggatgttgcagtgagccaagattgtgccactgcactccagcctgagcgacagagcgagactccatctcaaaataataataatagtatttggaggattttcccagagcatttgggaagcatttgtacacaaatgagtctgtgagcaaagggccaaggcaaggggcaggagctcagatgcaggctgtgttgatggggctcaaatccagagccccatgatccctatcccgtgctccactgcaccatcctattatcctattttgcattttatttttacattcctataaataaaaagtgcaatcaaataacttgaaatatggtattgcttttgtgcttaaaaataatctcagaaatacagcaaacatgccattcacttgaaattctaaaaaagggcaaaactatgttgacagaaaacagatcaatgatttcctggggtgctgggggtagcagtgggtaggaagagaattagctgtgaaagggcacttggaaactttttcagatgagagaactgctgtatcctgatggtgagggtggtttacacagctgtatacggttaccaacactcatcaaactgtgtgcttaaaacactgactatgcaatacctttatgcttatgtctttttataatttaaatagggagaaaaaatatgtattttgtaatatacatattaatacacattataagatatatataaatatcaataaataataccttatttggaaatagggtttttgcagatgtatataattaggcccaccctaaatccaatggctggtttccttataaaaaaaagggagagggggctgggcgcggtggctggcgcgcctaatcccagcactttgggaggccaaggtgggcggatcaccaggtcaggagatggagaccatcctggctaacacagcaaaaccccatctctactaaaaatacaaaaaattagccaggtatggtggcgggcgcctgtagtcccagctacctgggaggctgaggcaggagaatggcgtgaacccaggaggcagagcttgcagtgagccgagatcgcaccactggactccagcctgggtgacagagcgagactccatctcaaacaaaaaaaaaaaaggagagggatatttgagatacacagacacagagttatatattgtacattttacaaagaaaaaaatgtacatatatatgtatacctatatacgtatgacatccctttctattctgtcttccacaaatgtgagtataagtcttcacagtgggaagtaggaatgatcagagatggagtattagtttgccagcactgccgtaacaaggtcccacagaccagatggtttaaacaacaggaatttattatctcacagttctggaggctcagaatccaagatcatggtgggggcagggttggtttcttcggagacttctctccttggcttgtagatggccgccttctcactgagtctccacatcctcttccttctgtgtgtgtctgcatccaaacttcctcttcttgtggggacaccagtcatactggattcaggcataccctgatgacctcattttaacttattttcttctttgaggaccctatctctaaatccagtcacattctgaggtacatgggattaggactccacatatgaatttttggggggacacaattccacccataacagatggagaatagtgcttgaggtctttactaatttactcaccttggctctatttgaggttttctgccaggagcaggtattttataatttaaagtatacatatgggaaaacacacacacatacacatatatatatacacatatacacatatatatacacatatgtgtgtgcatatttcaaacaaggcagagatcatctgtgacccaaatatgtgctgatgagatcaatggactgtgctacttattggtcccataacatatcacttgtaacctctatctatgaccttccacgtcagtgcaataactaatacagccatcatacacagctgtgcaagagttaacattttattcttctgtgactgaacttctgtttcgagtcccccttttctcagagttgcatctcagttggtggggctgggggtgtctgtggtctcaggcagggaaggcaggcagctcttctggacctggccagagtacatggtcatttctccaggatggtctcccttagacagcctcattccctacctggccactcacatgtgttattgctgcaccctctgtcctgaccctcaggcttcttaagtttgactctgaagccgcactctctgggtttgaatcccagctctactcactatgggctctgtaccttggccacttcactttactttacttctttgtgctttgattacctcatctataaattagagctattcataatagtatctacttcatgtggctgttgggaggattaaatgagttagtatgtgaaaacatttgaaagcgtgtctgccccatagtaaaagctgtatactgtaagtgattcccattattagtagtagtagtagtattgttactgtgatgtcacatgcctcattggtgttttattttggggagcacataaagtactccatttgcctctcttagctgcaagagagaaattctcctgggttgtctcgggtccatgtgctggacccatatttctgctcctgcatcatgctgggaatacagattgtggagctggggtgcagggaggtgtatgactttgccagcttcctgtatttcccttgagaagtggagcggtgctaattgtccctgtcccggatgttccatcaactgtgtggtcccataccaacccctcaggggtgtctgcccaacccccaccccagctttctttccttctttacttagcatctactcctcaggagactgctttgcccagtatgccctaagataataaatgaccttctgagagtcaaatgccaggactcactcttggtctgtttgtcctcacccggctgctcccttgggggtaggccaggacacacactgggtgagaagcgtggtggaggaaaattatctgagttaatttatcaaaatacattattccccagtgacactagggaaaccttacagaggccccgccagcatcaaagagcaaggttctgtttcccatgttccgttacccgatccccagggcctgaaacagagtccagggaatatttggaaactaatcgtcatgagtggtagcatcctaagcagtaccattgtttacctcctaagatcccccaataattgtggttggctatttgttttctagtcatttagacacacacacaaaaattgtttttcaaatgagaaggggaatccacaacaaaaaactgtggctagcttattttcgagtttgaatgctttgtgtaaattaataaagttgaagtctatcccatgtgtataaaaatcttggagttatgttcattaatgagtctattgaattagttttcataaattcttctgattcaattgcatattcttaaattaacaacaaaagtccaacttgtatcattaaagactcaaaacagatggtgggaacagtaaagtgtaggaaagtgggaaaaatccttaaaaaataaacggttctttaaaataaatgaataccaaataaaacagaaaagtataaagagctatagttctttttttttttttttttttttaactgagacagagtctcgctctgtcacccaggatggagtgcagtggtgcgatctcagctcactgcaacctccgcttcccgggttgaagcgattttcctgtctcagcctcctgagtagctgggattacagatgcatgccaccacgcccagttaatttttgtatttttagtagagacggggttttgccatgttggccaggctggtcttgaactcctgacctcaggtgatctgcccacctcggcctcccaaagtgctgggattacaggcatgagccactgcacccggccgggagccatagttcttggtggaaagcaaagcttttcacatcagctagtgtagtgtctgaaaaagtcctcattatagatgggacaaaaagatttagtgggaagaagaaagagaacattgagacagttatgaaaagttttaattgtaaattttaattctcatgtgaaatgaaaattttgggatactttcacacacacacacacaaatgttatcctcagattaaaatatttatgtgggaaatgtttagaggtaaaatgtttagaggggaaaaaaccacttaccatgattgctgccagaaagggtaaaccttagaatcataatactgcagaatttaatgatcctttgtgagcttctggttcaacactcgttttacaagcaaagaaatggaggctcagagagattggttaggtgagccctgcaaggactcatggctaaatagtggtgaaatcagaagctaaagccaggttttctggcttttattccaggactgagatgtagtgacctgactctcgtaagtttctggcttcttccttttggagccacaggtaagcaccagtctagaaccttccactcagacttcatgctccagggttgtgaccagagcttacaagggtgttgtcctgggctggaagcagagactgtgaaactcaaatatacttaggcaaatgcaagcatatgaataaatcaccgaaatcaggacaaacagcttttcttagataaattgcccttggaaagaaaggtgaaaactaagccataatgcatgaatgtgttaattgtttttctcttctacagacactaatttattctgaagggaatgcttcatttccaaattctccttctactttaaagaaattcaaacttcaagaaaaaaattcaacaccatattgtgattgcttcaatagttaagaatttcggctgtcacgactgaaaaaaatcattagcaaaaactggccgtggaaaagggaagtctgtctagttcatgacaagcatccatcatcgtatgtgagttagtaatttctcacctctcatttgagagaggcaaggtacctgtgtgccattggggtgggctttccccgcagtgacagatccggatagatcaccagcctggctaagctccaagccttaaattcctttacttctcacccctgggccatttccgccacttttcctccatctcctttatccatttaacatctgttacatatatgtatatacacacacactttaagttctagggtacacatgcacaacgtgcaggtttgttacataggtttatatgtgccatgttggtttgctgcacccatcaactcgtcatttacattagttatttctcttaatactatctctcccctaggcctccaccccctgacaggccctggtgtgtgatgttcccctctctgtgtccttctgttctcattgttcaactcccacttatgagtgagaacatgcggtgtttcgttttctgtccttgtgatagtttgctgagaatgttagtttccagcttcatccatgtccctgcaaagggaatgaactcatccttttttatggctgcatagtattccatggtgtatatgtgccacattttctttatccagtctattattgacgtttaacatcttttatttatttttatgttttactttttgagacagggtctctgtcacccagactggagtacagtggtgcaatctcggctcactgtagcctctgtctcctaggttcaagtgattcttgtgcctcagcctctccagaggagactttgacaaatatatatatacacatacatacacaaatatatatatatatatttgtcacaaggatttgaccttatgcaattatgtttgctggttaagcagcctctgtgaggctgttgtctttacatctgaccatgagatgttggagcttgaagtccaagaggcaggtggtcagcagaggaagatggatatgaagtcgggagagcagggatgggctgggacccacaggcacacacagaacccatgaagacccaccggaactcaggtcagttatcgctgcctctctgggtgctatagttgtcctacaggatatgccggctcccatcatcacagacatacacacgcacctggcccaagagtcacagaagctgaaggaaaattcagggaaggtagagcagttgtgacttggctactgccccacccagcaacatgagccacagataaaacaggtgtgagctacagaatggctgccgcttccctgcctcctctgaatctcacatgtaagcatctcttgtggcccactctaacaagaaacattcaggaaaggagatctgggggagggggagcctctccaagctgacactttgcaagccacccagtctacaatgtggagaatggttgcaaagccttccacacttcttcctgccaatcctcaccctggtctccagggtcaagtgtgcactttctggggatgcagcctctccaccccacacacaagttgtaccgggaaaaactgagatttccagcaggcagagattgagaagcagcagctaataacattacaaggccatttggcagcagcgcaaaccttcaccattacaattagagcaagtggaggtaaaagagactctcttaatggccaaatcaaataaaaagtgacaggcttctgaagattatgttgaaccctgtatggcatgttaatgaaacaaagggtcagataccatttcatctgtggcttatctgcttagatagaagggatgtttttctgcctagtcctacctgaggatttccaagccacccctatgcatgaagatctgacacatttttgtccgcacttttctcagagtgttggggaaccaggactgagccagcagcgaaatattctgtgatgtaaggtggaatttagaataaaggtattttggtgatcaagcagctcaatggtccttaaccttgactgtaaccttgactgaatcacatgcaaagctttatagcctttctgatgtccaagctgcccagagatttttagggtgcacccaaggcatcaccagttagtaacgcatcccaggtgattccaaggtacaaccagagtctagaaccagggatctagtctaatccttttttcagataatgaagctaagtcatagagaagttaggtgtgttggccagtagtaaatacaaacagtagaacccaagtctcccaactcttaaacttatcaccttccactatatgccctgccatatctgctattgagaagagtgagaaacacacattaaaactgcatactctactgtgttccaagaatgggatgactttgaaatgcatgctatttgtagaatataggtagtgagactgatgcctggtcattcgcctacagccttaacacctcctggaagtctgattctttcagtttaccttgcccatagtgtgagacagagaaggaaaatagacgagtctcagaatgcattgttcagtggaatgcattttggaatgatcctacaaattacaggaaagctttaatcgccaataattaggtgtcttaaaaatggagttgtcttctggcgtatgctgacattatcagtccaagatagacttgagccaggagcctctgtgacagtatgctttagaaagagtgagagagggagcatgtgtaagctaagaaaacctttgtaaataagcaaagtcttattcaacctacagtctgtcctcagagctatcatttatcaggggaacccacccctgataattcaacatgagtccttttctattttccgtaagcgtcggccggtctgagaaacaaagggaaagagtacaaagagataaatttttaaagctgggtgtccgggggagacatcacatgtcggcaggttctgtgatgccccctaagccacaaaaccagcaggtttttactagtgattttcaaaaggggagggagtgtacaaatatggtgtgggtcacagagatcacatgcttcacaaggtaataaaatatgacaaggcaaatggaggtggggcgagatcacaggcccggggcgaaattaaaattgctaatgaagtttcaggcacgctttgtcattgataacatcttatcaaccgtaaaagacagacattcctagagcggccattttagagacctcccactaagaatgcactctctttctcagggatgttccttgctgagaaaaagacttcagcaatatttctcctatttgctcttgaaagaagagaaagatggctctgttccgcctggctctcaggctaccagacctaatggttatctcccttgttccttgaacattgctgttatcctgttcttttttcaaggtgcccagatttcctattgtttaaacaatttgtgcagttaacgcaatcattacagggtcctgaggtgacatacatcctcagcttacgaagatgacaggattaagagattaaagtaaagacaggcgtaagaaatcacaagaatattgattggggaagtgataagtgtccatgaaatcttcacagtttatgttcagagattgcagtaaagacaggcataagaaattataaaagtattaatttggggaactaattagcgtccatgaaatcttcacaatttatgttctgccatggcttcaaccggtccctccgtttggggtccctgacttcctgcaacaataattatttattttaaaagaaacaaaatcaaattattagacatttcaatctgtggtagtaacatgatattctggcatctactttcattatcacctttattaaaataaatttaaagaaaaatggcagtatgtttctgtgaagaccacgagtactcattttaaaggactcaagagttgcagaaaagtaaaaagaaaagagtaaaatcattttctaaatctcaccttccagaaataacgatgttgagcattaagtggacttcatttcatactctttcaaagattatgtaggcatatatatgtgtgtgtatatacatatatatggatacatccttagagaagttggctggctagatagacacactataaaaatggaatcatactctaatgccatttttaatttaaaaaatacatattcagatccactgtacttatatacagaagtaaatgaaactaaagtaacacgagaggaattctgaccctcatataattttttttactatccaacataattattttttttattatactttaagttttagggtacatgtgcacaacatgcaggtttgttacatatgtatacatgtgccatgttggtgtgctgcacccattaactcgtcatttaacattaggtatatctcctaatgctatccctccccttccccccaccccacaacaggccccggtgtgtgatgttccccgtcctgtgtccatgtgttctcattgttcaattcccacctatgagtgagaacatgtggtgtttggtttttttcccttgcgatagtttgctgagaatgatggtttccagcttcatccatgtccctacaaaggacatgaactcatccttttttatggctgcatagtattccatggtgtatatgtgccacattttcttaatccagtctatcattgttggacatttggcttggttccaagtctttgctattgtgaatagtgccgcaataaacatacgtgagcatgtgtctttatggcagcatgatttataatcctttgggtatatacccagtaatgggatggctgggtcaaatgatatttccagttctagatccctgaggaatcgccacaccaacttccacaatggttgaactagtttacagtcccaccaacagtgtaaaagcattcctatttctccacatcctctccagcacctgttgtttcctgactttttaatgattttcattctaactggtgtgagatggatggtatctcattgtggttttgatttgcatttctctgatggccagtgatgatgagcatttttcccatgtgttttttggctgcataaatgtcttcttttgagaagtgtctgttcatatccttcacccactttttgatggggttgtttgtttttttcctgtaaatttgttggagttcattgtagattctggatattagccctagccctttgtcagatgagtaggttgcaaaaattttcttccattctgtaggttgcctgttcactctgatggtggtttcttttgctgtgcagaagctctttagtctgattagatcccatttgtcaattttggcttttgttgccattgcttttggtgttttagacatgaagtccttgcccacgcctatgtcctgaatggtattgcctaggttttcttgtagggtttttatggttttaggtctaacatgtaagtctttaatccatcttgaattaatttttgtataaggtgtaaggaagggatccagtttcagctttctacatatgtctagccagttttcccaacaccatttattaaatagggaatcctttccccatttcttctttttgtcaggtttgtcaaagatcagatagttgtagatgtgcggcattatttctaagagctctgtccttttccattggtctatatctctgttttggtaccagtaccatgctgttttggttactgtggccttgtagtatagttagaagtcaggtagcatgatgcctccagctttgttcttttggcttaggattgacttggcaatgcgggctctttttttggttccatatgaaccttaaagtagttttttccaattctgtgaagaaagtcattggtagcttgatggggatggcattgaatctataaattaccttgggcataaattaccttggccattttcacgatatcgattcttcctagccttgagcatggaatgttcttccatttgtatcctcttttatttcatttagtagtggtttgtagttctccttggagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgagacgatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgcccgtttccaaagggaatgcttccagtttttgtccattcagtatgatattggctgtgggtttgtcatacatagctcttattattttgagatacatcccatcaatacctaatttattgagagttttttagcatgaagcgttgttgaattttgtcaaaggccttttctacatcttttgagataatcatgtggtttttgtctttggttctgtttatatgctggattacgtttattgattttcgtatgttgaaccagccttgcatcccagggatgaagcccacttgattatggtggataagctttttgatgtgctgctggattcggtttgccagtattttaccgagaatttttgcatcggtgttcatcaaggatattggtctaatattctctttttatgtggtgtctctgccaggctttggtatcaggatgacgctggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgcctcaatttgagagcctgttattggtctattcagagattcaacttcttcctggtttagtcttgggagagtgtatgtgttgaggaatttatccatttcttcttgattttctagtttatttgcatagaggtgtttatagtattctctgatggtagtttgtatttctgtgggatcagtggtgatatcccctttatcattttttattacatctatttgattcttctctcttttcttctttattagtcttgctagtggtctatcaattttgttgatcttttcaaaaaaccagctcctggattcattgattttttgaagagttttttgtgtctctatttccttcagttctgttctgatcttagtcatttcttgccttctgctagcttttgaatgtgtttgctcttgcttctctagttcttttaattgtgatgttagggtgtcaattttagacctttcatgctttctcttgtgggcatttagtgctataaatttccctctacacactgctttgaatgtgtcccagagattctggtatgttgtgtttttgttcttgttggtttcaaaaaacatctttatttctcccttcatttcgttatgtacccagtagccattcagcagcaggttgttcagtttccatgtagttgagcggttttgagtgaatttcttaatcctgagttctagtttgattgcactgtggtgtgagagacagtttgttataatttctattcttttacatttgctgaggagtgctttacttccaactatgtggtcaattttggaataggtgtggtgtggtgctgaaaagaatgtatattctgttgatttggggtggagagttctgtagatgtctattaggtccgcttggtgcagacctgagttcaattcctggatatccttgttaactttctgtctcgttgatctgtctaatgttgacagtggggtgttaaagtctcccaagtctctttgtaggtcactaagggcttgctttatgaatctgggtgctcctgtattgggtgcatatatatttaggatagttagttcttcttgttgtattgatcccctttaccattatgtaatggccttctttgtctcttttgatctttgttgatttaaagtctgttttatctgagactaggattgcaacccctgcctttttttgttttccatttgcttggtagatcttcctccatccctttattttgagcctatgtgtgtctctgcacgtgagatgggtttcctgaatacagcacactgctgggtcttgactctatccaatttgccagtctgtgtcttttaattagagcatttggcccatttacatttaaggttagtattgttatgtgtgaatttgatcctgtccttatgatgttagctggttattttgctcgttagttgatgcagtttcttcctagcatcaatggtctttacaatttggcatgtttttgcagtggctggtaccagttgttcctttccatgtttagtgcttccttcaggagctcttttagggcaggcctggtggtgacaaaatctctcagcatttgcttgtctgtaaagtattttatttctccttcacttatgaagcttagtttgaaatgaatgaaatgaagcatgaagagaagtttagagaaaaaagaataaaaagaaacaaacaaagcctccaagaaatatgggactatgtgtaaagcccaaatctacatctaattgatgtacctgaaagtgactgggagaatggaaccaagttggaaaacactctgcaggatattatccaagagaacttccccaatctagcaaggcaggccaacattcaaattcaggcaatacagagaatgccacaaagatactcctcaagaagagcaactccaagacacatcattgtctgattcaccgaagttgaaatgaaggaaaaaatgttaaggcagccagagagaaaggtcgggttacccacaaagggaagcccatcagactaacagctgatctcttggcagaaactctctaagccagaagagagtgggggccaatattcaacattcttaaagaaaagaattttcaacatactgattttttacagatgccttatcaaaagagattatgaaagctattggaattgtaatacttttattaattaatggttcacttttatatagtatcagtgaacttcgagcaatgaaagaagatgattttaatgcttccttcatttctctatcacccacctcctgatttttatagatcattatcattcattcattcaaccagtgtttatttagagaatactttgtgtaaggcaccttcaaggtgctgagcctagagctataagctatcgatggaacagacaagattctcacacataatggggcttgcattttaatagaaagaaaaaataaatcactattttgacattgcgctgattctgttcagtaaccataagcctcataattgttcagtattgtttctatatttgaattctttctatgcatatacataagtagaagtctggcagactagagagatagccagactcacttttataaaaatgggatgatactataaattcacttccgtcgctgacagcccatcctccacctaccttcttatctctgatcctccctagcagccctatccaggtttccctggttagaaggagaagctcggtcttttccagattcacagggaaaggttcccaagcaggaggagtgaggaggagccaggtggcagggccaggccaggccaagcctttctccactgcttctctgcagaatttccttggctgctggttttggaagtgtgtgacattaggttatgtccatttccttggttggtggctgctgataaaaattttgactggtttcactattttgatgctataattcttcatttttttttaggcattgctaagttagataaatcttatgttcagtcttttctatcttatctttaccccaagtctacctccttaaaatacttttatgagcacaaatccctgatgtaaaatcaagccataatgtgtttcctggagtaggggcggacaaatatgttaactaaattctttttgcgtgcttcatgttggatcaattcttaaggaataattttgactgagcctcttttaagcttttccaggcctggcttgttttcctgaaaagcttcaaagcagagaggagaatctttgtcagttagctgggtgagtggttcacaagcctcactgttgtgacacactccgtcatttgtgagggcatcacagccattttgttaatagaaatacagagccaaaagtcaaacatgattttatatgtgtgagatgttgcccgagggaaagggcaaagaatgagaagagctggactgggcaactctcatgtgaccccaggtccctttcaaagttgagtttctctagcaagtttgggatttccaaatgtttctactgagaaaaaaaaaaaaaggaaacgtgcaattaaattagaaaactacacagctcttactgaagagctgaaattttaaaaagatgcttaaaataaagcaaggaagataaggagaaagaaacataaagcatccaaacctgaaagaataacattcagataggctaacactcagaaaagattggagtcttgccaaacatcctgaggtcagccgccaccacagcaaaaagactgtttgatttggagtgacaagaaagatgatgtgatctcagaggaaacagatggctcactaaagatatttgaggatattttaataaaaagaagattttaaaaggtgtgagtaggatacagggaaagtgacaaaagatggagcaagttggaacctgatgggagtaatctggggggaaggaacccatagcagaagtggtggctctcaatggtggagcccagccaatccgtgggatcgggcaggaagggagctgacccactgtctgctccacgacctcctggtgctgcctccccttggctgaacccagccagaaggcaaagagagacccattggtccattccgtccaagatctctctcagggctcagagcagcgtacagaaaggtagtgtttctggaggaacaaatagaagatatccagcagtaagggcaaggaggcacagaagtacttcctgcttcaaggggttgagtggctatggtagttgatgttgagaaggcagatgaagtaaaagcaacttcgcatatatctttcctatcaaagacaatggtctaactggaaagaaaacaataaacagggttgtgactaaaaactgggcaaatgatctaaacagacatttctcaaaagtaaacatacaaatggccaagaggtatatgaaaaaaatgttcaacatcaccatcatcagggaaatgcaaataaaaaccacagtgagatattatctcaccccagttagaacggctatgatcaaaaagacaaaaaataacaaatgctgacaaggatgcaaaaaaaacccacttatactgtgttggtaggaacgtaagttagtacagccactatggagaatagtatggcggttcctccaaaaaactaaaatagaactaccatacaacccagcaatcctactactaggtttctgtattgttttgttttatattttttgtttttttggttttttttttttttttttttttttgagaaggagtcttgctctgttgcctagtctagagtgcaatggcatgatcttggctcactgcaacctccatctcctgggttcaagtgattctcctgcctcaacctccccagtagctgggattacaggtgtgtgccaccacacccagctaatctttttagttgagatggggtttcgccatgttagccaggctggtcttgaacccctgatctcaagtcatctgcccactttggcctcccaaagtgctaggattacagataagagctaccatgcccagccccattactaggcatttatccaaaggaaaggaaaccagcatatcagaggaatacctgcaccccatgtttatcacagcactattcacaatcgctaagatattgaatcaacctaagtgtccatcgacagatgaatggataaagaaagtgtggtatatttatacaatggaatactattcagccatttaaaaataaaactctgtcattcatggcaacatggatgagcctggaggacattacgttaagtgaagtaacccaggcacagaaagacaaataccatatgatctcattcacatacagaagctgaaaaacagttgatctcatagaagtagagagtacaattgtagttattagaaactgagaagggtaggaggggaggagatggagaggttggttcaaggttacaaaattatagccagatcagaggaatatgttctagtgttctatagcactgttgggtgactacagttaaaaatttttgtatattttcaaatagctagaatagaagattttgaatgttcccaacgtaaagaattgaaaactctttgaggtgatggatgtgttaattaccgtgatttatcattacacattgtatctatcaaaataccactctataccctataaagatgtataattattatgttcaattaaaaataatgtaaggaataaacaatattgaaagcaaaagaaaaaatcccaaagtggtcaaagcaataagccaatacttaactcctttaagcccatctgcaggcctaaatgaatcttacctgagagtgctgaaagaaaattatgtttaatttccagaaagggtcaaaagagtacattattgaacctgtaataaagttactgaaattaaaaggaatgttaaagatctcaggtttcttgatttcaggaagctatttgatggagcctttcaaagtttggttggtaatgaatatgctggagaaacaccggccatacaagaaggtttccctgacctgggatggacagtcatgcacagtgtttactagtgttgctcgcatggcatgaggaggaaagggcacaggacccttctttttgacccactcctattcaagtttctatgaaggtcttgaatgaagataggaggtgtaggtcaaagtcgtggttatgactgtttcaaagtcagaaaggagaatcggttctgtggatcttacaagctcctttaagatgcctcaggctatgaagctgtgggagagctggaaattctggatggatgggataatatttcctgaagcttgagggaaggtgtttgctgaagtttgtccaatgtgctctgtatgaagccagaacccaatgtcccatctgccttgttccagcactgcctcggattccagatcctgagaaccaccctttaccccagggaaacccctgatgccaccttctctgctgccaaccattatgtggtgtgagctgtccccaggttgcaagtctctgccagcagccctgcatgcttcaagactctctgtgtggccccacagggcaagcacaacaaagaggtcaaatgacagaatttcaaaagatttcaactgatgaaccaaattaaaggacatgttaggtattggaattttccaatttacagagctagtttgtcctagcattggccagaatgaaggctgaaagagtggcagggctgccaccatggttactgcagcaggtggaattcgagtgcctgaattgagggaagtgggggtcctcctgcatcccgagatagcgagagcacctcagaagtgctggcttaggtggtggcacccactgtaagagaacgatgacaaatctcagtttctccctaggagagtgcccagcagggtgatgagccaggaagatctgtcaggatgaagagtagtgagaggaagggggaaccctggagaagagaagaacttaaagggattcacaagaagttgaggagggcagagctgaatgagacaaggttgcagggaaacagactttttaagatcagtgtaagggaaaaaaaaatccttgacaatcagaattgtttcaaaacagagtcagcagcttcttgagactgggtcgctgtgctaagaacgtaaagggggagctgggtggcaccagcaaagtggcaggaatgtgtccctgcagggtctttgctgccttccgaatcctctcctttgtgatcctgtaatttgtgagagagcctggagggtagcatggaaaagagagaggagaggacctgacagcagtatttccatcttgtcccctaacaattgcctaggcagtctcctctcagcagggaagcaaactggtcaccaaataataataattatccccctacatttccttaattatttaaacttctgaaaggacatcaaacacagcaaagagtcaatgacttgctttcagaagtgattcagactgtagctccacccataacagtgtcaccttgagcagtcacatatgccttaacatccttctttctaaagcaattccatcttcccaggttgattgttgagcgtttagacatgatgacatatataatctttatatatgtatatttacaagtatatgtttatggataaattttgactgcctgtaacccatgtggccttgtgtcatcacacataagttcactgaagctcccaacaaccagacttttggggaagtacaaacctccacattagcactaggtctccttgcctgcccctctgctggaagaatccctggcaggggccttctttggtgatgggattgaattttctatttcctgaaatgtaatcagctttcagtttcaatggtggtcacccccttgtaccttcttttaaagattggaacgctgtattggtttctcagggctgctgtggtcttcatagaagatgacccgcgtatttccaaggtttcctccaggattgctggggctgtctgcgtccagatgttaaggttactgtagacaataaatgggagagggtgaaggaaggaggatgtttagagaaaattatccagtcacctggaggaaaggctcttagctgcaaaagaggaaataagggccaggcacagtggctcatgcctgtaatcccagcactttgggaggccgaggcaggcagatcatgaggtcaggagatcaagaccatcctggccaacatagtgaaacccatctctactaaaaatacaaaaatcagccgggcgcagtggcacacgcctgtagtcccagctacttgggaggctgaggcaggagaattgcttgaacccgggaggcagaggttgcagtgagatgagatcgtgccactgcactgcagcctggtgacagagtgagactccatctcaaaaaaaaaaataagaaactgctatttagcacaacatcaaataagcagtttgttgcttatgtctgaacacttctgtgaaaacaggcaaaggcagtcgtgtgtaggttctggtgaccaggaactggagctgcacagaggtgtagaggctcccaaagctcgtcaattgtttatgaagggagtaaaggctggaagtcagggggtgggtgtcagtttctgccactagctaccagatttctcctaaagatgggaaagctccctttatagagctggagtgcaattttgtgttttctttgtgtttggcaatgtctgttactgacttgcaatagatatgcaacagtataggtatgttcatcttagtattttggggacaaaactcccaaaccagccaccacacaaatgtatttataggtaccagtaggcacctttggactcggagggaagtcagcctccttaaagccgtattcagtaaggagaatgaagggtaggcatggctgcagcttgggttgtgcccaccatgtggatatccagccatgatctcaatagtcaggttggtccacattgtccagatatctccatgtaacattaactcagactttatgaaaataaccggtgagaataaccaaagccacattgggtaatgaaaactgtatgtacaattttctttagttacattgatgttgttacatactgttcataattaattacattggtttgtaatgtatcatgtcctattgtattgtaggttctaataccaagaccctaggtgttcctctcttaaaagctggtgaccacctttaactcatgtggtaaaagaatgatagttctgggaggatctgcattctctctgtgtccatgcagcattgccccacactgcctgtgctgagctgcatgatcctcatagctacatcatagtctttgcttgtaggcttgtcgtttggagaaccgtcttggagtctttattggttgatgtcaatggaaagctctgcttccctctggatgtcctatggtattgctgttcctaatgtctttctaatgagtgctacgtgtctgtatgtgtgtataaagagatttatgtaaagaattggctcatgtgattacggaggctgagaaaccccaagatctgcatttgccactaagtactcagatatttggtcaaacatgattgtgagtgctgttgagtgctgtattttttaactgccacgtaatcccctcaaggtccgtgttattctagacagtaaaccgggagaggcttctaaagccccctttgtcaggaaatgttactttagaatctgaccttgtgtgaaacacagatgacagaacctctctagtgcaatgacattaaaatcctcccccagtacttgaagtgcaagggaaatagctcattgctattatggctggatcatctcatggcctctcaacagatcaagagcaccattactactgttgctttcttgacttgtgttttacttttattctaacatttgttgcagtctgtgttaaatagggaggtagaccaaactatgagaaggagccctatattggaaactgtatagccaactatgaaacctccaggcttactttgctttctcattacaggcggccttcccctctgctccactggagagagtcagagtaattggctcttgctttatatgaaggatatgctcccaaaaaagttgtatttaaatcaagttttaacaaaccgactcatgcttgtttatccacttataacacttactatttaaaggaaatgataaagagtccttttctgttgttacagcgtagttggcaaagctgtatcttctgaagactgacttgcactcagcagttttagatcaactcgagtctgtttatactaagatccacagacccctggtggttctcagatgacttgcaaattctactagtttttccaattgtgtgttttttgatgataacttaaaaattttttatgataatcttttcattgtttagtataataatgtacagataaaccctagatgatcaccttataactgagtgctgtcatgagatttcagtgcctttgttctcagtcctgtaggtaaccaagacttcatctaaaatcacatcacttgactttaaatgtttgcaagacacatctgactgtcattgggttgataaaatctgtcttgtcctcattttgtgttgtgtgggactctatcatcaggtacaaaagcaaaactcctttgccatgagcgttcacagttgaatgacttttttatagaccaagagtttagtttcttagagtatatattgaatcaatttggcatcatggaaatggcatagtacattagaggcacatactatgttaactgtcacaatctaatgataaagaacagaaaaggacatattacataatcggtgcatttctgttaaagtcatggcaagcttattgaactagttttatagcaatttggcaggataaaaatgatgggaggatggagtcatcatagggtgcctgccctgtagcatggacacctgggacacaccttgctggatgatgtcttctttgggttccatcttaatacatgacaactggaaataattctgtagcagaaagtagagtgtaaaatagaaaatgactcttattctgatgaatcaaagtttttaagccatatatgtcggagtacacttgaattacttctgtaaaaactagcacattatataaaaatcataataaaaacagagattccagtgaggggtccctcttgttcagagtcgaaagattcaagtcaacaaaaatggaacctgtaagttagtctttttgccactgttaaaagaaaaacactggacacaatacttttaacagagtttatgtgagcattagaggattcatgaattgggcagcacccagaaccagaaaaggttcagagagctctacccagcagcatgggtagtgagctttaataggcggaacgtggaagtaagacaaagaaaacatatttgatttgttagagtagaaagtccctagttagaggttagttggaggtttctgatggtaacttctctagtttcattttactgttcacattgggctttggtttgcttacctaggaacttaaagtgctgggaatgcttcggcttaatgacctcccaattaaaatttttttaacatcacttttatttatgatctacaaagtggcaactgcctatttttttttaattttattattattatactttaagttttagggtacatgtgcacaatgtgcaggtttgttacatatgtatacatggccatgttggtgtgctgcacccattaactcatcatttagcattaggtatatctctcagtgctatccctcccctctcccccaaccccacaacagtcctcggtgtgtgatgttccccttcctgtgtccatgtgttctcattgttcagttcccacctgtgagtgagaacatgcagcgtttggttttttgttcttgcaatagtttgctgagaatgatggtttccagcttcatccatgtccctacaaagcacatgaactcatccttttttatggctgcatagtattccatgttgtatatgtgccacattttcttaatccagtctatcattgttggacatttggcttggttccaagtctttgctattgtgaatagtgccgcaataaacatacatgtgcatgtgtctttatagcagcatgatttataatcctttgagtatatacccagtaatgggatggctgggtcaaatggtatttctagttctacatccctgaggaatcgccacaccaacttccacaatggttgaactagtttacagtcccaccaacagtgtaaaagtgttcctatttctccacatcctctccagcacctgttgtttcctgactttttaatgattgccattctaactggtgtgggatggatggtatctcattgtggttttgatttgcatttctctgatggccagtgatgatgagcattttttcatgtgttctttggctgcataaatgtcttcttttgagaagtgtctgttcatatcctttgcccacttgttgatggggttgtttgtttttttcttgtaaatttgttggagttcattgtagattctggatattagccctttgtcagatgaataggttgcaaacattttctcccattctgtaggttgcctgttcactctgatggtggtttcttttgctgtgcagaagctctttagtttaattagatcccatttgtcaattttggcttttgttgccattgcttttggtgttttagacatgaagtccttgcccacgcctatgtcctgaatggtattgcctaggttttcttgtagggtttttatggttttaggtctaacatgtaagtctttaatccatcttgaattaatttttgtataaggtgtaaaggagggatccagtttcagctttctacatatggctagccagttttcccagcaccatttattaaatagggaatcctttccccatttcttctttttgtcaggtttgtcaaagatcagatagttgtagatatgcagcattatttctgagggctctgttctgttccattggtctatatctctgttttggtaccagtaccatgctgttttggttactgtagccttgtagtatagtttgaagtcaggtagcgtgatgcctccagctttgttcttttggcttaggattgacttggtaatgcgggctcttttttggttccatatgaactttaaagtagtttttttccaattctgtgaagaaagtcattggtagcttgatggggttggcattgaatctataaatcaccttgggcggtatggccattttcacgatattgattcttcctacccatgagcatggaatgttcttgcatttgtttgtatcctcttttatttcattgagtagtggtttgtagttctccttgaagaggtcattcatatcccttgtcagttggattcctaggtattttattctctttgaagcaattgtgaatgggagttcactcatgatttggctgtttgtctgttattggtgtataagaatgcttgtgatttttgcacattgagtttgtatcctgagactttgctgaagttgcttatcagcttaaggagatttggagctgagatgatggggttttctagatatacaatcatgtcatctgcaaacagggacaatttgacttcctcttttcctaaatgaataccctttatttccttctcctgcctgattgccctggccagaacttccaacactatgttgaataggagtggtgagagagggcatccctgtcttgtgccagttttcaaaggtaatgcttccagtttttgtccattcagtatgatattggctgtgggtttgtcatagatagctcttattattttgagatacatcccatcaatacctaatttattgaaagtttttagcatgaagcgttgttgaattttgtcaaaggccttttctgcatctattgagattatcatgcggtttttgtctttggttctgtttatatgctggattacgtttattgattttcgtatgttgaaccagccttgcctcccagggatgaagcccacctgatcatggtggataagctttttgatgtgttgctggattcggtttgccagtattttaccgagaatttttgcatcagtgttcatcaaggatattggtctaaaattctctttttatgtggtgtctctgccaggctttggtatcaggatgacgctggcctcataaaatgagttaggaaggattccgtctttttctattgactggaatggtttcagaaggaatggtaccagctcctccttgtacctctggtagaattcggctgtgaatccatctggtcctggactttttttggttggtaagctattaattattgcctcaatttgagagcctgttattggtctattcagagattcaacttcttcctggtttagtcttgggagggtgtatgtgtccaggaatttatccatttcttctagattttctatttatttgcatagaggcgtttatagtattctctgatggtagtttgtatttctgtgggatcagtggtgatatcccctttgtcattttttattgcgtctatttgattcttctctcttttcttctttattagtcttggtagcagtctatccattttgttgatcttttcaaaaaaccagctcctggattcatttatttttttgaagggttttttgtgtctctatctccttcagttctcctctgatcttagttatttcttgccttctgctagcttttgaatgtgtttgctcttgcttctctagttcttttaattgtgatgttagggtgtcaattttagacctttcgtgctttctcttgtgggcatttagtgctataaatttccctctacacactgctttgaatgtgtcccagagattctggtatgttgtgtctttgttctctttggtttcaaagaacatctttatgtctgccttcattttgttatgtacccagtagtcattcaggagcaggttgttcagtttccatgtagttgagcagttttgagtgagtttcttaatcctgagttctagtttgattgcactgtggtgtgagagacagtttgttataatttctattcttttacatttgctgaggagtgctttacttccaactatgtggtcaattttgaaataggtgtggtgtggtgctgaaaagaatgtatattctgttgatttggggtggagagttctgtagatgtctattaggtccgcttggtgcagacctgagttcaattcctggatatccttgttaactttctgtctcgttgatctgtctaatgttgacagtggggtgttaaagtctcccattattattgtgtgggagtctaagtctctttgtaggtcactaagggcttgctttatgaatctgggtgctcctgtattaggtgcatatatatttaggatagttagttcttcttgttgaattgatccctttagcattatgtaatagccttctttgtctcttttgatctttgttggtttaaagtctgttttatcagagactaggattgcaacccctgcctttttttgttttccatttgcttggtagatcttcctccatccctttattttgagcctatgtgtgtctctgcacgtgagatgggtttcctgaatacagcacactgctgggtcttgactctatccaatttgccagtctgtgtcttttaattggagcatttagcccatttacatttaaggttaatattgttatgtgtgaatttgatcctgttattatgatgttagctggttgttttgctcattggttgatgcagtttcttcctagccttgatggtctttacaatttggcatgtttttgcagtggctggtactgcggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctggattgaaaattcttttctttaagaatgttgaatattggtccccactctcttctggcttgtagagtttctgctgagagatcagctgttagtctgatgggctttcctttgtgggtaacccgacctttctctctggctgctcttaacattttttccttcatttcaactttggtgaatctgacaattatgtgtcttggagttgctcttctcaaggagtatctttgtggcgttctctgtatttcctgaatttgaatgttggcctgccttgctagattggggaagttctcctggataatatcctgcagagtgttttccaacttggttccattctccctgtcactttcaggtacaccaatcagacgtagatttgggcttttcacatactcccgtatttcttggagactttgtttgtttttattcttttttctctaaacttctcttctcgcttcatttcattcatttcgtctttcattgatgatatcctttcttccagttgatcacatcgactactgaggcttgtgcattcgtcacatagttctcgtgccgtggttttcagctccatcaggtcctttaaggacttctctgcattggttattctagttagtcattcttttaatttcttttcaaggtttttaacttctttgccattggttcgaacttcctcctttagctggtagtttgatcttctgaagcctccttctctcaactcgtcaaagtcattctccgtccagctgtgttccgttgctggtgaggagctgcattcctttggaggaggagaggtgctctgatttttagagtttccattttttctgctctttttttcccccatctttgtggttttatctacctttggtctttgatgatggtgatgtttttggtgtggatgtcctttctgtttgttagtttttcttctatcagtcaggaccctcagctgcaggtctgttggagtttgctggaggtccactccagagcctgtttacctgcgtatcagcagtggtggctgcagaacagcagatattggtgaaccgcaagtgctgctgcctgatcgttcctctggaagttttgtctcaggggagtacctggttgtgtgaggtgtcagtctgcccctactgggggggtgcctcccagttaggctactcgggggtcagggacccacttgaggaggcagtctgcccagactgcgtgctgagagaaccactgctctcttcaaagctgtcagacagggacatttaagtctgcagaggttactgctgccttttgtttgtctgtgccctgcccgcagaggtggaggctgcagaggcaggcaggcctccttgagctgtggtgggttccacccagtttgagcttcctggccactttgtttacctcctaaagcctgggcaatggcgggtgcccctcctccagcctcactgccgccttgcagtttgatctcagactgctgtgctagcaatgagcgaagctccgtgggcataggactctccaagccaggtgcaggatataatctcctggtgtgccatttgttaagcccgttggaaaagggcagtattagggtggaagtgacccaattttctgggttccgtctgtcacccctttctttgactaggaagggaatttcctgaccccttgcgcttcctggatgaggcgatgcctcgccctgctttggctcacgcacggtgcgctgcacccactgtcctgcacccactgtccagcactacccagtgagatgaacccggtacctcagttggaaatgcacaaatcacccatcttctgcgctggtcatgctgggagctgtagactggagctgttcctattcggccatcttggctccacccccccggcaactgcctattgttttacctgatatgcacaacattggccattagtgttaccaaagcaacatccatcacaagaattaatgcttcttgatttgaattttactcctctctgtctctgtttatgtgcattcatttgattgtacacttgtataagaactaaaagcataaaaagtttattcctacatctggcacagctcacgtctgtaatcccagcacttcgggaggccaaggcgggcagatcatgaggtcaggagttcaagaccagcctgaccaacgtggtgaaaccccaactctactaaaaatacaaaaattagccaggtggggtgttgcgtgcctgtaatcccagcttctcaggaggctgaggcaagagaattgcttgaacccgggaggcggaggttgcagtgagccaagatcgcactgcaccccagcctgggtgacagaatgagactctgtctcaaaaaaaaaaaaaaaaaagtttattcctagttttacatttgtagcattgaaattaaaagaatctaaataaataacagagcactgtgagaatttgttgtttaacagagctctatatgcattacacaatttcaaggaacattgatctgaatgttcctatccctcatggaccttgagccctgacaaaagttaataaagatgggtctccttttcttcttgtcccctgctttcagctctgaatgagaaaagttttgcaaatatgtcggtactttgtattaagcctaaaacttataaagtatcagatttgtaagttgactgtattaactttaatttctcaaagtgttctcagttaattaggttaacctaaaactaaaactataaagtgattcctcccctaccaagaaaaaaaaaattaagctgaaatcctctgtttagagtttcaggcctttgggctggactccacaacccttctcaggaagtagcagtagacacctgaccttaggctgtagtgctaatataacctgtgtcagtagctgccccattgcaaacaaggaaatgatcctctgaagtcaaactcaggaaggaacaagaacctgtctctctgagctctctaaagagtgtggttaagagtatgagcattgacaacagactgcctaggttcagataccacctctgatgccagttatgtgattttgggccagtttcttaatctctcaatgtctcaacaacatgagtctaataatagcatatatacccctataaccatggcatgaggattagacaggttgattggtgtgtataaaacacttggaacagggcctggcacagggtatgccttagtagatgttagcactgcatcacgactgctactatgattaccgtccctgtcactgttgctgctgccaccacaggcaggtcagtggaacgtcacccttcagggatttatcagcgccactccctaagcatgccacctgcatgaagggcagacatgaaattgtgccgccagcgttctggtttcttcagcgctccctgccagctgagctgtgtgaaaagcactcagctatgaaaaaatgagaaagattgattgaaatgttggtgaggtcattgtcaaatattctctgtcaactgaatgactgcaaatagggagatgactgcccccccaccaagtcagcctaggagggttcagtccttcatttattcattcacacatcactccttcactgtgccagccagccatgacaattaagtgcatttgggaggaggtggcagctgagctggaaagggggtttggcattatgctgggaaggtgtaaaaagccaggctgaagatttgggccgtctttttttttcccccagatagtggggagctggatttggagacaagaaacctttgtagaccctctggcactctctattgacagatcactgctaggaggcagtgtgactcggagaaccgcatgggctccgccaccagctctgggttccgcactcattagccagatgaccttgggctcattatttagcaagcctgcacttctgtttcctcacctacaaaatatgcataaaatagcagtacatacctcacggagttgttctggggcttaaatgagttcatctgtgcaaacatttagacgaagtgcttgacataatcagagctatgtaggtgctgttaattcttctttgccccactggtccccaggttccatatctgtaacaagaagcaactggaccacataatttcacatccttttatacccaagtttttgatcaagagagctcaggctgtactttaagcttaatgtgacagtgatttatagcatagcttgggggcgatctgaacacttgggggcagaaaaacaagttaggctttccctgtttccatcattctcccacctttcctccatctgcctgtccccacctggacatacatgccaaaagccacggcccattttactagatctaggtagtatgggaaaagaccatgaagcggacacatcatctgtactgccagtgtctctcttcaaaataaactttttttttttttgagcctgaatctcactctgttgcccaggttggagtacaatggcatgatctcaactcactgcaacctccacctcccgggttcaagcaattctcctgcctcagcttcccaagtagctgggataacaggcacctgccactacagccggctaatttttgtatttttagtagagatggggtttcaccatgctagccagactggtctcaaactcctgacctcaagcaatccacttaccttggcctcccaaagtgctaggattacaggcatgagccaccgcgcccggcccgcttcaaaataaacttctttaccaggaaataggattaagaggaggtagaaggaaattagagtaggatcagaaagatagaaaaaggagttttctctgaaacaataggacagccagatacaggctgagcaggcccaatgatggatagagaggcacatccactgctgagctctaacctagagagagaatgtctcaaaactccttgcatggaaggtgcctggaaatgtatttattctcctgttgtttattctcacctctcttcattcctttttctttcttctgtccttgaatcgcagcagataaaaagacaaatctgctgagaggatgcatgtcacaagtggtcagatgaattacagccatagcaccatatagataagaggcaaggctggcgcctgggcaggtctgagagggtccaggaggacacacaccatatcaaattgtgcaatttagcaaatggctggtggcagactgaaatgatagttaatctgttttccatgcactaaaggcttttgccaaactaagatttgctgtgaagacccaaagctggagcccacccagggagcgggctgccttggatgcgtttcccagccttctacagtggatgccagtaaaactaactagagacatgaatgggcaccaggataaacacaaggggatattttgttcttaccattagagaaggatactgctaactggcaagaagtcccatggttgttatcttttgattagtagtagtaaaaatactatttaaagctagtagcattttttgagagcttgctttacactgggtactttttcaagtgtcttacaagtattcgctcattttatctgcacggcagctgtatgaagagaatactgtcattatcttcactgcataggtgagcaatggaggcacagagaagttcagcaacttgtccaagctctcatagctgggaagtggcagagccaggctttgaactcaggcagtctgactcagagtccaagactgccggcctgaattgtaggagagagacagtgcgggtataccaggaaccaaatcctatcggctgaacatcagtgtttaagtcgagcccagatgctctgcacaaaatacaatgtgtctgtgcacatgtgactgttaatcagccatttccttggttcctgctttgtgctggccactgagctggaccctgtgggatggataaatcaatgtcagtcatgcccctggagacctggctgttgcaaaaaggctcctgaaatcatcataacccaaaagagaaaagggcaggtgctgaagagaagtataggtaaagagcagcaaaatcataaaggaggggagactctttgcctctgtggtatcagggaatgcttctcagagcgggtggcgtttgccctgagacttgaagtaggaatttaaaaacatagaaatgcagtggaacgggaagaaggacattctaggtggagagaagtagagcaaaatggtccaatctgcccccctaagggtgtgagacagagaagtggatgggaaggccaggaaggctgtcgccatgtgggccgaacatggggagggaggtgtttgtcagaatcagaatggactcagagggaagctgagctaaaagcttcaatttacagatgaaagaagaaagaatttggatatgtgactcactcagtgtaccaagttcgtggcagaagtaagtctcaaaccccaggcttgcctccaattttctttgcactgatctcctggcataaacatgtggctaacaagggtctcacaatgccaggagggtgttacgtttttataacctgttctatttgagggtctccaaaattacatatttgaagttaatattagccagatgctaactgtctgcaggcaagaataagcacccactttacattgggagaagctagagatttgggaatcaggatttgctgcagatactttgaggaatctaggcctctaatccacagtctcctaaattctggaacttctggcttaattacactttttaataaccagtcatcattgctgcataatttgtgaggtctggtatagtatgattcctgttcccttcagctaaccctgcccccacccccatcctttaataaacgtaaaacttttctttcctgtgaattcatttttttcccttttatcttttggacctttgcaattaacatattaatatttaattcatattacctgaaggtccaagaacacttttaaactcatgaaaaaccttcactagtaatttagctgctaccaaggtatccctgagccctcattatttgcctctggaaaatgccgtaaacgacatctaacaggcttcagctctgtacctctacaaataagaaattaagcagtattcagaacgccattgattattaatttaaaagaaatcaaaaatcaatatcacattcctgtaacctggcagtttttcttaactgaaggcagttgcctgcagaagccttgtggctttccagagcaacggcgccccttcgtggtgataatgtgaactgcaccccaggcgtgattgaaaataaggcagaaaggaatgccggcctcgagcaaggacaccggttcatgcccaaatcacttctgctttcagccaacagactgtttctgccaaaagatggacgcagctagattttttttttttttgtaccgataatctgtcttaaaacttggagaggatctcttttcccctgtgaagtcaggaaaatgacagcaagcagcatggattggttcgaataattttcaccagaaatgtggggtgaggggaagggatgggactggagtcagagcagtgatctggcgggatggggtgatgagccatacggagatgaggtgtggcgccacgggctgggagtcagggattatagagtgagggtggggtaggatcttcctggtcatcaaaactatgagaaatgtaattatttacattttaaactaagccaaagactgtattgaaatgtcttacacccagaacagagaagtggtatcaccaaagttcagaattcccagctctaacgtgatgcctttggggactgcctccccaccccaggctgacctaacacacccctttgagaaaagaggatttagtttctcctgactgtgaattgaatatgtgggatgtgcccctccaggagcttctaaaatcacctctgctttgaccttgaggggccgtggtagaggggagacagcaccggcttagaaaccccacggctcggctctagtcccagcatcagtggagcaccaaggggagaaagtattcatcactgaggtattttatgatatgtatattgttcctgggcagttgcaccccttatcgcctgcaccctgtgtacagctccccattcctcctcccttggaggccactgtgctatgtaacttgctgtgggctgcaagaaagactgggctcccgtttcctcttctgaaaggcaggaatcatgctcccggctgacctcacagaatcattccacagattaaatggcgatatggcttgtctgtgttcacactcaaatccacatgttgtgggagggacctggtgggtggtaattgaatcatgcgggcaggtctttcccatgctgttcttgtgatacagaacaaacctcatgagatatgatggtatcataatggggggaggttcccctgcacaagctctccctttgcctgctgccatctatgtaagacatgacttgcacctccttgccttctgccatgattgtgaggcctccccagccacgtggaactgtaagtccattaaacctctttcttttgtaaattgcccagtcttaggtatgtctttatcagcagcatgaaaatggactaatacaaatgggatgtaaaaataaaattcttatatacttagaacggcaatatgagctttacatctgagttatgctataatatcaatcaacatatataataatataaagtagtatatttattataagttataataacagagtgagatagcttagtaatttcttgttagtatctgcaatcttggggaaaacaaatctagagaaataagtccaaactggagctgcagagtcaagtgggcgagagaaagaagtctcgctttttttgttttccaggaaagctcaggtccagttcagcaggccagcccaagagactgggagagccctatgtactcaggagagcagcctcacccctcgtccttgtccaagattggggagtgggtgcccacagcttgtatgtgtccccatgagagtgggtgtcattatgaggagcatcaaagggccaagcacagtggtgacagatgtgggggaatttgccattctgagggcagaggaggtcaaacacaagtggactcgcttattaagcccagaaagagaactgggagaggaaggccaagtgaggatggaggcggagatccagggcccatctgcaagtcaaggagcaccgaggatgctcagcagcagagccaggagagggcatggagcggactcgcttgcagagcctgtagaaagaaccaactctgccgacactttgatttttaacttctggccttcagaactgggagagaataaatttccattgttttaacccacaaaggaagaaaaagactatcaagagtagaagggcctgacaggtggccacacggcaggtgagtcagagagttgagtcacgtgggaggtagtttagaaaaggatttgtgaagagggccatcccctagcagcgtgttgaatatagtgaggaatatgagatggaaaagaatctttttagagaacatgggtgccagacatagccacagacaaagtcgtgaaatagacagaaatttgtcccatttatggagactgtggttttccacccatatgtccccccaccccatgtcatgtttacctggccctcaggctcacgctgatggccctgggctgcttttttcccctcaaaagctgatgtctggtctctaattataagatacaagatgagatggaaataattgttaacaatgtattcattcaacaatggattgtgtaaaaaaaaatgtggtacacatacaccatggaatactacacagccatgaaaaggataaagtcgtattcttcacagcaacaggaatggagctggaggccattatcctaagcaaattaaagcagaggcacaaaactcaatactatgtgttctcacttataagtgggagctaaacattgggtcctcatggacacgaagataatagtaactgacactgaagactactagagggggtagggtgggagggggacgaggggtgaaaaacaaccagcaggtcctttgctcagtacttgagtgacgggatcatttgtctatcaaacctcagcgacatgcaatttatacatataacaaacctgcacatgtacccccgagcctaaaataaaagtcaaaacaaaatattcattcccaaatcatttactacatacaaatcgttaagtcaggatccctgctgtgacactagggattatagaagtgttgaaagcttcattctcatccagtcattcattcagtgcctggctggggttgtgataagcaaaagcaaacccatccctctccacatgtagcttccagtctcgtggtggcatttcctcagaggatgaagccatccaggtagcatagcaggcatgaggtggttccagtaaatggaggtgggacagtctccttgggctgccaccctgcttggggctattcctggtagggcctggagctctgcctagagaagcccacatgccctctcctggagtcacaagggcaggccaagtattctgtcctattccagtctttgctagaatgtgtcaagtgctgtgggcttgagtccttggcaatttttgcatgggacttagtttgggggtaagttttctggaaacttgaaatgtttcacttaaaaagaaaaatgcaggattcaaagaagtaaagagtaacaaataaatagaggcttttttagttcaggggtcagcaaactgagggcattgcagctgttctggaattaatgcgtgtccgggcaagggtcagtaattctgagatgccgttctgttgctttcaggccttttttggtgaaaactcttaaaggaggtataattcttcccttgctgggagtctttgtttcagaggggttgtaaaaaaagattcccagaggataaatcatatctgtattaacttcctaatgaaatgaaaaattatatcattgctgattattcctccttggctgatatggaaaaaaatactattaatactttttagtgtgattttaatcctttgcattcacggatatttgcattagtattttctggacatcatcttgtttatatggattttattcattgtaagatgccatcagatccaggcatctgagttctgggggggcaatgctataatccctgcccagaaccaaaactttccctgtgcagatggtctttcaatagagtggaatgtgtttggggtttctgcatatttcagtttacaaacccttcagtgatggttgtcttcatcctgagtttggctccatgcttcagaagatgcaacagtgctgagaacggtgcctgacatgcaggaaacattcagtaagtgtttgctgaatgaatgaataaattaattcaacaacagctaatgaaagcacatcccttaaaaagtctcggcaatattgcgagcataataccaaaggcagaaaccataaaagaaagaattgatggattggaaggggaaaatctttttttttgagacagagtctcactgtgtcacccaggctagagtgtagtggtacaatcttgactcactgcaacctccacctcccgagttcaggcaattctcatgcctcagcctcccaagtagctgggactacagatacacattgccacacccagctaatttttgtaattttagtagagacggggtttcaccatgttgcccaggctggtctcaaattcctgacctcaaatgacccacccacctcagcctcccaaagtgctgggattataggcgtgagccaccgcagccggccagaaggggaaaatcttataacatgaatttcagataaactgttacatccttaatacttaacgaattcctgttaatcagtatacaaatattagtacccaaatagaataaataccgatggccaataaatgtattagaaacatttgaatctcacttataaaaacatagttattttcctaaatggggtatcattttttcccaatcagattggcaaaaataaacaagaatacaaatccagcctagcacatgtacgtactttcaaagggaggataatttggttcaacatgttttgaaagctggttgtatggtatgttttgaaaccttgaaaatgacccagaaattttccttctagagatttatcttaaggaaattataggaggcataaaaagtttcacctgcttattgctttgtggcttatcattgcaaaaagaaaatggaaaactacttcttcagctaaaggaagtgatacgctatcgtactagaatattaaaaatgaagaaggtagggaaaagagaaagagaatctaagcggtaaaattgtttgacctttattttcttctttttgcttagctatattttctaaagtttttgttaaaataaactcttttaacaaaaaaattctaaaaactcatagctgcttagatgataatataattataatatttatgttaatttttgttgcgaacgtatgtttatgttgaacttaccaagtgatctaagctatattactaagttcttttcataagcctctgagttcatgtatattaagcccttaacataattcttagagttaagcagagcaggtggcgttattcttccatgaccgcactgagactcagaaaagttacatgacttattcaatatcacataattaataaagagtaagactggccacaaagtccaggatgccacacacatagctgagtgcttcttcctctatcatagaaacaaaaatctggatgaccattaggccgttgttggcctgcaaaggtgtagagcaaactattttatggtattgagagcacttatcttggcattactccatctgattgtttgtgtcaagtaggaaagatacatttattattcccattttgtagatggagaagctgaggctcagagaggttgagtgacattcccaaggttgtacacagtaagtggtaaagttaggatttaaacagttttagtccgaatcccttgctctgtctacttcagtttggcataataaattcttaacttccttaacagtttgtcccatcatattcctaaagttttatgatttgatgaagtctctcttaagctccttttccacatgggtggcatgggttagcaagattttgagggctgatcttgtgtgacagattgtatttccaaagatgtctggaataatatcttgtgtcccacatactgttgtggaactatcacctctccatcccaaaaggtggaacagaagcaacactatgaaactgccaaggctaaatcataaacattcaatgcacttctgccttgctctcttgggatgtttgtgcttagaatccagctgccctgctgtgaggaagcccaagcaactctgtggaaaggaccacatggaaaggaacagaagtgcccagctcacatccctggctgagctcctggccatcagcctaatttgctggccatgtgagtcatcttgaaagtactgtaggttcaaggtttactttctgaggtttcagttatccatggtcaaccgtggcccaaaaataggtgaatatagcacaataagatattgtaagagagagactatataacttttatttacataacttttcttacagtatattgctatgatttttctcttattagttgttgttaatctcttatgactaagttataaataaaactttatcataggtatgtatgtatagaaaaaacatagtatatgtaggattcagtactatccgctgttgtaggtatccactgggagtcttggaacatatcccttgtggataaacagagactactgtagatcctcctgctcctaattagcctaccctaactgatgttgcattgagcaaagtgaggtgagccgaccaacctctgcccaaattgcagatttctgtgtaagataagtgattattctgttgggggtagtttgttatactcattttccctcctaaccccaaattaggtggcagggatggaggagtcttgcttatcatctctctatttttgttaactcctcctcgttcagggtagactttggcacctggatcacaaccttattctccaccccaaacctgccattatccttggtgacaccattatccatgaaggggacccatttgatatgttagcttctcagttccctgtcttctaccccaaagtccttcaaattcaaagtatcttactctttttgttttaaaattgcttggagtagtagagaggactctagtggaatatacaagccaaaataatcaggaatttttacatgagagaaaggaggaatgtcgtgaagggcatcaaaaagcaagaaagatgctcattttcccttccaaccccaatttaggtggcagaggtgggagcaggtgaaaagaacaaagggcattggaaaagaccacctggaagtcagtgaagaccaagcggtaaagggatccttagcttaggcaaaggctagatggggacttatctcaccaatggagccagagaacagatgttccagatgtgtgtgtggaagtgggaagaggactgattaaggaaagaagaagctcaaagcaatatagagatgagacagagaaataacaggattccagaggcacttggattttactcaccaaggatgagggggaattagttggtctcaacatttctaacggcaaagttacaggtcacctaatacatatttatgtattagttggatcagaggatggatggatggatgagtgggtgggtggatggtagatggcagtggatgaacagatgaatgaatggacagatgtgaggatttctctgtgggagattcagttcgcccaggagtgatggtgtttctgagagagccctagcagcatttgttatctcctaggctctctctgaatgttcgaagcagtgagtggcaaagaggaggctcagccctctctggattgatctgttactggggtgtacaggcattcagtgcagagttctcttcatcaatggtcaaataacttctgttacccacttgtgatggctcctgtagcctctggttcgactccatgtaacaactgaagagcagccttgctgcaacagataggaagcaggtcttatctctgatttgagaatagaaggcccggtgggtacaacctgtagcactttcaatcctgtagaaatatagatagtgatgctgttggtaaaaaggaatccaccctttccaaactttttcctaagtcagtggttgtcaactggatgaggtcttgctcaagcacaagtgtctggacccctcctctagaaggagtgattctgcaaggctgagcaagcctgagaatgtgcatttctcacctgtaatcctagcactttgggaggccaaggcgggtggattgtctgagctcaggagttcaagaccagcctaggcaacatggtgaaaccctgtctctactaaaatacaaaaaaagtttccaggtgtagtggcacacacttatagtcccagctactcaggaggctgaggcacaagaattgcttgaacccaggaggcagaggttgtagtgagccaagatcatgccactgcactcaagcctgggtggcagagcaagactctgtctcagataaaaaaagggatgtgcatttctaataaattcccaagtgatattgatactgctctaggaccacactttgggaatcacttccatcctgcatggctaggtttaaattaggcattcttaacttcatatgtggcagggtgagtggatgttgagggccccaggtatattcttgaaaaacaaaaagaagtcagtgatcagttaattcattctagtctcctgctgagactgttgtctggcttatgaaggccaggatttttgccacctgaggcatttggagaagcctatgaaggagagtagaggagaggttggggacaacagaatgaagccagccagaaaaagagactgggcatagggggaatgggaatttgaggagaaacatatcattcatcagaacttaaatctgcatttttagagaagatattataatgtgcttacgtggcctccagatgtgcacaggtgccataggatagaagtagcccagggaagccttgtcatagatgggctacataaataggaaggcttgcagcagtgttaaaagacagctgatatgattaggctttgtgtccccacccaaatctcatcttggcttataatccctgtaatcccgttgtgacaagggagagaccaggaggtaactgaatcatgggagcggtttcctccatgctgttctcatgatagtgagttctcatgagatctgatggttttacaaagggctcttccccactttgctctgcacttctccttcctgccgccttgtgaagaaggtaccttgcttctctttcaccttctgccacgattgtaagtttcctgaggcctccgcagccatgctgaactgtgagtcaattaaacctttttcctttataaattaaccagtctctggcagttctttacagcagtatgaaaatggactaatacaacaccctccatgcaacctggagaaaatgcaaagtacatatagctctcaaacttcaggaaggggatccatatatgcagacagccattctttaaaataacctttccattctcccatccacttcgctcacacgtgatagatagtctgtattatctcttctctaacatctccacccaaaactaaacaaaacattaaaaccctccagtcattatttaacttgcctctttcttcacctcacttccagtttctccccgattcacattcacaaaagcccaagaatgttatggctgatcaaggactctcctttgagggtgggaagaaactgcaggggtcaggccagaattctcttctgcagacagaggagggggaaagacaggaaataagcatgcacaacgttcacctttgttggctgcacaacagcttgggatgtgcacccagccctaggtctccagctgagatgtcctcagttgtactcagcaaaattgccaccttttctgagttatgaaagccttctctcctagagccccagtatgttcctggcacctgcaggcttttgggttttggttttggggtttttttctgtgtggtgttgttgttgtgtttcttcaccagggcatgagtagacagatcctatgcaggcactttctttgtgatcttcaggatcatttgttttatcttgcctcccaaatgctgatcacccatgggcatgcttcttgagggttgcaaccatggctttaaaacccagaacagctggtgtctgtggtctgcagggcccagaaaatattatttaatccaggaaacattcctttgttctgctctgcttcattcagacctctcctgggtcttttccttcccctgctggctatcgatttccatccaactgaaggggtgaagttcagaagcccaggagacagcctgaataatgggtatgcaagtgttgcatcacacatgcagcaaacatttattaagcatgtatactatacagggctgcaaaagtccatatgtactaggatcttacagtacacttggaaacaacaaggaatctgggtatgaggattctttaggtggaccagatgcctgctctgtgtagcagcagaactcttcaatatggactgtaaccacctgctccaaaatcaccctggggaattgtgaataaaatgcagacttcaaggctcatcctatacttgatgagatagggccctgaaatctgctatcttaacaagcacccagttggtttggctcttcatttttctttttgagacagagtctcattccattgtccaggctggaatgcagtggtgcgatcttggctcactgcaacctctgcctcctatattcaagtgattctcatgcctcagcctcccaagtagctgggattacatgcatgcaccaccacactttattttgttttatttattttattttattttattttattttattttattttagtagacacgggatttcaccatgtttcccaggctggtctcatctcttggcctcaagtgaagtgcccacctcagggacatatattgtatggtactgtagagtgctttatacttatctttctcctaaccagatgttagctcttagaatctcatcctcctactttccaaggtccctgcacccatcaccaggcccccaagggatatggacagggagagccctctggccaaattctcgctggatctcccagtggccgttcagcttggaccgccttttctcctcttattccagtgatagtccaggatatctttttgccttttttcccttaagacttccctggtcttggtatttgggattttctcattttgaatctgggggtgaagaggggaatttaggggatattggtcacttgtcttctgtgtccaaatgtgagtgtcttgctttggattaggaaacccctaactaatgaatgttgttaggggctaagaccactccaacagtagaagctagaaatcttagatactaccttgcccatctctgggtgcagccaggacactgaatgtgattcaggctctgctgattagatgtgtccctgttagacattgacatagaccccaggagccagggttataagggacaggagtcctttgtcctctggcaagggtaatttcctcctcagaaccagtcctgggctatgttgatgggcgtggcccagttgccttgtaccaagtcagttttctagtcctgactagaaattgttagttctggcagctaacaattctacatgatccaaaaaagtgagggatatcatttaaggagggagggagacagcctctgccttggtgtctcaccttccaggagtaaagacgtgtcccaagtaatgggtagctccatgcacaagagaagagacagtggagaagataagacatgcaagaggaaggatcatggaagagagacccagaacatttgcttaaccagatctatttataagttttagtccttaatcagaaagcaatgtatctttcttagaacagtaacctcataatgcattcctgaggagcccagttagtccttgctcctgtccatcccacctccttcaggcggtagaacagaagaagggtcttcatctcaccccagctaaagcatctctgcttccagaaagtgtggatgagtgggagccataaacctgggaaataagccacatgctacccttttggttgttgtttattttaacaaaattctatgaccccaggaccatgtttctaagagtagccacttgaagcagaaggaaatatttagtcaaattctacaatcacagccaaatacagtctaatggcagccagcagacactgtggaaagagagtgtcacacaccattctaatgtggggagtaaggatgatgaagaatcagtcataggtccgtgttgtagctccgtctggggagtggaactcatagggtataagtgattatttcctattcatttccttagccctgaaccgtccaatgaccacacgcaacttgactggcaagaggtgtttagaatgttgagacacggtcagaaatgattggtggtttcatgtgatgcaaagaatttcccatactccgcctgttttctggatcacctgtccccagaaattgcctgaaaacaaatcacaggttgaaactagaaataacttccctctcctaggcagcttggagactggccaccctgtttcttggtttggtaagaatgttccagacacaaggaggggagcaacacacactggggcctgtcgggggttggggtatggggagggagagcattaggaaaaataactaatgcatgctgggcttaatacctaggtgatgggttgataggtgcagcaaaccaccatggcacacatttacctaagtaacgaaactgcacatcctgcacatgttaccccagaacttaaaatgaaaataaaaattaaaaaaaaaagaataatccagaaagtcaagaaaagcctaactaaaaaagtctttttaggcaagagagcatcgtaagtaggatgtagaggaagctcccctgcttaaaacctgttaatggtcttctgtagctttcaaattctagctcctcttgcctccacgactcaactccccagccctccttccgagtgtacaagatgactcaccctgagtccagagccaaactctcggtttgcatcccagctctttgccacttactacagaccatgtgaccttgggcaagtcacctaacctctctctgcctcactttcttaatctgaaaagggggggatgatgaccacccgtttcatcaggttgctgtgcatacaaatgggcgaatatgtgtaaactgctgagaacagtgcctagcaaatagtaagccctatgtaaatgtttgctgatgttgtgttccatgattccgtggctttgaagatgctgctctctcatcctgcaatgccaccttaccttacctagcaaattccaacgtgtccgttaacattcagctcaaggctgggcacagtgactgacatctgtcatccccaaactttgggaaactgaggcaggaggatctcttgagcccaggagtttgagatcagcctgggcaaggtagcaagctctcatctccacaaaaaaattaaaaaattatccagaggtggtggcatgcacctatagtctcagctactccaaacactgaggcaggaggatcgcttgacaccaggaatttgaggctacggtgagctctgctctcacctctgcactacagcctgggtgacagagcgagaccctgtctctaaaaagttttcatttttaattttttaaaaaatgtttttaatgtatctcaagccctacctccttcagcaaagtgttctgagcacccaggtctgatgtagggccttgtccatgcttcctgaaaatatatcttctgtagcattcaatgcactggaatgcctatgttagctgaaagttactgatcacaattccggtggcctggaggattggtgagcccagctgtgaagtttagaggcttgctatcttgcccaggctgatctcaacaagtaaacattagtttattcatctgtcttctccctggtttcaagcccctggagtgtagggccacatcttacttggcattgtatccagcagtcaacatagtcctagaatatagaaggccctcatgttgaatgaatagtaaaaccctcctgaaatccattaaattcatatgtttatttactcactcattctcttcctttgttcaaaaaacatctcttgagcctctgtgatgtaaaccaagtgctttttaaccagcagcttctctctgatgatctatctgcaatctctgtgtcagtcctcacatttaactaggacaaaaagagaacatagattcttagtagctttgctcatgacctgactttaacaagaaaaattttagagaccaaaagtctgactgatagctgagtgagttctttctttcaaactcaaagccctgtttgagcctctaaacttcacagctgggcttgcaaatcctccaggccaccgcatttgtgatcagtatctttcagctaacataggcattccagaagatgttctgccctaaacgtaattggaatcctttttgaatcagttgccacagtacttctgaagttttttatgctaacttcttgggtatatttcctcaagatggattcaagatgtggccagttctcttgtgagaagaatacatttctgttgtcctaagtgtagagaccctctagttcatgtaatagccctgcaaagcaatctgctattaccagtcccagcatccatttctccttccttccttagtaataaaaccctgctttggctgagcaccttgttgcccagaattaaacactgttttaccagcttccctgatgggtgtggtcaggttactaagatctggccaaagatgtgtgtatgagttttctatgctgctgcaaattactacaaacttagtggcttaaaacaacacacatttatcttataggtctggaggccagaaatctgagatggatcttagagactaaaatccaggtattggcaacagaggtgtattcctcctggaagttattgctttttctagcttctcgaggtcgcctgcatttcttgtctcgtggccctttcctctgtcttcaaagccagcagctctctggcatgtttgtgcttctcattctcattctctctctctctcccaccccgcccccgcccctgctgtgttatcacatctcctctctctgatccttctacctctctttcataagaacccttttgattagatagaacccacatggataatctctccatcttgaggtccttaatcacatctgtaaagtcccttttgccatgtaaggtatcatattcacagttctggggatcaggacatggacatcggggggacattattctattgtcatgtataagtagagtaagtaagtagagtatggcattttcagaaatgtgctcaaagggaggtgtctcaactgggaaggaccctctttgacccttctgcctttcctttctaaagctgagatatgatggctgatgctttagcagccattgtgaaccatgaggtggccttgcggatggaagtcaagcactaggatggtagaagagaaacattaagatataaattcctgatgatgccatggagccaccttttaccaaatacacttctatcttgtttaagctactgccatcttatttgtttttttttttctggaacatacagctggacctaatctcaatcccttaaaactatacatgactctcttcttaataaactgcaaggctggttctctcagcctactaccctgcctaaggaacagataggtagtaagcatggatatgaccattgctcagaaaatgtgttccaaaaacagacagtatgtttatcatttattgatcagttcagcctctggctctgcctatacactgagccatacaacctcaatattaatctgggctgttaacattcttccagagctttgatcatggtctacatcttactccccggagaatcaggtgggcagaaatgggctactgacctatcaatttctagtcctgattagctcaaaatgtggtcatttcctcttaacataaatgtatttaacaacctgaaatagcaaatagcaaggtaactttccactgacctgtcttactattaatatcagaagtcagaggtggacctaaaaagtaaccaaacaatcaaaaccaatgtctgtaaggaaaaccagcatcgttattagtgacaccaagattcaaatcattgatttagcaacactccttagtgtattcatcagatgtttattggaaatctatggtgtggcctctgcagtgagtcagagtgcagagttgaagagatgagggtccctcaccttaagaaccctcactgcattaatggagagacagaccaagaaatgcctttgtggtttcaagaagtgcctttgttctgtttcatttttttattgtcaacaatcatggccaggcatggtggctcatgcctgtaatcccagcactttgggaggccaaggtggggggaatcacctgaggtcaggagttccagaccagcttggccatcatggtgaaaccccgtctttactaaaaatacaaaaaaaaaaaaaaaaaaaaaaaattagccaggcatggtggcgggtgcctgtaatcccatctactcgggaggctgagacaggagaatcgcttgaacccaggaggcgggggttgcagtgagccgagatcatgccactgcactccagcctggactacagagtgagactccatctcaaaaaaaaaaaaaaaaaaaaaaggaaaaaaaaaatcacaacctagattctgtaagcacctacagcagctatcctttgctggggtttcctcattcagctctctcctcattcattatctgggtcctattgtattccctttattagttttagcaatgtttaaaattatttgctgcttgaaatctaatccattttgcaagtaaccagcacctgggggcaggggtagtgatgagaaaacagggctaaaaggaataaattcacaatgagttttatatttacaccatccttttcccattcacagggttttcccatttgggaacattcttagcgtgttctctgaacagaagaccgtttctcttggtctgaagttgatcaatgtgagaggaagatggcacattagaaagatgcctggctctgatgacattccaccccgcagtcttccagcacactgggatctggggcttgaagtcacttgtctggctgtgtgactgtatccacttggaagcagcgtcccctgctcctaagttgcacaagatacttcagggagtctgctgtgatttagtgatagacaagtcagaaaacaagtttaaacttgttattaatcagaagagaacacagacatttttagctgtctatctgacttggtcatagggcagagccatcagatgccatcagtggtggtcggtgtagatttttttgtgaatcaagacaggagcaggaaaaaggggggtggaaataacagacaggttccaggagggcctggtggagggttcagctgttggagctcatttttcttgctttttcccgagagaggggaatggactgccattgtcacaggttaagtcacagaagagtgaagctcaggtgacaggagacattccaaattgagaacagacatgccaggggtccctgttgccacctgctcacaagccaaggccttggttccgagcccctcttctctctctgcattttctccttgggtgacctcatccagcctcgctgcctgaagtgcattcctacacaccagtgactctcaaatactatctccagccagctctctccccacaaatccagattcaacagccactccatgtccctactcagatggctcctacagacctcaggcgaaacatggctagcacgcaagcccaggtgtcctccccatcctgttttctcatctcagttgatgtaagctccaccgtgcacccaactagttaagctagaaacctggagtcactcgagactcctctttttctcatgggcaagccccatccatcagagaggaccaggagccttgcctccaaacccatttgcttctcttgatttcaccatatcacctgtgcccaaccagccttccatttctctaacccagtggacacagttccaaactggtctccttgcttctactcctctccctttacaatccattctgcactcagcagctaacatcttttaaaaacataaactggaccccttaccacttgaagccttccaggactttctatttcttttaaaacctgacacagcccctgccttcctggtctcctctccactgtgttctgtgtggccaacctccaggcgtacgagcctgcctcttgccctctggacagatcaagcttgcttcctgccttggagatctggccttggctgttcctctgatggggaggctcttcctccaaagagtcacacgaccatctccttcttgttcctgagttctttattctcaatgaatgaagtttattgcactcccctccccaatctcagtagtccccagtgatcctctctcccaactcccattctagcttcattattgcgctgtttttccttggtttcatgcagtttccttgttcattgactcctccattacagagtaagcttagagaggtcagggaccacatctgtttctgtctcattccccacttcagcacagagaacgatatggggcacagtaggagctcgataaatgctttagtgaatgcataaacaaagtaagaaaccatgaggtgacccaaacctcggtttcttcagttataaaatgggcacatgggtgcaaaggctcaggtgtattgtaagggtgaaacgagaggtgatgcgtgtgaggcctttgtgagctctagatctctttgtagatgcaaagtatcagtgtagattgcagtaaccaggacatcagaagaaaaccctgctctttggaagcaaagtgtgccaaataacaaagcttagctctacaaggctatcgctaagcctatgcaataaatactttctctcctccacatctgagctggacattctccacttgtccctccagagccactctccacccttcttacctgcctctgtgcctcacgggctgtcactacagctgcctcagtaagctcccttgccctctgggtacaaggcttcaactgatgggtgacaccaacaggagatcagaggggaggagagggagaccaggtaacttattccctggcagaccttcatcagagagtagctgtgttctgctgaaggctgtggcttctgtctgtccaccttctcctagaaagaccacatcctgtgggttcctgtaactgttcctccttgctaccccattcgacctgaggttggaaacttcctctagttgttgctctagccgcaggctgctccacaatccctaacccacccaaacctttgtctaaagcaccttccttacaccctccccagctgtggcatttcggggccctgttagcatccacgtgatgctgctttctacaaatgtgtctatttgtggtgacagcacttgcgctttgctttcttccctttcttatcctacctgatatcccagccttctgcccctcagctacaagaccactccataaccatagaggaccaaaatcacctaggagcttgagagagaaaatgtatttgacatcttgaaaataatgcagtttgctcaggggatttatttctccctcccctgggctctgcgctcagaccctctttgcttctgtccgactactgcaagcaggcagttaagattatttctagcaaatggacttagagaagctgagcatatgagtgatgttgaaatttgacctacacttcttttttttttttttttttgagatggagtctcgctctgttgcccaggttggagtgcagtggcatgatctcggctcactgcagtctgcctcccgggttcaagcgattctcctgcctcagcctcccatgtagctgggattacaggtacatgccaccatgcccggctaatttttgtatttttagtatagacggggtttcaccatgttggccaggctggtctcaaactcctgacctcaggtgatctgcctgcctcggcctcccaaagtgctgggattataaacgtgaaccaccgcgcctggtgagctatgcttattacttagatttctagcagataacatatagttatttcctaaaactctgttcttaacctgagctgtttttgtcatttttcagggttttagggggtgggaacatattacaggagctattaggtgcatgagtgtgagttgcgggcatatgtgagggttgtgtgtcttgtgtctatgcacatgcgcaggtgtgtaagtgggtgtgaatatgtgtgagcgttgcatgcatgcatgagttgtatgtgtgttgcatctgtgcgtgtgtgcaggtgggtatgagttagtgtgagtgttgcctgcatgcgagttgggtgtctgttgcatctatgcatgtgtgcaggtatgtatgactgtgtgagtgtgtgcaggtacagcttctgtattaataagagacgggcaatcactgtgcactgatattgaggggtagggattagagggcaccttgtctatttgggaggtgaaggagggctggaatgagaggctgaaggggtacagaagaggaaggcagacccctgcaggcctcagggacctagcctccctcccttcagtgtcccttcctctccctgcaggaaccagaaaaagtgtggaggtctgaattgcagtctctaaaatctctcctcagtctcacatgactggcttcagttttctcaccagtcctgcaaagccaggccttgaccccttatctaaatatccaaagaaaaaaatggaattagggatcttagaaggaaagagtggggcaggaaatgcaccaccagggcagtgcagcttggtcactgccagctcccctcatgggcagagggctggcctcttgcagccgaccaggcactgagcgccatcccagggccctcgccagccctcagcagggccaggacacacaagcctttgacttcctcctgtcactgctgctgccattcctgttttgtggtcatcactccttccctgtcctcagactgcccagcactcaaggatgtcctgtggtggcatcagaccagaggcccctgaagaggagtgagttgggtgttttttgccgcgcccaaagcagctggctgtcccctgaaagatggcaagtggggaatgatgatggtgcaccatcgttctgcacaccaagcccttctggataggaggcccccagcagtggagggatgggggctgccaactggcattgcccagaggcccagctcctggtcacatagactgacctagcagtgcaccagctacccgaggcagcctgcaggaaaggtgcactcatagcgatgctggaatgccatgaggcccagccatggggttgagaactggaatggagggaaatgtttgcatcctgatgctgggaaacaggagatcagtcctcaccaacgctgagatgatttccctctggttcttaagctcggttctctttctgcttgatgcttgaatctctggtgtctggcagagagtctggtgtctggcatagtgctttgtatgtaggtcatgccagagcatgctggtgactttgcccttctaggactcttttccatttcatagggacttgctgtgaaaccccgtttgacctggatataaatgttagatgtcatggagtcctgttagcatggtgagctgcaggctgttctgcatgagtcctccttgagcctgcatctaatacccactgctcaatcaatctcttttcactgtttcccattgatcccaagtgtgtcctctgtgagccttttcttgacactgggtcacccagaattactcccctgtctgtgtccccatagcaccccacaaatagttcaatcatagcccttgtaacattctggtgcaccagtttaaggacagagccctgtcttattcatcattgctggtggatgaataaaaatgttcaagtcgtaataacggcaatgacaacaatgataaactcaccacttactgaccattggctgtgtgccacaggacataggactgaacatcttacaggtgttatcctcatgtccactctctcagactgcacttctatcgtattctacagaaactgaaggatggaaggtcacagagctggtgggaggggagcctggattcatacccaagccgtgtgcctcctggccactcctatgggtgaaggaaagcaaagggcttagctgtagctgggatggagaaagaggaatctcaggcttctcgtcatattttgcctcaagaactggaaattgatctgggagtagatcccacactgagggagaaggccccagaccaagaaaggatgggctcatctatttgattgaaaacagagaagcttggaagacccaaggtagggcaattcctgaaccgtccagggctggaaaacctgtagcaaaggcctggggagatggggcagaaaggctaaattataacttaggaatctccaccaggagatcagctccaagacagcttccagtttcggcagatggaagggatacttgatggaaaaggagggagggtaagtgtcagagactgctaaatgtctttacctacatttcctcatttcaaactctcacagaacagagtctgaggtagactctagggctggccccattttgcagatgggtaaactgaggttcagagcactatacccgtaagatctttgctcaagaacttgtatgtcccagaccatgcttgaaacctggtttactcacacaccctgctgtgcagacctcctccgttccaaagtggtggcagacttcagtgtgctttgcagactttcaatctcagcacatgctgtggaagtgctagcagtgttgctgtgctaaccctgtggttaggctgatcacagtcctggtgagtaactatggcctgcagccctggcatctgaaagatgaccccttgcctctcctgctgtcctcaagaaagccttagccccctagattattttcaatataaaatgttcatacactacttttcagattcaaatttgcacaaatgaagtgaccgttagacaccactggaaggtaataaaacccccaagcctgccagccatcaggtccctcccagccatcccagaaatatgctcagctgccctcgaaacatctgtcatgctctctggtgggtgctactgggcacctgacattagatcacttctctcccaaagctgcagctctgcttattcgattcttatttctgcctttggattgagtggaaggcagtcatcagtgacagccaccctcggggaacagaaacgatgtccacagtggcaacgatcctccatcttcctgcactgaggcctaatcaatgtagcccatacccagcctccatttaataagctgattgttgagctaaatcccgcacactctccccttgccctggacgcttttgattgacaaaactaatctctcctccacccccacgtctgctgctgcccacatcctcttgcaaatcatgtactcggctgctgacaattagatataagacttgggattcggatgtgggagggttatgaggttatgaatcaattgtgggggctcaggtgagataacaaaccaggggaacccatttcagacacctcgccacagccctcagagcctcctggttgatttatgagttggtaataacctcgctgggtctcctggcccctattatttttcataatgcacaggaaagctttaaatatcagagaatggggaagtgcacagtctgagtgggagggaggtgaggggggatggggcttgggggagaacagtggccaagggcttccccgcagctgattgtctctcctgccccatctccccaggccttcgctgcaggtcttctagtcctggacgtttcaggaattgctttatcttggctttttcaagcttctctgtttcattcaaatagatgagcccatcctttctcggtctggggtcttctccctcagcgtgggatctactcccagatcagtttccagttcttgaggcaaaatatcaggagaaacctgagattcctccttctccatcccagctacagctaagtccttcgctttccttctgtgggtcaccacggggtgccgttgtcatatacccatggaggccagcaagctgatctggccaacctgggagaagaccccaggttgatgacccctggtttaggagtgcatatggcaggatgcttgagggatcactgggcccaaaatcgtatttgctgtgtctggatgtaatgcctcccacctgttcaagaccacgtcagaatgactcagagacctgcctgttaagaagggaaaattatccgctggacaaaagccagtcaaaaagcaggctcaccctgcagtctggaagccagttgagcagcgaggacaggccaaaaaggtgggagggggccagtgagtgtctctcagcctggaggtaaagagctgaagactttacctttccttctgcctgctgtcctcttcccagtgacagccagtttttaataaggaaaaggaggaggctttgaattgctacctaatatttgtttaagtagtaatttgttgagatttctctgttttgttttgttttgttttgttttttgagacggagtctcatgctgtcgcccaggctggagtgtagtggtgcagtcggcttactacaacctccgcctcccaggttcaagcacttctcctgccttagtcatccaagtagctgggactacaggcacctgccaccatgcccagctaatttttgtatttttagtaaagacagggtttcaccatgttggccaggctggtctcgaactcctgacctcaggcaatccacctgccttggcctcccaaagtgctgggattacaggcaaaaagatgtgattttttttttttttttaacagtatcagtgggtgaaagaccctgaacctttcctctaaggcagtgtttgtaaactgcctatatgatgtctggtactagattgtgatgatgttttcaagggccacaaaacaattgaggaaaaatttaaaacatactgaatatacatgtgtgggtgtttatgtattatgatgtgtatttgaatacaactatcaacgaataagcattcattagaccccaactctgtaccagatgtttgtttactccatgccagggacagaactaacagggtccctgctctcttggagctacagtttagtgggcattatgggttgaattatgttctctcaaaaattcatatattgaagttctaaacactagaactccaaaatgtgaccttatttggaaatagagtcattgcagatgtaattagttaaggtgagataattagggtgggccctaatctggtatgactggtagtcttattaaagggaaatttgggccagtcatcgtggttcacacctgtaatcccagcactttgggaggccaaggcaggaggatcacttcagcccagaagttagagaccagcctgagtaacataaggagaccctgtctctacaaaaaatttaaaaattagccagcatggtggtacatgcctgtggtcccagccacttgggaagatcgggagaggcctgggacagattctccctcacagccctcaggaagaaccaacccgttcgacacctggatcttagctgtctggcctccagaaccatagacaataaattgctgttgtctaagccacccagtttgtgataccttgtcatggaagtcatagcaaactaatatagaagaggaaacagacatcgatcaaataattacattgtggctaattccaaactgagataaatgcttcaaggagaaagaaccttgttctcttgacgttgaaagccaaaggaccttgagccagtctggagggcaatgaaggccttcccgagggagttagggctgaaggatgtgtcagagtcagctagagctgtgttccccagcctttttggcaccagggaccagtttcatggaagacagtttttccacggaccagggttgtgggggatggtttcaggatgattcaagtgcattacatttattgtgtactttatttctattattacattataacatataaggaaataattatacaactcaccacaatgtagaattagtgggagccctgagcttgttttcctgtaactagacagtcgcacctggggggtgatgggagacaggaacagaacatcaggcattagattctcataaggagcgtgcaacctacctggcatgcacagttcacaatagggttcatgctcctgtgagaatctaatgccactgctgatctgacaggaggcagagctcaggcagtaatgtgagtgatggggaggggctgtaaatacagatgaagcttcacttgctcacccgccactcacctcctgttgtgaggcctggttcctaacaggccagggaccattacctgttgggaggctgaggacccctgagctagaggaagaggtgggaggaggaagggaaggcacgacaggcccagggagtagcagatgcaaagatcctgtggtgcaatggagactgttgcattctgggaagggaaaggcagtcccaaggcaggagaggtgggggaagaagaagagggtgttgggatggatgcaaccagagcaccccaaaccagaaagatgtttactccattaccttcaactgaattacagtggggtgagggcacctattttgctttctgccctcacttccgggaaatgcgcatcctggatcacagaaaagctgctgggcagaggtcccagtctctcagtgaggcctcaccagactagtagagttgtccagccacaatgccctcctcatttccccttctgtccaacaagctgtctatcggaagatcccagtctaaaagcaccagaagacattttgagtttctctaaggcctaaaatttaaaagctgataagtaacacaaggattccaagttactgctgtctctcccagccacgcagatgactgggttagacacttggctggtatgaggtccctgaaacatgggctctgtgagtagccaatgtgtattaatattaatgcttatgatatgtcaggcactctgcatgggttcattacccctcacagtcaagatgatgggtcccattattactgtcctgttttctttatttttgagacggagtttcgctcttgtttcccaggctgcagtgcagtggcacgatctcggctcactacaacctccacctcgcgggttgaagcaattctccctgcctcagcctcccaagtagctgggattacaagtgcccgccaccacaccaagctaatttttgtgtttttagtagagtcagggtttcaccatgttggccaggctggtctcaaaatcatgacctcaggtgatccacccacctcggcctcccgcagtgtactgttctcttttcatatgaggaaataaacgcacagggccagcagatgacttgctaacaaccagatcatttcagcaaaaccatgaaccaggcattgtgaagagagttttgtatacctggccttattcttaactagacagcacttcaccctagttgacgtatgaagaaatggagatcagggcaggtggtgggtaagggacctgcccaggttcccaccgtttgtaagtgatgtaccatgagttgctctcaagtgtgtctgactttataaatgctgcaccttatcatttcctatgcttggtaagcaagtgagtgtgaaatttgccacgcttttccttggaaaaactcaagcccattgaccaaacaatactacttgaaaatgacactgaacttttcatcactgtgtttctccacctgtgttcccttctgtcttactgccacctactcattgtgctcaccctccaaagcccagtttaacatttcctcttagttaagctttctctgctagctgatcattgcattttttttcaattaaggcataaaagaaaaaaaaaagacggtaaagattgtcctacttagaatatccttccattcatttgcaaaatggagataataatatgctatttacaacataggattagtatagcaggattattccagagcctggaatatagaaagtactcagtaaattattagttcaacagctaataatagtaccaattattattatcactaaattaatgcctctgtttcaggaaaaaaactgaatacatacagaatatcggttttctaattgttttttctttatactacttggaaagttatacagagttaagagacacagaatagtatagtggaaataatatttggcatgaaattgcctggattccatcagtagtagcctgtggtcttgagcctctctgggcctaatctttaaaatggatataataattatcatattggacacaattattgtcaagataacatgcgataacagggtcaagtgcccagctctggcctggtacaccatgggcactcaggaaatgtcactccgccttcataagcattggcctgtgcatgacatctatgtgataaggtggcctgaagctgtcctccccacccagaggtgcagcagaggcctggcaggaatgtgaaaatccaatggatcaagtcataaccttgactgaagagtatggtgagttcactcatggcaggaaccatctgatcattcatacggctccagaaacattttactcaaaagaaagtgtctttccccaacagtcaagattgataattagtttatgaattgcttcatttatcagtactatgatgtactgtataatccaccaggtttcaagttactggaattttgcaggtgatgggaaccagtctttttatcaactttgcataatctgatctgggctcagattgatagaatgctttgggaagaatcaggggagtgttttatactaggatctcctgcggttctgatgcgttaatgggaggaagctatccctgtcaaattctacaattttggaggagcttaaaacacctgaagacaaagccctgaattttatgagtgtctgcctgaaaccagaaacagaaaccccttacagcttactcaacagcgttaattcagcatggaaaggcaccaggaaaagatcactgcgtcttactcccaccaagtaaacaagctaacaaacacagaggagaggtgcaggttggcacccttaggccggactctgggtggacagccctgtcagagtctataaagggtcgctctgaggctccaggagtggcagatggccagagagtggccaactggaggcacactattgagcctcgggattgagcctcccactgtttacccctcaggaaaaagagagctttgagtctcctggccctttccccagagagcaggaaatggccagggcttgaggatagccagaggccgtccaaagttacccataccatctccactttggcctcagaggccagctctttcttctctctgtgctttttaaaataaaaacttatttttctagtgtaaaagtattatatgaatgttctatgaacttcaaataatacagaaatgtaaagaatagaaatttcccattatttgatgcctcccgctccccaaaataacctaaagttaacaatttaaatatatatccagaatttttcctctccatatttatatatatctatacatatataattaatagaacataaatattttacagtaaccctgttctcaagatgcttttccactgtagatgtttaataaatatttattgcatgaatgagccataatttatttattcagtcctctattagaggcctttggtttgttcccagtcatctaataaacatgattttagatataaaagacataattgaaatacatataacacatacagaaacataacccataactgcatatcataaatatatccttaaatatactaataaaacacgcatgcaatggagaggtgttttgggtgccgtctggtgtatatcctggatatccctggaatatatattgataaatcagcctcaaaaagaatgctttcagacagtgttttaggatctgtgggaacaaagggtggccatcctgcatttgttatgttgtttcaacatagcatttgttatgttgttttattaactttaagtccttggcaaagcagcttgactaagataagatccagaaaccagtcgtggtaacaaggcaacaattaatcttagatagaacagaaaaggaatccgcttcaaattctctttagaacaggaaggaaagggtgatcgtgggttagcaggaaggaaggaaagaggcaagaaaggaaagtgaaaaaagaatggaaatgctttctcctgctggtgatttggatgtttggactactcttgtcagatgctacagcgtaatcactgtaaatgttttaaaggacgcgatattatgacagatttccctttctgacttgttcctggggctgcacacacaatgatttactccctgccacgggctggaggcttggccactcctgggttggtccaaggaagcctggaatacccaatgcctgtgagagtgagcacgtccccctgtctctaggtgttgttgcttgtgctgaaatggagtctaccaagcattgccatggcatggaagggatggtggcggagtagatgccactgcagattgagtgcagtgtcccaggcagccaggggcagccgctcagcccttgcctggacctgaggactgttgcatcagtctccagatgagacagcagctgtcatggtggctgaaccagggaaaagaaactccactctgtggtctccatggggctagggaaaaaaggaaatgggtttttgtgattttcccttctttagaaacaaaagtgcttaaatgtgattctttagctctgtaaatgcaaaccacggcctggtggactggggagaacaattaggccaaaggctgagcacaggaagccaaaagcgggtggaaacccagacaacggtgctgagccgggggttggggtggttggggggagcggatatgatagcaaggaaggagtttcaatgtgaatgaatactaattagtgacatggatattaatgatgacagtaattaacaggggaaaggaagggctgtcattgtcccagggtgagtaatcaatcttggcaggtgataaataatggttcagcaagctcagcagaaagataatccgcaggcctgggggagaactcagctaatgcaggaaacctcacagtttctaggcaacccacagaaaagaactattttttttttcttttttgagacagcgtctcactctgtggccaggctggagtgtagtggcgcgatctcggctcactgcaacctccacctcccgtgttcaagcaattcccctgcctgagcctcccgagtagctgggactcaggcatgtggcaccacgcctggctaatgttttgtattttaatagagacggggtttcaccatgttggccaggatggtctcaaactcctgacctcgtgatccaccctcctcggtctccaaaagtgttgggattataggcatgagccactgcgcctggccagaactatttttcttttgaggaaaaaacagattagagtatctctcccacccccagcttgggactacagttcttatttgatttctgctttgttcttcatttcctgggacaaatgttgaacttgtataacttggaggaaagggacacacaggcacatgtacacacacacatattcattctctctctctctctctctctctctctctccaagaatacgaatgaatacgagtgtttttgatctaaagtttgactcacagatgctgtccaggagtagcaagagtgaggagaagcctagaagtgctgcctttgaggttggcgcggggaaactgcaaaattgcaaggctgtgtcggcagaactggggcacacaggaggatgaggatggccctgggggtcccactgtgcagggttacttcacctgccatggacccagagagaaacaaaatgtctaggctttctgtcctgtaccagtcccacttctggccaccagtcacatatctaagaaaactgatttctgggaagagggcaatcctcatgaagcccctctgctggatccccaggccttcagccaggaatccagcccaggagagttcttggcacatcccctccctctcaccaaagcctcagacccacggtaggactctgatatctaaaatgtctccccttgcaggctgtgttccatcaaacaatttagaggtgacaaagccacaccttcaatggtctgcactggtttaaagtgagatctttgggtggcaaaggtagattgaccagaaattcagaaccttccagaaaactgaactcctctactgccatgtacacagtgctgctctcagaacattgtttgcgggtcacattttcaaagagaggcagacagaagggaacttattcagaggattgggaacatatggtgaggaactccaggccacaccctgcaaggaagcagctgagggacccaggcctgttgcacttggagggaggacgtcgctggtatgccgcaggactgtctgaatagctgaagggctgtcgcacagagtggttaggttggggtttgtttttctatcatcaaatggcaaaactgaggccaaagggaggaagtcagagaggggcaagtttctgttcagataaatcaaggctgatttaactgggtcaggctgggtaggggggagtttgtgagtttccaggtactagggattctaaacacaggttacagcacctcttgtccagggtgttgtgaatgggacatgtattggctggggttggagtagacaagctttaaaagttccttcagggccgggcgcggtggctcatgcctgtaatcccagcactttgggaggccgaggcgggcggatcacgaggtcaggagatcgagaccatcccggctaaaacggtgaaaccccgtctctactaaaaatacaaaaaaattagccgggcgtagtggcaggcgcctgtagtcccagctacttgggaggctgaggcaggagaatggcgtgaacccgggaggcagagcttgcagtgagccgagatcccgccactgcactccagcctgggcgacagagcgagactccgtctcaaaaaaaaaaaaaaaaaaaaaaaaagttccttcagactcttaagatttatattcgttaaggtaatactagataccaaaacagctaagtcccaaatttcaggggcttaacacaacaaagttcagtcctttcagtcctcaatcaagtcagagccccacatgggcgtaatgtccatggttggaaccgtggctccctgcctattgtggctctgcattcccccaggtctttggagtcccccacatccagccagtagatgggattgaaaggggcagagctaaggagagccatgtaggagtttttatggtccaggtctggaagtggcatatgccatttctacccatattctattggcagaactcagtccatatctaagtgcaggggaggctggaaatgtaatctagctatggcacagtgaggagaggaaagaggtcttggtgaatacatagacgtttctgccacaaatgcagggacacattcattcaggataggcctgtgccggaagagatgagagttttgcaagaacctatgaggtcacctgtgttggtcagcccttgtaattgatggtagggagctgatgaggcctccttcttcaagaaatggtctgggggccaggcatgataaagcttcacctagcacgtctcagggaagtcctctatagacacttcctagaaacatgaatataagctcatcctgcatcatcagaagtgagtgttttttggacaagaatggaattgtaactatggaagtgtactgaagaatggaaagggttggttaggacaaaaaaaagtgcccatattatcctgctctacagtgtggactgtttggaattaggattctcttaggtaaacatgtttcttctgccacagtgttaaacacccaggaggtcttcagctgaaattgctttatcgttgcaggtactgacattgtgcagtggcttatgaagaacctttccattgaggacccaggtacttgacctttgaccccacccttatctcccctggtatcagtaaacatcccataaccaagttccaaactagattcccctgccctcctgagaactggtcttgtaaatgtgaattccaagacgtggaatcactctatttacaaataaaattaatttattttctccactgaatatttgtctttaaatttaaatcatgctttgaggaaatgagcaactttttagaatgccaaagagcccaatacaataatgtgtgaaatgagttgaattctcattagctgcagcaattaaagataagttgtagcactgtcactgaacagccttctagagccagctcttaaaattagattgcctgatccacaattaagatgtttaattatttgctaagactccctctgttttctgcttctgcaagaagtgaaggaatgattttttttcaactttaattgcgcatttcaattaggaagaccttaccaggaaaacaacaacagaaccctggccaataaaacaatttcccagtctgttctcccaccagaaaataggcagtaaaatttattttcacagtgtaattaggaaatggggggggtgttccagaaaaataaaaattcaagataagtaaagcttattcccatgtgctgtcagttaatacttttccgaatttattacatactcctttgccttgattaactgagtattcttgatgcctgaaggtcacatttataaagatccactaatacactctgatgttcttaatggacattggcgtgattagacttacctgccccaaattaaatggccctgaaccacaatgctttttgaagatttttttgaagtgcccattctgcatccgtgaccttcagctgtgagtccctgctggaatcggtgtgtcagcttggcactcctgtattttaacccaacatttctaatctgttgactgcaaaacaatacagtttctatgcagttcaattatatacagttgttagaactctgagtgccagaaaagcagatcattcatagaagtggcccgagtcttttcacccccttgattagtggctactctcacaactagtgaaaattcttaattctagtcaagttcttgattcacagggaaaaaactataaatgctaaccctttgtaaaggatagaacccaaagcaactcactatgtgttgtccctgatgcagcctgtacttctgagtgtccgcttggaaagcctggactgaatcagcatctacctgtttagttacatttatctaaagtcagtatttcttgtgattataatgctaaactaaggaacgtgtttcctcatggccaccttttctcttccaagagcactggtttctttgcctcctaaaataatcgttgtatttctgacatatattttattattactattatgagaaccctaaattggcgagcagtatgtgagaatgagcttcaggaatcctccagccctggcgtgagaagcttctgtgaagggtcctgaatgatgagagttatttctatgaaaatctgttatactctgatgcccttgggaagacatcatggtataggggcctgtttgggcttctgagaagtggctgaggagaagctaagaaccatttgtcagctgggaatagtctaaggggggagatgaggcaaaccgaggccttgggaaacagtcagatccagcatctgcccctctctcccttctttttcccatcagtcgatttcctgtggttattttttggtttttgaggcaaggtctcactctgtcacccaggctagagtgcagtggcacgagcatagctcactgcagccttgacctccctggcccaagccatcttccacctcagtctcccgagtagctgggactataggctcctagcaccacatccagctaattttttgttttattttttgtagagatggggatctcactgtgttatccaggctggtcttgaactcctgacctcaaacaattcttctgctttggcctcccacagtgcttggattacaggtgtgagacactgcacctggccccattggccaacgtctaagcaaaaacatttttgctcagagaatgaagttagagtcttagctccaagactggtggcatgaaagtcaccttcctacaggattttgttctttcttctctggggaaggagcaactgctgatgatgaaacttctgttctagctggactcatggttcttgaagcatatggactttaaaaagcaaaccggccagacatggtagctcatgcctgtaatcgcagctctttgggaggctcagctgggaggactgcttgagcccaggagttcaagaccagcctgagcaagatggcaaaaccctacctctaccaaaaaaaataaaaaaaaaattagacagacgtggtggcatgtgcctgtggttccagctacttgggaggctggggcagaagtatcacttgagcccaggagttcaagtctgcaatgagctgtgatcatgccactgcactccagcctgggtgacaagagtcagacctgtctctaaaaaaaaaaaaaaaaaaaaaaaaatagcaaattggtcatcactaagcaagtaaaataaaactctattcattccaattccaccagttacatgtatgtttctttcaaaggagaataggtggttcttgatacgcaaaacattgcattgtattcaacttcttgaaaagtttgcaagtaaagccaaaacaaactactttaaaaagtcagagctcgtgaaattaataattgctagaggctccctgagcacattaacaatttccatgtccaaaaattagttttaacctgtaacagtacttttggatttgtgaaagattgtgtgtggtagaagcattgaggtttgttattttttcttagctctgctcaggataaatctaaattcttaacttttttttttttaattgagacagggtctcgctgtgttgctcaggcttgtctcaaactcctgagctcaagcaatccgcctgcctctggattacaggcgtgagccaccatgcccgacctatattctcaactttctatgtgcatctatttatggctggtgccaaaggaacgaaggaacagattgactgtggcaaaaatataagtatttctatcaggttagcctctctctgtcactgcccacttcagtgtccttcctctaattttcaaaggaagtgaggttttcctctctgtccataagagaagggtgacacccttctcattcctgatgggactgtcatattggggaacgcactgggagtcctacgtctctatgggcagcgaggctgcattcttactgctggggatgatgaaactggtatgaatcagagctgctagcacttacggagtatttgacctgtaccagacaatcacttcatgtgaaatatctcacttagttaaatacaggttcttctatgccagaacttatgcccttgaccctgaagccagactttcttctgaaggtcagggtgaggaggggttaagccatgtcagactctcagaggtgggattcagacaagtcccagacacatagttgccctttccagccattggcatctcccctcctcacccccacactgagcaagggcaattgtatcatcaacacagacatctgggggtgatgacagttgacttctggtctcccagcttaattttcagccaaataacctgctttctaattccttctctctctatgcactgttcttacagttgaagcaatacacttggggagccttatcgctgcccagggctacatctttccaatctcagaccatgttctcaccatgaaggatgatggcaccttttatcgtttccaggtaagcctgctggctcctcctcctgaagaaccttttcttcacaacatcatctgatcttaggttagaactacaaagaaaacctagggatatctgagggagtagccctcactcctcatcagcactgggaaagccaagagaacttttctctgggccactgggtgacccacttagagaatagtaaaaggctgtcattgagagcctaccatgccctgggcactgccttagtcccttgggctgctacaacaaaatacctaaactgggtatcttataaacaaacaaacaaaaaatttacttctcatggttgtggaggctggcaagtccaagaccaaggtgccagcagattcggtgtctggtgagggcctgctctctggctcatagatggcaccttctagctatatccccacatggcagacaggacctggggcttatatcagacctcttttataaaggcactaatctcacctgtgagggcttcaaaggccccacctcccaataccatcaccttggggattaggatttcaacatgtgaatttgaggaggatgcagacattcagaccatggtagacactttgtacagatttcctcatttattctgaagagcacactttagggggtaaatattacccattttacagaggagaaaactgaattgctcaaagaattaaagtgtcatttagtaaatcctggagcagccttcatctgaacctaagtgagcctgatagcacagaccttgatctttctactgtctcatgttgccttctcggagtgaagtttctatttgcgacctaatcaccctccccacccatttcacactccttctcccagatccttccgtagagggaatgagggcagaggatatgggcttgaatcaaggtctaaccaaagggtgtgggagaagagttcttcagactaggttaaagggaggaaaggaacatgggcttaggtgcccagtaagttatgccagcctgacttttgtacttagacctctattgtctcaggataagaatatattgccctgtgaacaaaacttaacatttttgcatttgttttgcttacttacattttgcttctcaatgcctaggttaaaatgttgactcaccttagctgaattagagaagaggagagaattgtggggtagcatcagcaagaaggagatgggggagagcctgccatcagggaggctcctccctgggtgtgggagggaagcgcaggcatggcgcgcccctgagcactaacacccatgctcctttgcaggctccgtacttctggccttcgaactgctgggaacctgaaaacactgactatggtgagaactgaagccactgggaactctcaacttcaacactgtgtgtcacttctgggggtgcagaagacaaatgcttggtgtgggccatggtggtacatggggaggagggtcctttctgcttagtcctttctcatattgttgctatataacaaatctcctgttccacataacagaggaaggcccagcttactgaaagatgtagtccttggaggggaagcaggagagggaagaaaaatcttatcaagggtggtcagtatgttcatcttggggccatggagaaccaggatcccacagcaacactatcagatggtgacttttaattgttctttccagggatagggcttcagggagggctggatcaaggggctacctcctcctggccctttctgttctcatagacttgtcaaaacttactaagaaccttttggtgttcttgacagttgcaatttagaaaagagacagagaccagggaggagtatacagaagtcactctggactaggaaaatagagtgggtgaagttgagagttctgtctctctagacagggacctacaagacttctgccagatattctcagtggagattatttaatattcctatatgccaattctctgaagaagttttattatcgctatgcttaagagaaagaacctgaggcccagaggggccacaccctcacactaccacattgtctgaatgctcccttgattataagcctcttgagggcagaggctggtccagcttatgcattctcatatctccagggcatagcctatgtctgaggcagaattagtgctcagtaaatatccactgacagttctggttctttattgaaggtgaccaacagacactcactagagggagcagaacttgaactcagatctgagtggctccaaaacccatacttctttcacggtcccatgtgtgacatgcctgaaggttgtagctgcagcactgcccctttgcatgcatccttgctgctgactcagctgctgtggcagtctcatctgtggctctccttgggactgggacactcaatgagacctgcagcttctttgcagaattgtttaagacaagaaggcagatgcagctgtggtgagtgggagggagatgtgcagctgggtggtgatcaggggagcctgtctgggagacccatgggataagatacaaccttggagtcacacgtttgagcaagaggaaaccaacaacagggagccaagctgaggatggaatacaagcgagttgtacctactaaggctggagttgttccatggtcaagtgtggaggacgtcagtcatgcagaagggcaggctctggggctgtctgcttggctatccacaggcaccactgtgggccctctgacactgtgctgcaccctaaccaatgtgataagtggatccaggaagacttccgactgcaagtgagagctgcatttgaccgctcataaaactagtgcttctggggctgaaaagactgctcatgaaagcccaactcagaatttgaataattatagctcagttccatgcagcaacgtgtgcccttgtgaatgtgaaaaccagtatttttccaggcagtggagagggtgggaggatggtaagaccagatacctgggcccaagtaagattaaaatatttacttccgtaaagcttagggcatcttatgctgcatactaaagggcatcatctccctgttctacaggtgttcttcattttataattttaattgtgcatcatgaacagggagagaaataatagtttgtttcaggctctcattaaacaaaaattattttaaattcctgtgcctcaatttatggcaaatcagagggagaaatcaaggttcaggatgcacaagtgttcaccagggaccaggcatggtggtgcatacctgtaatcccagtgactcgggaggctgagatgggaggatcacttgagcccaggagttcaaagctgcagtgagctatgattgtgccactgccctccagcctgggtgatagaggaagaccctgtctctaaaacaaagaaaaaccagtactccccagggtttccaaagcagtttagttagaaaatcaggatgtatttatgaagagagaatccagcacaatgagcccccaggatcaacccgttccactagctgggtgatcttggcaaattacttaacctctctgtgcctcagagacctcatattaaaattagagtagtaatggcacttgtctcctagtgttttgttaggattaaatgaaatgcatgtaaggttctctgagttaatacggagtggtggttggtatcactactggggtggggtcggtattattgccactgggatgttggttgatattattatgactgaggtgaccgtctcaccaggaagcatgtgaaactgaagctaagaattcaatatagtatgatttggactgatgaagtaccagaaactttcattcaattgacaaacgtttactggtccctactctgtcaaattctatgtcagagatttgaataagtcacagcctttccccgcaagcattccaggctgggagaggcagcatgatgcagggaagaaaggcatggtgaggatctggcttgagtattcaaaggttttatgtgatgaatgactgagaaggctgaatagcttgggaggggcaggtttataaaaaggccttggcagtcaagtagagacatttagaatggattcagcagtttggggaagctattgtgggtccccaacaatgaacacactttcccaagttttttccctacttgggaaaaaattggttcatctataagatgggggtaataacagaacccacctagtagggttattatgaggattaagtggactgtggaagattaagtaagggctgtgacttagtcaaatagttcctgatattcagtgggctcaatggaagcagtagctgctacgatggtgatttttccagcacctaaaacggtacttggcccataggagacactcagtacatttttgaatgagtgactgaatgaataaatggatcggtgaatgtcatagaggaaactctgcactggtcctcgattctaattccatctccatcactaactagcccttgggtccatcacttcatttctctgggcctttagtttccccatctgtaaatgaggggcctgtacttgatggttgccaaggttacctccagtctaaaattctttggttctaaaaagtcatcagaaagtatgaggaaaatagagaaataagtgagttataggttccctagtttaggagattgaggtacataatgatgttgctagtaaaggcagaaagtaaagaaaggggtcagtttcttcagtacattgaaactcgataagctcaatattttttaagaaatttaattgcacatataatacatgaatgtgttccctttatacaatttttaaatatgtcccagttttgtgtggtgacacatggtgaacttgagatggcagtggatttctctgagtgagatgtgagatataggtaagggtggaatgccagatgtaaggacaaggaaatagaaatttttcggtaagaaattaaatatccaagagaaaccaatatctgagcttaagacagttcttccagatgccctcttgtagggctggctattgtcaccagtagtcactagagtcggttggaagttagagcaagccctagtgagggcactctgggatgcagacaagccccagggagttctgtgccaagaacagccacatcccaccttcctcattgtggtgaaaagattccttgtgtgactttaggcacagggacattagctagtagcatgtgaccctgtgactcatggccatcaggagtggccccagctctgcattccatgcatgataactcacttcacaaccccgctgtcccattttgaccccgcttacccatttggacatttcttgggatgactctgcctgcataaaacccacagtcaaatccaggttagccttttctgagttttacatttggccagtgcaaaatcctgtccagggcagcattgtcaaagcagctgccacctccactgacctgcactgctcaaaggtaatcatgacctggcccagtcgagctggtgacatgtcaagcttcctgcctgaggttgtccctaattctgccaggggtccaagagactgaaggaggtactttgtgatagatcggacacccctttatcagacacagtgaagcactatagctgcttggttcattggaaaagttggtaagtagaaaatcatttttaaaacgacatatgcacaccttaagcacctcatgtaaaggtaagatatacaaaggaacactcatttgacagccttgtgaagtaggaccaaagtgttctctttgattatgagctgaataattttagtttcttaaatcaaccgcactcaaaataaactaccctgttttggtatctttaaagtgcatcaagaatgtaaagacatttttgtagtcttttgtatattggcccctcctagatttttattatttttcttactttttcctgttatctcacctgtatcaaattcaccagcaattgccttagctaactctccttcattaaattgttccaaaccattcaactgagttttcatagaagcaacactctctctcttttcacattaatttcattgagacgtgtgatatttagtgaacttgtgtgattaaaataacagatgtgcctgatataagcagatttgggaacaaccacaactgactcctatgagcacacaattcgccgggtggaagcagaagtgtgggcataccagagggtaggctgctagcttccaggctccaaaatgtcataggtatcagtaaatttttcagaacaaatgaaggaagttggttgatccagcaaagagttgactagagatctcttagtaaagagatcttgttgtccaacaacaaaatgatcacaggttctctctggccctccctcttgatcattctgttgttcatttatttatgccattcatctactgttttccctggattgttccacttggctctggagaaggaggaagacattgaagaaggaaaggtagggagaagaagtgatgatgaaggccatgtttgaggaagaaacagggaaaccaggggccaagaacctttccttagcctgagttgagagacctaaattgtcttccctttccatagcctttttactgcacctgacaagacaggctatggtgctagcaacagggatgaaagctgagcaggacatagcctctgcccttaaagagacttcagcctagagcaggggacagtctagtaaatacaggatttcagtgcaatggaatttagttccatggtcaaggacatgtagatgctatctgaaacaccaacttgggtcttcaaagattagtaagaggttgccagatagagggaaggagagaagagagaaagactttcctcaaaaaggacacatatgcaaaagaatgaagctgaaaagagtttggtggcctcacagtgcctgcatgagggagaagaagttgatgagataagcagtgagcagatcataaagaaccatatttgccatcctaacgagcccaaccttacttctgaggccattgaggactccaggcagagcttttaggcactggagtaatgtggtcatgtttgtgaaatatcactctgagtgtaggatgttcagggtgaagcagagtgaggaggaagaaggggagttgtcaggattggaatatggaggagtcctcatttgatcatgactatgaaaggatttatagaggtcaggggtcatgaggtccacttagaaaacatatttttcccaggacagtgctcatgaggtccacttagaaaacatatttttcccaggacagtgctgggcacatagcaagggtgggtgggcgggctgtctggatggatggatggatggatggatggatggatggatggatggatggatggttgggtggatgggtggatgggtggatggatggatggatggatggatggatggatggatgggtgaatgggtgaatggatggacagatggatggatgggcttataattccattgtgctgctggttttgtacatgttgtcatttcctttcttccctcagccatctatctctgtaagaggacaatgcaaaataaagcaaggctggaactggcagattatgaagcagtaagtatgattattttccaggatacatataagaagagagtaaaatcatatctgcagctccgtctaagtttattttttttttcttttgtcccccttttgtccctttcagacagtggaagggaagtatcttctatttctcctcccttgttctcagctcctctgaccatcacaataagatggtgtttttacataaataactcttaaaactcaacaataaaaaaataagcagctcaacttaaaaataggctaatgacttaacagatattttaccaaagaggacacaaggatgataaataaacccatgaaaagatgtccaatattattagccatttaggaaatgcagattaaatccgtggtgagatactgttacatacctattagaatggccaaaataaaaaatactgatgataccaagtgatggtgaggaagtagaacaactggaactctccgctttgctagtggtaatgcaaaatggtacagccactctagaaaatagcttggcagtttcttataaagttaaacatacacttaccatataaccaagcaatcccacttgtatatacataccctagagaaatcagaactcatgttcacacaaacacctataaactaatgttcatacaagcttaatctgtgataaccaaaagctgaaaacaacccaaatgcactttaacagttgaatggttaaactaactgtggtacatccatacaatagaatactactatgcagtaaaaaggaatgaactgttgatacacacaaccacttgaatgagtaccaagaacattatgttgggtgaaagaaaccaatctcaggccagccattccatttataggacattcttgaaaagataaaactatcatgatgaaaagcagatcaatgattgctagtggttatggatggggtagggaattgttggaaggtgatggaactgttctgtatcctgatcgtggtggtggttgtatgaatctatacatgtgttaaaatttacagacttgtacaaaaggaaaaaagtcaaatttactacataataacatttcaaattaaaattttaaattgcacctttatacccactctcctgtgcttagtagcagaggcagaatctaagggtaaaattcaattcagaaaataagacaagatgtgtgtcacatgaggtatctacttcccagctttcttaccttccttctctatctttcttcataagatgagacttcttgcaaaaattagaggccccaccaccaaacttgggtccattcccatttgacagagcccagaaaccaaagcacttgaaaactcatagatcatttaattttttttttaacttttggttgcaaaatttttcccccaaactgaactttacatgggtcacagagaatgggagaaactggctaaactttcttataccttctacttccctctccctatatgtcttccaaaggatgtgctgctgagccatgaatgactgaagggccagcagctatggaaggaggggcaacattaaggggagcagagaatccttccctggatagtccagcattaacagcatcttcagacccacccaccgccaaagcccttcctgcttttactgcctcagtctttcaaaacaagtgtgaggccccactctgccaggccttacctctcctaggttcatgttcccaagcctaccaagcctaccaagcctaccaagccagctgggccatcgctcccctctctacagcccaagtgtgaatgcgcatgccattggggagcaggacgtgtgcatggtccttcacctctttgatcccactggcattgtggacctgtgaatggggtgcagggggccagaagaggaagaagcagtgcagcagtttgtccagagccctcaggacctggctagagtttgcattatcagatgatcatatgttggaatattatgatctccccagataaaccttggcctggttgttctgtggctctggacatcctgggagcccagtcatgcccctgtctgccccaatgcccagcaatcacagcacccctccttcaaaagactgctgttgtactctttgtgcgcccagtgcaagtagctttgacatgatgacattacctccttaacacaaccttgaggaaaggcccagacagtagaagcctggggcccctccctcctgtgtgtctcttccccatattttcaatgttttggaaaaaggtcccatacagaaatcagacagcatcaactcctgctgtatttgattcaatttctcttctcttgtcccttaatgttctgctctggtatttgtaaagaatatggcattgaggccaggtatggtggctcatgcctgtaatccccaaggtgggcagatcacgaggtcaggagatcgagaccatcctggctaacatgctgaaacccgtctctactaaaaatacaaaaaattagccaggcctagtggcacacgcctgtagatccagctactcaggaggctgaggcaggagaatcccttgaacctgggaggcggaggttgtgagccaagatcgtgccactgcactccagcctgggcaacagagcgagactccgtctcaaaaaaaaaaaaaagaatatggcattgagatgtgctctcaggttgaagttctgcacaaaaatgattcaaaaccaaaaaagcattttgcttccaaaatgcaataatttttttatgaattttctgattacatattctttttacaaaaacaaaaattcaaacagcaaagaaaggagagaatataacctgtgactccccctcacctaagttttttctatgcatacatttttttctttacaaaactatatcagaatcataacataaacattcttgtggcagctgcttctctttccccagtcattatactgtaggtatctcggggtctttaccatgtcagtaactataatctacgttattgtgtttaatggctgcctagaattctatgctatgactgtgtcacagttgattgacatttaggcattaccagttttgcttcctatgagcagtggaagagtcacaaagacagtttttagaagtactttcacaccaagcctgggtgataactgtgagctcatgtgtggtactctccaactgaagctccttttatattaataatccattaatgagggtaatcaattcgtgttggcatgagctctatgaaaatacatagcataatatgggctccggccttgcattcatcagaattaggaggatcattagggcgcctgtcaaactcccctcctcgccgcccatcctcatgttccattaggtaactctacagacttagagaaaatacttttctttttctctaacggcagccctcaatgacttttctttctgttttgggctttttctttcatgaacatcacaaacgtagacactccgtttggggcacttttttttttttttttgaaacagtttcattcttgttgcccaggctgcagtgcagtggcaggatctcggctcactgcaacctccccacctcccgggttcaagcgactctcctccctcagtctcccaaatagttgggattacaggcacctgccaccatgcccagctaatttctgtaattttagtagagatggggtttcaccctgttgaccaggctggtctggaactcctgacctcaggtgatccacctgccttggccttccaaaatgctgcgattacaggtgtgagtcaccacactcagcctcggccactttgaatcctgacattagaaaaagcatgaaagccaggtccctttggttttcctttcctgtgtccttcccagctccccactggaagaggagtcctgagaaatccagcctttggttttgctcctggagataccagcaggtggcaaagactcgttaattccccaataaccacagacaattttcccgattttcagcaacctttgaaacaagtgctgtgtgagttgcattcttgtaaaacaccttcatgaagagaggaatcaggtgaaccatagagacttcagacttaatgggtgtgtaaatgaatattaatagttcagctctgtacggagggtctggcgcaaagtcaaatgggatacatgtccaggggatttaaagcaggtcttgctattttgttggaagtaaccaaaattgatggatgccttataataagcataggtgtcgatgtgctaatttacgatgattaatgccgccttgttgattttcatttctcattaggaaaacttagcaagactccagagggcctttgcgaggaagtgggaattcatctttatgcaagcagaagcacaagtaaagtaggtgaacttgatagagaccttttcagagaggaaaagactctggaatttggaaatggtgtgaaggtgggattgtcaaagtgaagtttccagatggcgttagtatttctaatagggcctgagagcaactgagtagaaattaaagtcaggatggataagttttgtcttcataatcaatgcttctctaaagcaatttcagaaatgtgtgtttcagcagacaagggagatcctcccaaaggtagaactctggttataagaaggtgtacctatttccccaagagatttccagttattttctgtgttcaaaggctgaaatcccattttacccgttggactggagattttgtcttcatgggaaaacaggttggagttttaggaagaacaacaagtagcccctgtcttcttttccctgacaggggaggagtttagaaccaacagaaaaagaaggcacagaagtcagacagttggagtccaaaatatcagattattacattaattaaaagcaagagtaaggctgggcatggtggctcatgcctgtaatcccagcactttgtgagaccgaggtgggggtggatcacctgaggtcaggagttcgagaccaacctgactaacatggtgaaaccccgtctctactaaaaatacaaaattagctgggcatagtggtacatgcctgtaatcccagctactcaggaggctgaggcaggagaattgcttgaacccgggaagtggaggttgcagtgagctgagatcgtgacattgcactccagcctgggcaacaagagcaaaactccctctcaaaaaaaaaaaaaaaaaacaagattatagggcgtgacactggatatgtggccccaggtgaaaattaaatctgcccttcctgtacagaggtgtgtatctataggcctcctctccccagcatctccaccccaccccaccagggcataggtgacccctgtaagttttctgcatgcagagagcagctatcctgagcacaggctgacccagatgggggcccagagagggagagtctgaacttcttcaatttcttctttcaagtctaccaattagttaagtcatttttcctccacaaaggacaagagatgaaaggaagaaaaaagttggaagggtttttcccagatttttttctcctggatacatagtggacatttcttcctctctaaggaaacatgaggaatgggtactctatgttccccaccccacaaacatcgttgtcaaccagatccatttaattctgggaaacagaatgattggatctggatctcccctgtccctcccagggatgatgtctaggttagccaggatggttagttaacaggagaagtgggacaggagcaggaaagggatgctaagctgggagaatgggactatgtttcctctgggtaccacctgcatgtgagcagccgctgagtcttcagagcaacattcctgggcgatgttgcagcccgtggcctggagccgggtctcaggctgtgtgggtgtagactcatcacagctatggtcacagttggaagtgacctgaggccatctggtccagtggcctgtacactgccattgctgtgaacctccccccacagtctctgcctttctcctgtccatgatgccagccacctcctgaccacccagcagccccccggggataggcgggtaccaggcactgggtgcccccgaagaggtgcaggtgggagagtaggtaggatggaggctgggattcaactggactaaggcagaattatgcctgtgtactcagaagccactggaaagcaaagaggaacgctaatttgttcttccagaatcaaacagcatcacaagttataaacagaggggaaattgttacttcataaatacatggtatttctcgattaacttttttgattaactctgtgattacattataattgtgggccacctaagtacacagtaattatcacaaaaatcgcagggtgattatgggtttatttcagtccagtaaagtaaagcgttcccgagagagccgagacctaggagttacacggcaattaatctgagttgctttttacttgaaataaaatgaagtaatacatgcttttttaagaaaaaaaaaaaaagaaagaaaaagaaaaaacctcttatctatgctgcagatcagaacaataagaatctgtctttgtcacctgcaatttccctcttgcaatttgtgcctcccccagctgaggccagtgatatttgcctcctggatcttgtctcattctagggccattattctgcctttagaaagccagatggtgtaagtgacttataaaacacataattgcagcattttaaagacatttatttctactgattctaaatctaaagcaaactttcaaatttgaacatggaacactggcaagatggtggttacattccatcttataatttgtatatgcagtatcctttttgataagggggcatatcaatggataattcagtttttaataatccaaatcttaatacttcagatgaacagctgcattcttattcttcccttaggccaccatgttcattacacatgtatggcaatctgtaatctagcctaaaacaagttctcttaccatgtgtggaattcctgaggttttcggggggggaattatacacccctatttcacagctctgcagagagcaggcaccatgcaggtaccaatggccttgtgttcacttagcccctagcaacaggagcaaacgctggagcaagtgtcagaagggaaaacagaatacagagcttcttatttccttcctctctttactctttcaggattgaccggaaaaaagacaagacagaaaggaaaattttggatagtcaagaacgagccttttgggatgtccacaggcctgtggtgagaaagcgctactcaattctctagatttttttttcttaattgttcatttttatctctataaagaaaagaccgtctttagccaccaggtgtctcattcttaagaaaatcgctcagctttgtggaactggtttcgccattcatttatataatctcagtaaattttctggaatatatgtaagttccaccttttaaaaattattcattcggccgggcatggcggctcacgcctgtaatcccagcgctttgggaggccgaggtgggtggatcacgaggtcagtcgatcaagaccatcctggctaacacggtgaaaccccgtcgctactaaaaatacaaaaaaattagccgggcgtggtggcaggcacctgtagtcccagcgactcgggaggctgaggcaggagaatggtgtgaacccgggaggcggagcttgcagtgagccgagagcgcaccactgcactccagcctcggcaacagagcgagactccatctctggggaaaaaaaaaattattcattcctgaaaatatggaattgcaaatggagaagctatgggaattccaccaaaagacctttgtgtcccgaaggtttacattccccaaattaacaatttccatttccactgctattcaactctgaatcttcaactattctctgtcgaatacggttaattcttgttatccatggcagttatgttctataaagtctttgcaaacactgaattagcgcacattgaagcatcactcccgtgggaactaccaagctaggtccccgtgagcctgtggccacaacatttttatcagctgatcgatacataaccttttaaatgtgtttctgtataaagacagcttatgtaatatatatcattgattcattaacattaaactcatggccaacagcactgttgctcatgcctgcatgtttatttcctcctaaggcacatcagagaatggtgaacagcacttcagcactgtccttggggccattttaaacagcaaaatcaccaacaaaaagtacagaaatgcagaaaagttggcactaaattagccctaaatagaagggtctgaaacaaaaaggcaggacgtcaccttgttcaatttcagtgggaaacacacatatcaggctactcaaggtacaactactgagtaaggagttataaatgaaatttagcaagcaggcaaattcacaaatgcaaaatttgtaaataatgaggtttgactgtatttctgatttcacgttattaaaacaaatcttgcattttcctcatgaaatggaactaaaaaataaattattggtcttcttaaaatttgattaaaagcaaaaaataaataaatagctactcatcctgatatcgtggagtctttttcaaacggttaagtatgtaaaaaaaaattttaaggactgtgtctgaggcaatcttgccacttaaatagctaatttgctcttagaaactgtacactataccctctacatatcatccttagattatgaggtaagcttttctagatcgtatgggaactccacagaggaatgcatattatggcaaaatggaaaaaaaaatcatgcattgtctgtaatggaaaaagataaagattggtcctgatggtgtgacatgggctaaattggaagtgtaattttcacgtagtaatttatatgatgtgttttttttttctcagccaggctgtgtgaacacaacagaaatggatatccgaaaatgtcgacgtttgaagaatccacaaaaggttaaaaaggttcgctagtttagctgagttaaaaattcctgatgtgaatagcccttccagttctagtactattcaaatagtaatttgctacttgtaattctaccaccttttgtcatttgaaaccataaccatttcacaaatattgattgagcagctgatgcatgcttggcgctgtgctcgtgctaggatacagtggcaggtcctcatggagcccacagcctggcaggagtaaaacaagccaacaggcaacagggccatgaatgctgtgttaggagaggtacaggacagttgaggagcccaggaggggcagctaagccagacctggagtgggtgggggtggggggcttcccaagggcttcctgaaagagggtcaggtgttctgaagggtaagttgcagttgtcctggggaggtggcagggaggggaggaaacaaaaggagcaagaagtggcaaagctcacaggtgaaagcaagctttatacttagaagcaaataaaagtcttttttatggtttttttttttttttttttttttggatagagctggatcacccaaactcaaaccaccatcttgtccaactgtgaatgacccagtggtcacttgtgtttcactttactcaaaggagtagtggtcacagcatacccgagggtgccatgctcagactcccccacgattcatatgtcccaccctctccacagcaccagggacaatattgcaggacagcatgaccagactccgtaatattaatttccaaagagtgggccaggtacggtggctcacacttgtaatcccaacacttgggaggccgaggtgggcggatcacctgaggtcgggagttcaagaccagcttgaccaacatggagaaaccccgtctctactaaaaatacacaattagctgggcacagtggtgcatacctgtaatcccagcttcttgggaggctgaggcaggagaatcgcttgaacccaggaggcagaggttgcagtgagcagagatcgcgccattgtactccagcctgggcaacaagagcgagactccatctcaaaaaaaaattccaaagagtggagatgtgtccccaaacattcctatttcttgtgatgaccaattagctctctctcatgtatgcattaaaaaaaaatacacgcacacacacacacacacacacactagacatggcgtatgtatataaacttctttaatctacttacatattttgttcgtcactgacttaacaatatccactgtattatattttaaaatgttagtcctaaaatgtcctcatttcatcttcaagagccccataattctaacattacagaatttcatggagtcacatccaccttatctgagcccttctgcattttgatgattttgactacacattgcatgcccttcagtgtttcatttctttcccattgcaaagattgtgtttagtctttccgtaatacgaggaacagctttaaatgtagctatagctacggacatgtggaaaaacttaggccagaaaactgtttaacttgaaagggaaaccctgaaatgctgccatcccagttttgtaccagatgggaatctgctgaccaacggaaatgtagaggggatcttttgtgcatactctttggcagtggctcttgaactttctttattcagaatcatttggggcatttgataaaagtgcagatttccaaacccacccacaaagattctgatgcagtaagtccagggggcgaggggatactcagcaacgtgtcttttccaagcacacccaggtgattctttgcaggtggtctatggaccatatttggagaaacactgagatacaaggaggctattttcagcccaataaaagataggatttgggttatagtggtaccccaaagatgagatgacatgccttaagaggcagcattctcatcattgaagaaataaaagcagagaccaatctcttattgtcatgaggggattcacgaaattggatgagtcattggactagctgacccctaagccaccctccaattctgtgggtggatgatcctctgtgcttgcttcttctcctagtccgtgtatggcgtgactgaagagtcccaggcacagagcccggtgcatgtactcagccaaccaatcaggaaaacaacaaaagaggacatccggaaacaggtgaatgaattgacagcttgcactctcaggaggagacgtggccagtttaaaaaccctttcaaatgttcaactctgaagattgagcaagctttgagttcctggaaaccacagtggaacccagctgtgggtgattgaaccttttaagtgctgtgtgtgaacaagccacggaagcttgagagaaagaattctctacccagttcctccagcagttactagaaaagggcgtaaatgagtcatcccatgccttggggtaactgctgtaatggggtttcccacagtccgctgtgggagctggaggaaggagggggctcatgtcacacagtccttataattggaatgcaccagctcaggatggtctactttattgctgtgatttgaaaggaaagtttaagaataaataaagctctactcccaatgccatttcagcattacttggttgaatgttattttctttcatgatgagcagcccaggtcaacagacaatggctaattatattacttccttctgatatttactggtaacaaagcaacctactgtttatattatgccttgctggttcctagagggcaaaacccaaaggagtaaactttgaggtgcttgcccttgacaagtttattatctgatgggtaagaggtaatggatatatgaaaaaaaaaagctatttggcggggctcggggctcggtggcccacacctgtaatcccagcactttgtgaggctgaggcaggtggatcatctgaggtaaggagtttgagaccaggctgaccaatatgatgaaaccccatctctactaaaaatagaaaaaagttagccgggcttggtggcgtgtgactataatcccagctactcgggaggctgagacagcagaatcacttgaatctgagaggtggaggttgcagtgagctgagatcatgccgctgcactccagcctaggcaacagaatgagactctgtctcaaaaaaaaaaaagaaaaaaagaaaaaaaaaccacacagaaaaaaagctatttgatgattccagtcaagcatgccaaggacatgggtgtgacgtgcctgtgaaaggtgggcagaggaggggtcactggggattgttcaaaacaggtatttatggggcacatttcacctgtccatgctgttgctaagctacgtagaaaatacattgcctttaaattttggaaagcaagacttaaatcacaccacagtataggaggagatgagacaaaggctaaattgcagaatatgaatcttgtatgatagggatgtccagaggcacaagtaatttgctggagggcagagctgagggagttggagatgtctggccagaggaggtatttggatcttggtggaaatgcaggatttgggtttgtggagcgaggggaaaaaaataattttagtttggtcttaacatctgtgttctctattttcccagataacatttttgaacgcacagatcgacagacattgtttgaaaatgtccaaagtggctgaaaggtatgttttcctttaataatattactactttcttctaatttaacagggaagaaatgttacagggttatggttaacgaatgtgttcaatgccaagagttagactgtagttattccttagactggggtgcagaaaaacccacaggctccatgtgagtataactaagataacagacctcccttgagtgatgtcaagaaatgttccgttgctaaggctttacagggggtggccacgggaccttgtcaatcaaggaagaatgtcctttaaagctacataatgcacctttgccttcagcctctggattaattcaaatggaaattgctcccctttcagctataaaatgcccagattcactttataggggaaaagaaattatgtgtgtcctttgaggtgctggctgcatagacaggaggggactggatcatcgggaagtgttccgcctccacacgccatcaaccactgaactgcatcgaatcagctgtaaagaaaatatttggcccctccagcctggcttccacagcggtgtgtgtgcttcattctgcaccagtagctagttccactccgttaactcatgggagactcaattttatcaactaaatggtctgtttttttaactcttccgtgaagatgggagaccacatggggaatctatatggaataaatctaaccaggcagctcagtagtgaacatttattcatccatatgctaccgttaaagcaatgaccaattgcttaaggaatcaagagcttaagttgggtcttggtatttattggatgtcagataaactgagtcttttaagcccagctcctacagggggctggctgtgagagccatctataagcctgtaagcctttctctgctggctcctgggttgattcacatcttttttctagataaattacaacaaatggaaggtataaaaactccaaccccaaacaaagagtctgattgaataccctaccttcaggggctaaggacatccctggacttgggctcacgtctttattccagggtttctcgattgtggcactagtgacattctgagccagataattccttgttgtgttcttaatgtcctatgaattataggatagttagcagcattcctgacctctccccattagaggccagtagtcccccaccaccacagctgtgagaaccaaaaatgtctccagacattgccaaatgtcccctgggtggggtgaaagtcactcccattgagaatgactgacactcctgctttttctatgcaaatgtgctggaaagttgccctggctggagctcagcttacactgaggtactgatcactctggagtcgctgtttcagctagctgtgtaggctgcagaatcacctcatacctcctctctcatcatgtgtggcttctggccagagtaccaggctctgaaaatgctttttaggtctcactgtggttcctttgccccagaaaggtggctgtgagtgaaacagcagcatggcctcaactctcttggtgtcatccatggcctgtgaggaaccacgagcttctttctctgtgaactagggacagaaatggctgtcctagtatactttgagggtcggtgtgctagcaatgctcatgtctggccttggaaggtggaagagctctttagggtttgcaatttagaaagagcgtatatatgggagcatctgtttctttggatctatttgctcaggtccagtggttctaagtaccgtaatccaggtgagggagggggttaaaaaatggaaattcccaagcctcagccctagggattcagattcagtggttccagggttgagccaagaaatccacattctggataatcttcaagtggactgatctggtctttcaggatccggtgaagccattgcctgctactcaggctgacctgagagctcacatccaatttgttatatctttgggatgcagagaaagagcctgaacctgtcagcatgagggaggcagactccagggcaggtgtgcagagagtccaaggaatggaggaaaccaaggtggaggcggggagcccggcccatcctattgtttgtttgtttccttgctgtcagggaggggccccacctggtaccacctaattatgcttgagaggctgctcatattgaaggattattccaactggctactcctcggtgcccagctagaagctttcatgagtctctgcccggcagaggctggattttattcccagcagcaataactggcaacttttcaatgcgacacgagggtttttcattagagccacaaggaaacccccagataaggaggaggagggaaaggagacgcgtgttagctggagataaagcagctgggagccgggcctgtcagtggctctgtgaagatggggccagggaggaggtgctggcagctggtgagaagctgccagagatgcaggctgagctctctcaggtgggcacgcacatccacatccacatccccatcctgatctggcttccctgggcctgctccaggtgataagtggcaattccatatcccccaggaaaccgcatcccccaggaaaggtcttcatcatttttcacccagttctgtgagaactaatagtgaggagaggcaggagggctggggacagcgaggctgggctctgggatgtctacagtcagggttggactaaagggtgcatccagaccagcagggagggaaaaagggaactttgcaaactaaaggggcagaacagacagtttaggggatgggtctgaaaccgaccatcgaggtttgaaacctacccctgccatttcctgttttctaactgatgaagccagtggcttcttctctcggtgcctgtttttacctctttagaggggagatagtagttgtatttaaattataggattaatgagttcatgcatggcaaaagtatggtccagtccttgggactcagtctgcacactgggaatgtgaataataattattttccagcatgacacttaacttgtgctttggaagagagcagaattcaaggccatgagacagaatgaactggatatatggtgcttaaaggagcaaacaaagggcaggccaaggagggaggctgctaatgcaattctttcctgcaccctctgtctccccccagtctcccacacagagatctctgcaggctgcccaaggctgaccttgcactgcatgtctccttccactgcctcacacgccatcactaatctggggctttgcgggagaaaagacttgctcttctgcacagaatttctcagatcatcccagttccaaatattctgtccattgtcttcctgagtgcttaagtgtccccaaaatgccagcatcgtggcaaccaaactgcatttcctaggctgccttttgcacctggaagcaacacaaaaggctttctgagctgttacccaatttttgttgcagaatgtattgtctctgcacacacacacatgagtgtctcagataaatgacacttaacaccctaagctttttattttaactttttttttttttttttttttgagacggagtcttgctttgttgcccaggctggagtgcagtggtgcaatctcggctcactgcaagctccgcctcccgggttcacaccattctcctgcctcagcctcctcagtagctgggattacaggcacctgccaccaagcctggctaatttttttgtattttttagtagagacatggtttcaccatgttagtcaggatggtctcgatctcctgacgtcgtgatccgcccgcctcggcctcccaaagtgctgggattacaggcatgagccaccgctcccggcctattttaactattttttaatggcagtgtttcttaaatatggttcatccactttacttcctaataaaaggacactacatttcagttaattttgctagatgactcaagagtcagtagtcttctattatgctttaaaactgtcagtggtcaggatcttataaggtgccctgcttccccttccctaaatggccccagataataatattctttgaattcctgtttctgccttttagttgtctgtctgtctgctttctctactaacccttccccccaacacccaacccctgctttccaatctgtagcataccatgtgtatcagttagctgtcactgagtaacaaaacaccccaaaactcagtggcttaaaaaataggcttttactattgctcacatgtctatgtgccacctggctccactggtctcagccatgtttctctatgtggctatgggttggcgaggcagctctgctgatcttggctgggctctctcacatgtttggcttctgctggtttaggatggcctcagctgggacagttgagcactccttaatatggtctctcaccctccagcagactagtttgaccttttccacatggggatagtgggattccaagagagagaacagaagcatgcaaaactcttgcagattagaactggcattctgtcgcttctgttaccttttattggctaaaacaagtcactaagctggactagattcaagggcagaagaaatagactccttttttgaaactgaactaccacaccaggaaatcaaataaccaaattgattagctttgatcctaaagcaagtgtgaaaagtcttttttgtgaggtgtgttgttcccgataacaatgaaccttgaggcatggtgtttatttcatctgtagactatgcagaggctcttatgctcacttatctcatttgtgttctctggatacttgaagttgccagataaacaaggtcctactcttctctgcaagcgtccccaagggagtccctttttttattcatctaagccttatagcacttgacaaaccaactttgagaagcaacactccatgcattttagtcccaaactgtctagtctccatgtttggctgcgattccccagagacttctcccgacccatagcgagcttacaccacaatcactgcagctatcccagtgcactgctgcacacagagggatcaaaatgtttcattccgtacctgcatctgtacttggctcatcctcaccctattactgggagccattcgtgtgtcacagctgactgctgaattgattttttttagcatcatctcacttgcctgtatctgagattgccgctgctccctgaaattggatgctggttcttcctccacctcctgaccctcagtgatcatgaaatgtaattaatgaaatgagataagacagcaagggactggatacccctaagggtctattaaaaacctgctagggtgatagaggtttgggaacttaatgtctaattatagtttcaggggaggaaaaaagagggtcacagaagtcattacaactttgcttttatgggatttcagaaaccatggggtctttgctcctcctttctcctagcctgttctaggtgacagaaaaaaaaaaagaccggaggtatcattacagccagggtgactgtatctagaccaagatatggaatctgtagcatgtggaaaagaaggggcctccatacctggcctggtgtaagctcttcttcctgcagggctgaattcaccttcatgctccttcactcatcccaagtttctctattgaatgtgttttctctgggtgacttgcaattaaggagttctctttttatattttccctacttcccaccttctccaagtgaaaaaaaaaaagctagattaattaattaattgctaggaatcaaactttcttctttcctctccgcagtgctgctctgcttctcattttcctttctaatcagatccttcctgtcctggttctctgttgtgcatcacagttcagaaactgcatgtagcagagcgaggcgtgccagcatgctctcctcttcaccccctttaatattccaattccaggtcttctcatgtagaggctctgatttcataatgaatgctttagtgcatttgtactgtatttctaaagtaggactaatggtcgtatcccataatgctttagattccaggcctcgtttttgttggattttgtttgtttgtttgtttgttttcctggatagtagtttcccatagctgcaggccatacttcactgtccctttttcctggagcctagccatgtcagtatctcttcatcttctccccacctgctccatatatgtgtccttagctctagggattcctcctaggcattgcttaactcaggatggacagcatttcttcttcctccaacttgtcatagttttgtgtggtttttttttggtggggggcggtcacatctatacaatttgtagcaaaattataagtcttttgttaagagagaaaggataaaatctacaacttttatttttgtcatattttctcaagtggttggactgtatgtttactaaattctctttcattatttccttcccctccatgtttatcaaaggtagaccctaattagcaatctaaattgggaaggttttgcattaataactgtcctcctaccaggattggttactattgttagaagctgtgactttgctgttagctcagctctaacaactctctgagatccagagagctgtttgctatttaatggcatagtaggctctgaataatggctactaaatgactgaccacagagtgtacccctggtagccatctggtagattttttttttttttttttttttgccattactaaaggttcatggggcaggagtatgtgaacaaatagccagttccacatttccactcaagacccagttcaaagcccacgacaatggtgggtagcacatttgctaaaggttcacagatcagcatcttctagtgatgtgagaatttgtcatttgaaaataacaaaagcatataccaatcaggagtcagggataaagggacaagaatgctaaaattgctcattgagaaatattgttcctaatggacttctgaatttcctatatttattttatttcttccatctcatcccaattctgcttttctgccactcacacccagcggttggaggaccattgctgctgtgtactgttatatgctggacatcctacaaagctctttacatacctctattttcttctccctttttgcttctcctctcctacctctagtctttctgtggtcattggtattgactttggactgaaatggtactgtgcgttggccattgctgcctccttcattggcctgcctggccttctcattgtcttgtgtgtcccaagcagactctgttcatcttgtaatctgtacactaccaggaagcacatgttctgaaagagacaacctctctggctagttctacaaagggctgccttgatgaacttgccttcacactcccatcaccttcattcccttttcaactgtattggtttgattccaagcaataaaaccccagcttgaacctggttctgcaaaatagaagcatgccttggctcccagaatacaagaaggggctgtggaattgaaccctgggaaaggcagcaatgctactgagctcaggaaaagctggagccagggccttcagtgcctccaagacccattcttcctctctggtcctgcccactttccatgctgaccttattctctttcatgacagacatgtgttaggaaacatgacaccaccagcccttgaactttgtgactatacaactttgatatggtttggctgtatccccacccaaatctcatcttgaattgtagttcccataatccccacacgtgatgggagggacccagtgggaggtaattgaatcatgctggtgttttcccccatgctatgctcatgatagtaagttctcatgagacctgatggctttataaagggcttccccccttcattcagttctcattctccttcctgtcaccatgtgaagaaggacatgtttgcttccccttcccccatgattgtaagtttcctaggcctccccagccatgctgaaccatgagtcaattaaacctctttcctttataaattagccagtcttgggtatttcctcatagcagcaggagaatggactaatacaagcttctactgctgaagctggggaaagaagatatgaacctcacttgcgtcaggtatctgttcctggacaaatcaaccatggccaggagcagggcttataaataaatacatggcagctcctgaagtagccttgtgtacatgtcagagtacaattctcaggagacaagcagaagtgagcagaaacccatagaggccctctatgcctgctcacccattttggagtactcaccatccagaatccctatctgcttcactcagattcccaagagacccagcataagggtcaacccttgtacattcactgtattcctaggcagcacttctatctccatttggatctcctttcatgcctaagaaatggtgctggacagcctaggcacaaacccaaaagccttttaactctctgcattaagcttagatcttatcctatgtggccaaccttcatttctttcctgtgtcccaccttggaagctctagctaccaggcataaggcacctccagcccagactaaagagacaggagagcaaggaaagggtaaggagtccttgctttcatttcttgtgctgtttctgcacagtctgatgatgttgagaagcataagggaagaggagatcgccttccctctctgcccagcgtggggtgttctttcacctcctctcagtctttggctaccccagctgtgaagttaaccctctctgctactctctctgggaaggatcaccctcccctcccaccaagaagctgggagagcagttgaggcagcagactgctaaatgcccaggtcacccatgggaaactccaagatgcactttgctgtctcctgtcttttccatgcaatgatgatggcaaataggacaaatgagggtgcatagattcatgaacactgggtttatttgcgtgggttgtgatagtggcagcaaaataaaacatggcggtgccattatgcaccttttatctactgccacactctcctccaggtgactttattttctacatagataaatatagtaagaaatacataataatacatttattttttcacataaattgcagtcaaactacacctgtggtaggcagaataatgatctctcaaagatgtccatgttctaatccccagaacctgtgaataggttatgttacatggcaaggagaattcaggttgcaggtggacttaaggttgctaatcagttcaccttaaaatagagagattatcctggattgcccagatgggcccagcataatcacaggttcccggaaatgtggaagagagaggcagaagagtcggtgtcagagtgatgcagcatgagaaaaccatagctggctttgcagatggaagggggccacgagccaaggaatgcagggagcctctagaagctggaaaaaggcaagcaaatgaattcttccctagagcctccagaaggaacatcgccctgctgacaccttgattttagctcagtgagacccatttcagacttctgactcttagaattataagacaatacatttgtattgttttcagctgctaaatatgagataatctgttccagcagcccttagaaacaaatataaaaccccagtctctccccttctcatagaatctgaaggccaaattgttcatcctctttgtctttaatataccagcatctccgagcaccccgctgactaggagtgcctcttatagccccaatacgtgtatgtctcattctgatgattcaatacttccttttcccatcaataaaatacaacattcaaaatatgtatgcccatctaattttactgtttcctttacaaagcctctgactttatttatgtaacttaacaaaatagatttccctcttctaatacaataaatttcccttccgaccagtaccactcatctctgacactggccagcagattagttgctcgtaatgactttggctttgttgcctggttcaggttgtcaggactttctgtgttccttctccacgtgttcctctatagcatgtcttgacgcctcttgcctagaccttttttagagaaggcatgacatggcacaagctcccaggaacaatttcattcatgcttaatgcctgttgcaaagtcatattttttgctcttatgttgggtggtcacaaaaatctcaccttgggctctcaaccacattctcctaaaccaacatcaccatgagctctcaccacctctcttccacccacttctctaatgatattccaggatttttcttaaagagatctggctatgagcctgtatttcattacagcttaaataatcatattatttcccatttccttagttgctctctggacttttaagattctactgccttaggctggtcagcggacagctgccttcattgccatgcatatagtaataggcagctggagcctgcaggctcctcttgggaccaggtgctggctgaactctcaccacagcctctcctgagccttccctattgtcccctcagcccagcactcactcagggctccatatggggacttgtccacaggacctgacctggctggttggaccccacttcccaggttggagatgtgaccacatcgaggatctgctagaacacatttggggaggggtctgataaaaaccccagcctgtctcattgaaatctaaggaagcaagagggaggaggggaggacatttcatttttcaatccctatgttctacttcagggaaatctatttctggtcttaaaaaaaaattccccaataacgtaattaattaaaagaggtcctaccttttgccttgagctgccaagtggatgtcttttatttgagattcaaagctaactaaggctgagattattggaatggccagggcagatgtcctgggaggacaaagggggcccccccaccggctgtttgctcatctcagattttgagaatgccatggatgctgaaatgcctcataattgggagaaccccccaatatgtcatcgtgactcagatcctctggggcacctcagtacaactcgtcaccccctgaacaggatttcggttttctgctgctggcttgtctttgtgctgatctgagcaaaggagacaggtagcccagtgttctctctgtatccccacatccagcttgctctctcacattccctgtagtgggttgaatagtggagccccaaaagataggtcctaggccttacctgtgaaacctgtgaatgtgacctcctttgggaagagtctttgcagatgtaattcagttaaggatatctacataaatcattatggattatccagagactccaaatccaatgacaagtgtcctcataagacaaaaaagagagcggatgacacaggcacagaagaaagccatgtgaagacaaagacagagatgaaagtgatgcagccacaagccaaggcatgcctggagccaccagaaactggaaggaaaagaaaggaaaggaaaggagaggcaaggcgaggtgagacgaggcgaggcgaggtgaaattatcccctagagccttcggagggaggatggccctgccaacaccttgatatcagacttctagcctccaaaaccgagtataaacttctgttgttttaaccatttgtggtcatttgttattgcagccctagaaaactaacatattcctcaacatgcaatgccatttcttttataaagaattcaatcagcccaagtagctaagaagtggcttccaggtgcagcaccaacttgtagcctggtccttcctgccatagtgctttcttacagctcccttgcccaggttcattctgcctgagatgtcgtaaagctcttgatatggtttgcctgtgtccccacccagatctcgtcttgaattcccatgtgttgtgagagggacccagtgagaggtaattgaatcatggggcaggtcattcctgtgctgttcccatgatagtgaataagtctcatgagatctgatggctttaaaaatgggagtttccctgcacaagctcgctctctttgcctgctgccatccatgtaagacatgacttgctcctccttgcctcccaccatgattgtgaggcctccccagctacatggaactgtaagtccattaaacctctttctcttataaattgcccagtctcaggtatgtctttatcagcagcatgaaaacaaactaatacagctcttattggtgaagcctggccccagggaagatgcataccttgcaggagatttataggacagaggatgtgcctctagtgtgcccgtggtttcgcttgtctattttatatttgtagaggattgtcaagattctttggagatgctttcccattttctatcacaatggtcctgagtgctcaacaagcctgttatataacatgatgaacttgacaaagatcagttaaatgactcaaccaagaattcaaactaaggcttttcaactgggaccactgctgcttctaccccaggggtcatgataaacacctgggacagcgaggaggctctgaggtgtccgaaaatttacatccatcttcaaaaccaaaattaccaggggctctttcattttgatttgatgaataaaacatcttgtgtcctgaatgtttcagaaaattgaggaatgagatatggttctctcaaacttggatgtgcatatgaatcacctgggggatcctattaaaaagcagaatctgactcaggaggcctgggctgggacctgagatcctgcattgctaacaggctcccaggtgatgccagtgcagctggtttatggatcacacttccagtagcatgagatggcacctctgactaatttctctgcctgttcagcattaagctaattggccattattgccctttgcaattcagtagtaggaattgtggctctgactttgctgttgtgggagaagatgctgacacacaagctggcaatgcttaaggaaaaattttattgtggatcgataaccataaaaatattcataccttttggtcaaataattctgcttatggatatgcattctaaataaataacccagaagatgaaaaaaaaaaatctgtgtgaacaacggtgttctaccacagcactatgtatattaaaaaagaaaaaaatctgtgtctaataaaaaggaaacgattaagtaaattgtaataaagtcactcaatgcaaccaagacaatattgtagacatatgttcatcttctccctttcctcaaatgcaacatgtcactaaaggaacaaaaatggcatgaactcacaaggttaacaaactattaataatttcaacacatttgtccaagatacaaagtttacgtaattggggaacataaccacaggcccctatgtctgtatttgttattttttatttttttaattggtcagcgagtacaaggtatcaaagtaaaatcttacaatttttatacatttctgtatgcctgaaatatttcaaaatttaataaaaaagaaagtgcatagggacagagtaaagaacattctaacctacatgttgggggcagaagtgatgtgacaaagtgagccagttttcgcaacaaagcctggccttggctcttgaaggcactagggaccatggaaagcaggaatgaggcatggggctaacagcagaggaatggtcaagtctgtcacaggagactttgcacccctagatctcctgccctactaggaaacaatccttcccacctaccaccactgcaggagatgggcagttttttcttgagagaaattgagccacatacgctcagatctcagacacatcagatctcataagaggccacctgaaaataagagaattaatggaagctctacgcactgaactgtggggcctgtagggatggaaagtgtgatacctttcctcatctaccataaggattacggccaacactgctataacaaaagaggttaacaagagaaaagcataaatgcatttatttcatcagtttcacatgacacagaagccttcagaaatgaagactcaaagacccagggaaaactgtatttgtgcttaggttccatgaagaatgggaagccttgtagaaatgtgattggacaaaagggtgtgatctactggtaacagactgaggggaggaaacccagcaaggcctgtctgttcagattcttcttagtgtctctgagtagcattcctacctcccaggtaggacctctctggaatgagggttttcaagggagaagggagcgagtgacctttctaggttttgtggcttgctttgcaggagaggcattctagtttctatgacccactttggcgaaaaagaattcttgtttctatgacttacgtcgggggagaaaaagggatgggagacgggggcaggagagaaggtgaaagccttggcttctgaggcccttccattctcctttagttcaaagtactcagcatgccaacatactatactttagggtatcatgttctgagccccaacagaccctcagcccctccccgaccctgctctcaggcctccaggagccagacatatatacccacaggcaagagactgtcaaagtacaacctgtgggccaaaccatactccattctgtttttgcaaataaagttttattagaacacagtcacacgcattcatttgcaagctgtctatggctgcttttatgccacagcagtagagctgagtagtggcaacagacaccatctggcccacaaagcctaaaatatttactatctaggccctgcagaaaaagcttgccaatgcctgccctagggaaaaatagacgccccagaggaaagactccagatccctcatttggagctcccattaaaatactggtaaacttccctatgacaatgaagcccatcagtgacaagccccatccacacgcccactgagccgccaagcaggtttcagtacctcagtcttaagtacaaatggatgtccaaagattttccagacactccaggaaggctcagcgtgaaagagtataatcaaaataaaccgacagaaaaaaggaacttggaagaaccaaaataattcaacaactggaagaaacttacaataaaagtatagaactcatattatctgagaaatgagaaggtatttcatccataaaacaagaactagacactatgataaccaaaagtgaactctgaaacttagaaagtaatggctcaaaattaaaaaataaataaatagttaaaagagagtttaacaaaaagacaaggagatgaaaaatgggagggaaaataaacaattcaggatgtccaatattgaactggaaaaaaaaatataggacaagcaaacaaaggaaacaaagggtttaaaattagtgatgaatactataaaattcctgataattattttcttatctatcacacactgtgcccagcatagtaaataacaacaaccagcaagggccatcatgaaattgcagaacactctagcaataaagagatgattctaagttgacagagagaaaagaaactgaaccaaagaacgagaatcaaaatggatccaggcttctcaatagtaacactgcataccagaaaaaaaaaaacatggagtgatgcctacaaatttctaaaggaaagagatttttcacctagtgttctatgtctagcactatcagtcaagtatggagataaaagcatttttagacttgcaaggattctcatgcatcctttattacgaaactactaaaggatgtgcttcaacacaatcagggagtaaaagcaagagatagacatggaatccaggaaacatgggcttttcaacacagaagtgaaggaagtcccaaaaagatcattttccatcaagtctatagagcaaatgatccagtttcgagcaagaagactaaagacttcaggaaagaggatctctgggaaacaagaggacagaactgctcaattatttgatgtgtttaaggtataaaaaaatgattgctagatgttttacaggtttgttaaaacacttgcttggaaaaagtagtatgatatttagctgaacagcaaacaatttttatctagtttaataatgttacactgaccattgatttaacaaaaattgtaacacaaatctatttggaggatcacgtaagaaaaggagggagttgaggactggtgaatagaaagataaattcttgtctaaaataaaaaaatcaggaatagatataaaagcgtataatttagaaatatataggtagcttttagaaaaaacataaggtggaaagtagatgcctctctgagaagggatgggaggaaaaaataattgcttttgcttttttagtatatataatcatttggtactattttattattctaactattcacatacattttgataagaataaaaattagtctaaaataaattatatcaatctataagatcaacatatctattagatcataattataactagaaaagttgcttttttggaaaaaaatgcaaatgtttactccttgtggtctgctgatatttaaaagtctttatcataagaaagtccttccgttgggaatgctgagctggcagtctggtggagctgtagtgtcttttgtgtgttccagatgcctcgagaatcagtctttgtgggagggtggaacacaaacagttttgaccagtgtattagtatcagtaaggctagcataaccagggagagatgcaccaaggttcaggtaaagaatcaagtgaggaaaagatatataaaatgcatgtatatatcatggctgcaacagtgcaaaaatggtatgttcgttataagaaggaaataaggacaaatgaaaacagtttgatgtgtcagaagtgggagcggaaataaattttttcctttaatttagaattatgtgaagactgctataatgtttgtgtaaaacagaataaaggggttttctaaggaaatcagtggcattctttgctctgcctccctcctgcagtttaattgcctacacggaacaatatgtggaatatgaccctttgataacaccagctgagccatccaacccttggatcagcgatgacgttgctttgtgggacatagagatgaggtaaaaaatgttttaaggtttgggagtgggatgaatgtagacaaaaatccatgagatcatgagattaccttatattctatcttaatttgacattttttatcgctagaacagaaacccctcaagtagcctcccagctgagttctacttacagtttctacctccttatagctttgatttgtgcatggatcctttgtggctcccctctgaccctttggataccatgataactgagacagtccctcaccattccctagttctgattgctggaagaaaagaatctgttgttccaattttttttcctgttagacagcaacaataatgataatagctggcacgtattctgcattggccacatcctgcagtaagtgtctctcactgaatcccctcgacaggtaaacattactattctcaccactcagcagttatggaaactgaggcacagaggagttaatgaacttgcccaaggtcatactgctagtacagcagagttaggactagaactcaggcagagggctccagaaccatgatttcatcactctgttcttctggagtaactgccagcaacgattccagccagtttctccttccctgtgagggaagccactgtgtttacttaagaggggaggaaccaaagcccagagggacttggaccactttcagaattacagaaggaaacacacagacaaagctagtgtggtgtgccttcacaccccctgcaccttggctggatgaatttttatttcccttttcatgtctctgtcactcacattgtctttcacttttgccccttttctggctgcttttcctgaaatggaaaaaatcttataaaaataataaaagtcgcagatgctcattctaaaaagttcaaattatccagatgtgcataaagaagaaaatgctctcttcctccaacccgatttcaccttccagaaagaacctttgtttatagtctaatgctgtggttcccagagtggatcagagcaccctgagcactgtggggaactcacagagttaccactggatagtccaaattttttatggaaacacagcgatggttgacacatggcagatactgcataaactactagcttaagatggttcagtttcaacattagagcacgttacatcccttatgatgatacgcatctttgcaaatctggcttttcggagcagtcactatgataaaaagcaagaactgcacaaaaattaacatggaataagaaatagggacggtaagttccaacctaattccaaaatttaagaaaatgcgtagtgcccaataggtgcatattgtagttatttaagaatgaaaacaaaattttcaatttatgtgtctttcaaacagctactaagttgttaggatacaaatacatattaagttgattggtcctagccataataaatgacactgttaagtatttcttttggcccaggggcactgtgaaaaacttactgagacgctaagggtaccatgagctcagcaaatttgggaacatctgatttagtgtctattactttggatttttatgcacatataacattctatccttttgtataattgggttcaatatatatacccaaatatgtacatatatatatatagtccaataatttttaaattaacaataggtcgtggcagtctttccatgtaaacacatatagatccaccttactctttttaatagctacatactatcccctggcaccggtgaagtaagatttattttaccagtacctggatcataaatatttagcttatgtcctccttttttgccaccataaacaatgattccgggaacatctttctacacaagttcaattatttcatcagtatatattttccaggagtagaattcgtagaaatggtatgcatattttaattttagttcgtaggtccagattcctcttgagcaaaactgtaacacatctttttcattcccttagcttaaaagtgcccatttccccacattcttaccatcccaagcatcatcaatcattttgtctttgcaaatccaaaaggttaaaataattctcattttactgttttgtttccttgttaatatacttgagaatcttttcacatgtttattagacagattctagcaatatgttttgctttggatatttggatataaaacagtcacatttacttgaatcatatattttatctttttcctgatatatttctgaatctcattctttgttcttgtttctttttctcttccctgacttttactttattaatgttatattaactttgtaaaaaccctagtttctattctagttgtattaacttttaaatgttttaattaaaaacatcatcgatttaaacaaacaagagtgaagtatataaaatagtgaagttacctttgcctcccttaaatcccattcttcccagaggtatgttaacttgatatattttaaaccaacatttttgaacttgtatttctatgaacatttaaagaataactagtatatagtacgtatcttctttctaatatttctgatgagccctaggtagttccttctaagtcaagaacttaactctttctttaactcaggattttttttctcttttttaaaaattattgctgctttttttccattctatcctcacttttcaggaaatccttttttaagaagtctgggcctctgggatggagttgctacatcttttatattttctctattataatttccatcttttagtctttttattctatattcaaaggatacaatttcctgaattgctcttcagaatcactgctttgattttcactggtgtccattctgtgattttatactttagagagtttttcttttcccactgagtgttgggagagtggttgataatcaagcttttcatttccaagacttcttaatacttcttggactgttcttttcttagtagcctgctctgttctattggtgtttatcatgttactccccctggagatgtgatatagatttttttcatagtttatattttttccatattttcatatctcctctctatttctgccgcttagttttattcggggttattcattagagaatcatcatttctgctcattgtttcattcattcctctggtcactgctcagagcagatcattctttttgtatgcccagctatttggaagactgctcatttttataaatgaaggtcttagctttcaatcctgccatacattagaaccacctggaagtttctaaaaaatactaatgcctggtcctcacacacagccaattaattcagaatttctcacaattgaacattgttttttaatctccccacatttttttttaaatctccctttttaaatcagggagatttaaaaagtctaatgtgcagccatggcctaggactctatcagtagctggtgagggtgctctcagtgatggtatgggccaatggttctaagccatgctgtgcatcagaatcacctgggctcctctttaaaaatacacgcatactggggtggctctgggcgtctgcatcttgagcaagcaccccaggcgttctgaggcacacgacagtttaagaagtcctggtttggttcacggagttccccggcaggctttcccctgagcagttcacacaggagcagggctgcacctgaatgtatgaatggatgggcatagatcaattgccaaggttcccctctgggtcccgggtatgtggtccaagaacagattaaaagattgggccctctcttacagtgagacaggtggcaatgggagtcttggggaggtagacccccacccttcctagtgtgacatccctgcagccaagtgttctactctgtgggtcaagccctgatggagtttctgatgtctttctatttcctcgccaaggtactccccaacaagtcgactcttctccctccactaatgggtcttaggggaacccacttggatctgcgaaagccaatgagaggtggggagaaagctaatgtgtctttaaaatctccctggttcccaagatgttttttctctgtgtgtgtgctgtgctggcaggaacacaatcctctggccttactgtccatatgagaagctggccgggaaacatcccccttaacttagcaaacccttttggccatgtggaacctgatccatgttcctgagttgcttccatatgccccttgtctgatgccacccactgcctccacttccaatcctgctgctcagagctcggggtttcccaaggcttctgttggggacactcagctattttcttctctgatgcctccactggaatcgtaggctgctgtcgatcagatatgtcacaagttcagtctatgtgcttcgtgccttcctgaaatttctcaaagctctcatctgctgataggaaatttctttgcctctacatactgtgtttagtttttttggggtttttttgttgtttgtttgttgttttttttttacttaactgagctctgggcttttgcctgttccctcctcgttggccacttgtcccccagatcctcacatggctggcttcacttctcattcaagtctcactcagcactggtgtcccttcctcagaagggctttctgtgaccaccaatctagagtggccacctcatccctccagctgttctatatcacatcctcctcctggttccctttctaaatagaatgatttcagcgcctaggcctatctggcatacagcgggcaccgtgtgggctggagggaggatggatgaacaagtcattctttatttgatcgtttcattggtatttgggaaaggaggagaggcaaatgtgtgaacctaattcacaatgataaaatgaacttcctcttttgttcttgaaagtcagcaaagaagtatgtaatcatgtaggaaaatggggtcgcatggcctattggtttattccaacctattcagcactttttccccaaggaggtgctacctgccccctactactcatgccctggttctactcctgttgttctagcttcgactctgaacttcatgcctaatctaggatagctacagtgttctgtccacttacaggcagaatcaagtgttcagatacaagtgaaaacgaagccctgtttcttctcccaacagactactcctacccacttagttgctggcagtgatgttaggaaaaaacagggtggaatcagtgtcaacatcacactccagccaagggatggtttctgtccacaaaacgaaggctgaagatgaccaataaaataattgagtcactttctctcggtttcagtttaattcaatacatttgtatagtagtcaactatgtgctgtgttctgaacaagaagggctctcaagataacaaatgtagcaaggtaaataaaacatgctatcttaccatctggcaccagaactcctccttgcttggcaaaggacattaagccacttggggcagaaggtaaggccctaagggcagaagggttggcagagactgaaacaacaaagggagagggttgtgctgtcctgctgagaaaacgagacaaatgtattctctgttcctgagaggggagaactaagggcaggggaaagcaggggagggagagaagccagaggccaacaaaaactaagtctctgtgcaaggccagggaaatgcctagcattgaggtgaccagggacttttcaaaagcaggaatgtctagtatgtgcttttttaaatagtaggctgccaggaggtgcgatatgtacccatttttcaagaccctcaaattcctgtaaggcccccaccctcccaaacgcttcatgagaggaggggtttggtgggtgtgggtgaaggtttgtgggaaaggagagacagtgagaatgcaggactcccttaggaattcctgccaatctcaggtgggctttggacttcactgggctgggtgaaggggtccaggcaggctcgttatgatttccagggcccaggatgtcaccgacaatgtctaaattctgcaaggtggagaatatactgagtctgccgtggggaggttacagacagccaaatggaggatggccatagcagctgaatagaatcacggataagatgacataggatatacaataaatagcagaaaattgtgctttaattctttctccttctcagacaagctattcgatctggaagtccaaggataagaaagttatattcagaggggaaaaaaaggcaactgttttaaaggatgggcaaactacacctcaagtttatgcaacatagtgagctgtgatcgcaccactccactcccgcctgggtgacagaacaagacccctaaagaaaaagagtaaattctgagaagtaaagtttaattaaagaaaatagtgattgccagggcttctcattgaggagaagtcagtcaaaagttgccagatgacgtaattctttatgtcatctgaaaaccaccaggagagtgtcccagggatacgtatgtaaagtatttctggtggtgccactaactagatgctggagtctaatgaaacctggtgttgtcagcagaatgtggtttgtgatttgctctctccgcatgacttcagtttagctctccctctctgctgggtatcaggcacatgagcaaagagctacaaggaacctggcttgtccagcttggccgtaggcattcactcccagccaacctgacctgctgagaggcagagatcatccctgagctgcccatgcacagcgagtttgacagaactattaatccggaatattagtcaagctcctttcttatggtggtggatctccaaatatggccccattggtgccttccctctttacatcaagtaggacaccaagaccaaggccagatgaaaagagagggagcacctttttccctctctcaaactatttgagaaccagtaatccagaacccctgtggtggcttccaccttggtcatttgaaatatttgctcttgagacattccttcttggaatccatctgccatgcttggagaagcccaagccgttggagaggccatgtgcagacagtctggtcagtagcctctgctgagctcctggtcagcaactagcatcagctgttaggtgatgagccctcctggatgcacagcccagtcaaatctccaaatgaccccacctccagctgccatccaactacaaccatgtgatccccaagtgagaaccacccagtggagcctagtcaacccataggagagtgaaagagactaataaatggcttttttaagcccctggattttaggatggtttgttacacagcgtaaataactgggccaggcgcggtgacttatgcctgtaatcccagcactttgggaggccgaggcaagcggatcacgaggtcaggagtttgagaccagcctggccaacatggtgaaaccccgtctctactaaaaatacaaaaattagctgggcatggtggcaggcagctgtaatcccaggtactcgggagcctgaggcaggagaatagtttgaacctgggaggcggaggttgcagtgagctgagatcgtgccattgcactccagcctgagcgacagggtgagactccatctcaagaaaagaaaggaaaagaaaagaaaaagaagtaactggaccactcttcattggagtattcaggaccctcaggttgttcttgaggtattaaataaaattatgattgtttctttagtagccttggctctgagatggggacattggattattttctttttaaggaattgccttatttcgtaatttttctaataacttgtcttagtctgttcaggctgctacagcaaaaatgccatatactatgtggcttaaaaacaatataaaaatttttttcacagttctggaggctgggaagttcaaggtcgagatgccacagattgggtgtctggtgagggcctccttcctggttcataaatgtctgggtcctcacatggcagaaaggcaagagagctctggggtgtccttttataaggacactaatcccactccacgtgacctaattacctcccaaaggcttcacctcccaaaaccatcacattaggggtcaggatttcaacatataaatttgaaggggaacacagacattcagtccacaacattctacctcaagatccccagaatttatgtcatcttgcatgcaaaatacattcattccatctcagtagtccccgaagtcttaacttgtcctggcatcaattctgaagtccaaagtcttatctgaatatcatctaaatcagatatgaatgagattaaagataccattcatcctgaggcaaattcttctccagctgtgaacttgtgaaaccaaacaagttatgtgcttccaaactacaatggtgggagaggtataggatagacattttcattcaaaaagagagagagagagagagagaaataggaaagaagaaatgggtaatgggttccaagtaagtccaaaatgcaacagggcagaaaacattaaaccttaaggctctaggaataattctctttggctcaatgctctgtcttttagacccactggggcagcagccccacctccatagctctcctgggctggagtcatacacccatggctttcctgggctgatgctctggtcttccaggcccatttgggtggcagcatcatccccacagcttggtgggatggccctacagcagctttctcctggggtccctattgctttcccaggctggggttcctcacctgcagctcttctgggcagcccagtccaccatggctctgctgggtgcagcccatattgcagctttctgtggggaccccatcccaagtcactgggcaggagcatcctgatctacctaaattgaagagacgagttgatcctttaaaactgttctgctctcctactacatgtcccttgaactctgggcctatggtgcaagtggcagccctgatgaactctgaattgcttttgagtaattcttccattgtcttgaagaatagttcctggattctgttaagatgactcatccatactaatatacttatcaaacagtcacttggccacactattagtggtctcattttttgcatatgaatagacaaagaatttttcagatcttcaggttctggtttctttttgtgcttaacaattctgtctttaagtcacgttttactataagtagtcaggaagagccaacctgcaccttcaacacattgcttagaaatttcctcagctaaatatttaatttcgttgcttgcaagttttacctttcacagaatactagaaccaaataaaattcagccaaattctttgccactttataacaaggatcaacttttctccagtttctggtgatatatgtctcatttatgtctaaaactcatcagaatggcctttaccatctatatttctaccagtattctgttcaggattatttaggtattatctaggaagattgaggctttctttatagctctcctctttactttctgagccctcgccagaatatcctttaaaggcctggttacagcagtttaggttcctctcccctcctctcccctcccctcctctccccttccctctcctttcctttcctttcctttcctttcaagatggagtctcactgtgtcacccaggctggagtgcagtgtcgggatctcagctcactgcaacctccgcctcctgggttcaagcaattctccttcctgagcctcctgagtagctgggaattacaggtgcccaccaccacgcccagctaattttttttttttttttttttttttttttgtatttttagtagagacggagttttgccatgttgtccaggctggtctcaaactcctgaccttgtgatccgcctgcattggcctcacaaagtgctgggattacaggcgtgagccactgcacccagccaatttaggcttttgctgacatatatctcaagacccttccagcttctattcattacactgtaagccacgttcacatttttagttgttcattacagcagcttcccactcacagtacgaacttctgtcttagtctgttaggactgctgttacaaaaatactatagactgtgtggcttataaacaacagaaatttatttctcacagttctggagctaggaagtccaagatcagagtgctggcaaattcaatatctggtaaggatctgctttctagttcatagatggctgtcttcctgctgtgtcttcacatgacagaagggaaagggagctctctctggtctcttatagagtactaatcccactcatgacctaatcacctcccaaatatcctgcctcctaatacgatcacattgtggatcaagatttcaatgtattaatttggagagggacacaaacatttagtccttaacataattcttaagtgttttgaagatagcttgtatattccccaagtcttagtttagatattgattgaggcaaatgtagtagaaggcaaggtaacagagtggaaaaaaagaataggctttggagacaggcagtcctgggatccaggtcctggctgccacctaccagctgtgtgaccttggacaatctgacctcttttgaactctggatgtttaaatacaatgtcagcctccctggcttatattaagatttaaatagggcactgtaaggaaagctccttacaccatgtgtagcactatgaagctcctgcagaaatgagcattgatatagacaattgcttcctttgaatctggctttcttgtcctcagtttggtaactttcctccatctctagctgggggatcagcagaaatgaaagacagacacccttggagagctttgctatgtgttggtttgggctgtccagtgggaggcaggaacttgataagaatgaagaggcacagaggacaaataagagttagaaaaaggcatccagctagcgattagaaaacactgtcaggataaggacacttcatccacatcactatacacatttctaaactgatttcattttagtgctgaacacttgccatgtgaaaagtcctatgctcattacaaagacacatgaaatatggtccctgacctcaaagagctaaaaaaaaatagctggaaagacaatggcataaactctcgaaaatccaaatgctgacataaaactctactagagaatatgtcccaaggaaatatcgctacacaatggatgtaaagagactgtgcttctgtggattgtttgcttgaatttggctgagggacagttattgtaccacttacctggagatggatgttgaaagatattttaatttgcagaattattttataaccataagagaccattcagtggtaacaacatgttcaagtcttttcttaaaccttgaagtggatgatattgggaatactcaagtgatacagaagagatatgtatagggaagatgtatctaggaagcttttaatagaacagactcccagtagtgaaatcgtactaggaaaataaggaagaaatgtggatcatccagttgtagtaatacaattgtgaataatggatagttgagggaagccaagtatacatggttacattgtatcgactaaaaattcatgtctttcccagaacctcagaatctgacttatttggaaatagagttgttgcagatgcagttagttaagatgaggtcgtacttgaatagggtgggcccctaatccaatatgactgatgactttataagaagagaaagcaggctgggcatagtggctcacgcctgtaatcccagcactttgggaggccgaggcaggtggatcacaaggtcaggagatcgagaccatcctggctaacacggtgaaaccctgtctctactaaaaaaaaaaaaaaaaaaaaaaaaaaaaaaaaaaattagctggccatggtggcgggtgcctgtagtcccagctactcaggaggctgaggcaggagaatggcgtgaacccaggaggcggagcctgcagtgagccgagatcaccccactgcactccagcctggacaacagagtgagactccatctcaaacaaaaagagaagagaaagcagagacacagacacttacagagcaaacaccatgtggagacacagaaacacaggaagagagagtgcagtgatgcatctgcaagctgaagaatgccaacatcagaagttaaggaaaagtcatggacctggttctcccctaaagctgtccaatagagcatggccctgtcaacaccttgattttggacttctaggctccagaactgtgagagaataaatttctgctgttttaagccacccagtttgttagtcctttgttatggcaatcctaagaagctaatacaccagggtatcctgtctctctagacccatttatttctgctgaactatgaccttgccattttccagatacccccaccttctgtcctaagcatccctctgattctacatctacagtgacaccccaagatttctggcccactccaaaaattgcccttctcccactcttgccaccaccaaggaatctggtggaatgaatgtggactcaccacttgggtaccagaaaggggtgacactggtggtgggtgtgcatccatgaggcagtcactacaaagtctgagtgaatttctacagctgctaatatgggcacagccctcattcgagtacagctgccactagtaccatccctggagagccctgaatcctcctctggtaaagagtaaatggttgggtccatccttggtcatagcatgaccttggcagaaagagacaatgtcctgcagtctctggggcttaaatttactgccagcctcaaccccaggggaattcttccacaaacagtatttttggttcccttgaaagttattgagtttgattaggtctgtggcttgcgtttgagagaatccaggatttgtcttcatgtcttgttgtgaaaggcctagcctggtactttggaagaggtgtttcatggagtctcccattgtttgacctgatggggttagtctaccaccatgaccctattggactatgctggaaatgcagagttgcaagccagaggctccctgacctccaggctcatgatctattggtcatcatcattgtaattagaagatactgctgttgctgattatgtgtgttggtgaagaagtagttgggtttggatgcggtatgtctagagctgcataccaatatagtagccactagccacatgtagctatttaaatttaaatttgaatcatttaaaattaaatgaattttaaaattcagttcatcagtcacactagccagttttcaacagcccaatagccacatggggctagtggctgccatattggagagcacggttatgggatattttcatcattgcaggaaattacactggacagcgccagtctacagttatttgctttcccaagctttccacgcacacaagctcctttttttttttttttttttttttttttttttactaagtggaattttccaagtattgagaatatgtcagctccataataagaggaaacatgatttaatctcttactgtctgttggaaataataaaatatatgcatctattttttaaaagaggaaaaatgagtattgctagaccaatgtttcccaatttgtaatgtggacataaatcacctagggttcttgttgaactgtaggttctgatttagcaggtgcaggtggggcctatggttcttcttctggttcacagaccacaccttgaatagggaagagttgtagcatgtgacttgtgagttaggaccttatcactgtttaaagggccaaggacataaatacagcaagtgaactttaaatggaaagacagaagctgaaggaaatactcttatcgcccaacaccagaagaattagaccaatgcccattctttagtctgaatgtgagacagcatagcaaagatgagctatgcagcatggcagaattaagaactggggccgggtgcagtggctcacacctgtaatcccagcactttgggaggctgaggcgggtggatcacgaggtcaggagattgagaccatcctggctaacatggtgaaaccctgtctctactaaaaatacaaaaaaattagccagacgtggtggtacgcacctgtagtccccgctattcgggaggctgaggcaggagcattgcttgaacccggcgggcagaggttgcagtgagccacaatcacgccactgcactccagcctgggcggcaaagtgagactccatctcaagaaaaaaaaaaaaaaaagacctggtgccctctggagccttgctgtctagatttgattcttgacttcattacttcctagctgtgtattcttaggcaaactaccatgagacctcaccttccctatctggaaaatgggaatcatactagtacatttttcacagagcagttgtgaggactcagtgggttaacagatgtaaaatgcttgagacggtgtctagcacacggtaagcactgtgcatggttgttaaatcaataagtgcatgtaacattctgcttctaacaagagaatatgctttactctggatgtgtcaatacatttctgaccagttgtacatcacttggcttgaaacaggaccataatttctcccctgaggattgaggaaggggtgggaggtggaggatagtgtgttttgatgaaagattgggtccatgaagcatcctgggttatagtactagtgaaaaaattagagtcaaaagttgagtccataattgataggaatggtccagggagtttaatcaatggcatggtagacagcagccatttgaagggcatgccggcaaccatcacttaacatgcctccttaaagaaactgttcatcattggttactgttggtgtaccaaagtctgcatttggaatttgtgcagcttttgtagaatctgccccttaaatatgagatgtttccctttggtgagtgactgcaaaacagacttgagtcactgaagagaatatgacacgagcttttctctggtattgatcttctttaaaccttcttccttcaccccaaagcaaagagcccagccaacagcgagtaaaaagatggggcttctctttcgatgagatattgaaggaccaggtggggcgggaccagtttctacgattcctggagtccgaattcagttcagaaaacctcaggtaaatctctcaaagtttgagctgtgtgcggaatgtgtgtgaagaaatttgcataatcggtctctccatctctctctctctcaatgaaacgttatcagggttcaaattcaaatgccagctaatctggctgaggttgaaatggagaagaacaaattaaaatatgtaactctgtcaccaccataatagcacctactaacaccagcatgtttcagttcaagtctatatgacctttgtgcgactaattggaaataagtcttcaataataattagtcaaacggatttgacaacatcattcattaagtacagccatagaaccagggagcttcagagtggagaggcatctcagaggctgtctcctcaaaacttcccagtctggggtcctgaatatctgagaagctaaacggaagagggagaagtcagtgggctcatttcagaatttcaaagagcaaagtaaatatcactcagtaactggtgatgtaactgtagcagctacgtaacagtagcagctaataaaaacatgcttttttcttttagaatgacttctgtcgactccaaatagtggttactctgatcatctgacgccagtgagaacacctgattgttcctattggtctataactaatacttgatgagggaaatgtattaataattactatttaataggagaaaaaaataagatattcaaaacctcaggtccaatatgagaggaagaaaagggggtgaattgaaaggaaaagtctccttggttatgaaaaatttgggaacttgtttatttagacttttatggtattagatgaagaatcagaaatctgcagaaaatgtgacttatctgagacttatctagtgatcttagcaaactggtgactttttaatgggtaagatggaatctctctctttcttttttctttgtaccagattttggtttatatagtagagtaacacccatcttccagtgctgttttctttaaagatgtcttaataatgtttcaatattgtattactttaaaaactcagagcatgtgctgcgggcaaaggactgcccctccaaagttaatgtgcaacatccatgcacttatttgaagttgagaccatcggtcccatacgtcaatcaagtgatatttatgctacacctgtgctgtatcaagccctgtgagagtctgctgagagatgcaagtcaagatgtgtgatctttgcctgtaacgaccttgtaggtccttgaggaaaaaacacaagaaatgattaaatcattgaatgtctataaatgagtgtaaactctaagaaccatttcgaaagcatttaaaggagaagaatcaaagctgaagtagttaaatcataagctggactttgaagaatacacaggataatagtagacgaagaagcaggagagagaatattccaagctggaggaccaaatgaggaaagaggtggccgtgggactctcccactccataaggtcctgagaggacacgtagatgccgactagctgtatggagcgtgctgttctaggcatccacgtgtctgttataaaccagacaaggttgagtatcttattttgggttattatacaagagcctttccttgtgctgaagcatgattccaaacacatctcagagcttcatttcaatgcctaatgaagcatttgtaacagaaggcttgacttctaatactcttcactagggtggtgctcagactagcctccctgtataggaaggaaggctctctgtggccagcttgatggacccaggtggcctctctgtgtagccagctcagtcccagtttccaccccctccatggtccctatgagccacccctgggagtccttctcatcttcccttcttacctgttccccttgggtctccaagatggagcggtatagaggccccctttacctaactacctctaagcccgtaagtagcctcaggaccctctgctgcctgcactcttgcagagagcttgaagaatgacccagagtttggtcattgtgagggtcccaggagcatccactggctcagctgccaccttgcctggtcagagcattcattctagaaagtcccgagtgtagccagaaccacatatcagttcagactagtttcacaaattatgcatcacacttaaagcccagagtgcaccaaggagtgtgtccctggcaggtgttcagtgcttcttcctgccatcacctcctgcgcctctgccagctcctttccccatgccaggagggctacatttaatcttgggtgaaagcatgcatgtgagcatgtgttcatgtgccagagcctaagccacacccccagaatgcagaaatccagacttcagagggtcacccctgctccatgacaggaaaggaaatagaatagcagggaggaaaaggatagccaagagcctctaaaatcctctctggatgcccaaattccatttttatgatattcagcataactggatacatggtgggtgagagagaagctcagtcgtaaatcacataactgtaggactcttcagtcacccatcacagggcagccttttccccgttccattgcgttcatcccttcagctgcagatatcatcttagcaccaaccgtggcacagggctggcggatttagagctgactgagtaaatatcagggtggccaggcatggctatacagatgcacctccactgtggctcatgccatggaggcccctgggagttgtgcaatatggcacaacttgaggatcctgccaacctgtcatgttggccgtgctggagtcgtcccttctccgcaggattggtgaggggcccaggccactggcattggagcatggcaggaaaaagcctgaccagaactcacctgggtaaattacaaagtgcttctccacttcctctgtcctcctgtgctccctctcatctctccagtgaaagggctgcttagatcataacattcttgcacaacccacggggtgccagttaagtagccaagtggctgaatttctatcagagcttcagaatgcggaatggaggagccccaaagtgtcaccctggatcctttaaggaacaatttctatgatgatgtaatagaagttgacatcccctttgatcagtgtcttctgggtgggtctgtgagatgagggtgggggcatcatctctgtggactgggtggggtatgaccagcagcgcattttgctgaagctgtgagctctctgtggcagggtctacctctttttctccttttctgacccacctgagctgggtgcaggctccctttgcaccgagtggacccacagacagctgtttgttgagtgccttgggaatgctcatggcttctgtccacaaggcaggggcctcacagctctgatgcagggagctccgctcagtttcttggcctcatccttcttcctgctttgtgcattttcccagaataatgacagtcactccttcccatctttgctccctctcccacatctcccctacacaaatctttgtcctccctggcttgacaccctctgctgcacagcagagaatgagttaaaaatcaaaacccacagcaaagagtgtcccccgtacattttttgtgagctgtaacatctcctgagagaaggtagttgttcttctaacctgcagattgatgatccgagttccacacagtgtcggctgaagggagaagcaattaaaagagaacacagtggggcaccaggttcatctcgagagctcttgtctctggcagttgccctgagtccaaggaagacctcagaaggttcactaggcccagcaggatccaccacttaccaaacccatgattaataggaacagaggtgactcccacgacaccacaaccatctgcagtgtttcagtcactgcccagtgaacagaactcagcttcagtggtgctgggggtggttactaacgtaggcaccccggaattttagccccaccgggaactaaaccaagtttaagctctgctgcctacgtctctggttgaccagcagagggcatagaaacactttcttctctcctggagtttgctttttctctgggagcgaaccaaaagctgtattttctaacccatgaaaattctagtttatgaaaagatatgtaaactggtgactgagggcctgcccagacctcctggtaggatggagaatgatcaagggccaaatggtttgtcttacccagccagccttgagaaaatcctcttccttgaaagcctctagggagaaaggaggctcccactggggcagcccctggatggtcctccagccctgttctccactgcttcgccccagtggtatctgagcccaggctgcctcgctccaaaagctagtttccccgccagcatttctaagtcatgaacacggatcaaatgcccgcacaggggctgcctccctactgcagctatgacaattggcagagaccaggggcaggtcaggacaggtggtctcccagatattagtccttgtggcctgccagtcacaacggcccttctgctgcaagccatggaggctcagtgcaggatggatggatttgatgcagctgctggcatttcactccctgccgctgcccttggggaggagcggtacctgcaggttttttataagagcagaagcttccaaagcttcaaggggcttcccatgggcagcagatgtgcagagaggagctgctgtggctctctgcagcggggaatgtggcctgggctctgagttcccagctcaggcctgtggggctcgaagatggccaacactaaccaaagcctgttctgaatttcaaattgacacaaaggttcctcaaaaccagtgatggtaaacacatacgggatgtcaggatgctgctgtgacagcagttttgctgttgcctgagagagacaaggcaggtcaactccaaggcagacagaaggccagggagagtccccagtgtgtgcagggagagaaaactgctgtctagggaatgttaccccataccttccccctctcccttcttgccctttccccctccttccctccctttctctcccctccccttcctcttcctccagcatgcctgttgttttcacttgtacttaaaaaaattcttggttttatgtgacaaagaaaacctttttatttttacataaaagtttattaaatttgattccgcggcctggtgcaatggctcacgcctgtcatcccagcactttgggaggccaaggcgggcggatcacttgaggccaggagttcaagaccagcctggccaacatggtgaaaccccatctctgctaaaaatgcaaaaattagctgagcatggtgacatgcccctgtaattccagctactcaggaggctgaggcaggagaatagcttgaacctgagaggcggaggttgcagtgagccgagatgtagccactgcactccagtttgggtgacagatcatgaccctgtctcaaaaaaattgattatgaaatttgtatttccatcagctccggtcatctctatatccagctgagtgatgtacattttcatgtggcacccaaatcatcctgcaaaaaggaccctgagccctcaggaaccgcagggagcctgcagagctcccagggtcctcagggccttcccacaggggctcagcagctcctcctcagtgctgacagaggtgacagaaagtgacctcccatgtggcattgattgagggggcaggaaatcacccaggtgtcatccatttgtgtgagaagttgcaggggcccagggggcgtgggaagacgctgacccagaaggttgcttccagccagggattcagcccagacggcctccctctgtgaacctggttctcctgtctgcctagcatggggctgaggaagcctcactgacttcgtctctggacatttgaccccttctgggccttggaaaagccaacactggcttcttcctatagagccaggttccccgcatctttcacctactggtcagacatggccttccaggcagagaaagccttgtaggtactctcaccagcagatggccattttcacttggcaagcctcccggccacttccttcttttcacagcagacctgagagagtggacagagagccctacagaacctagggcaggcctgggagatggaggagacccatgccccagctcaagagtcaagggcccacctgaacaatgaggtaggggaacagctcctttcaagcccttccttccccaccctctctggactctggataaagaaacacgactgctttcctctcacccagaagccagaaggacctgagcacccaggacttgtggctgtcagagagctgtggaagggcaggggacaccagatggcagcagcaagagctgggcggcagcatctgcccaggccacctgcggagagaaggctggaatccgagggatcacactgggccagcattgagcctgtggccaccacactgacccctcctcagctccccctcacaggacctgaaagcatttctgagttaagtctgcataggaagttttccagagccatgccacatatccctccatccactcagtgcccattttacagatgaagagagaggcacccagaaaggtacaccaaggcaagatatggcgtagacaggatgagggcagagccagcttcctgatctgatggaagtcatgaagccttctctgccttacgcttggctctgcagggtcgctgagaggttcctttaaggagatcatcagaatcctaaatggcaaaaaatggcaaatcaggggaagagttggagcccagcatttggggacacacacacacacacacagtcgtcttgccttgcagaaattgggttgcattactccagtctgccactgagtggcacctttgggccatgcacttggctccaaagacatttctctgaacagcaacagaaaaacatgtttaaccctaaaaaaaaaaaaaaaagaaacaagtacatcttactttggatgaaatttgatgacagattgaatgcactgtctgcactttccaccacgtcatgtttcagcttcgcttgtccctccctttctgttgactagactacctgtgattcccgctgctctcggaaccagcacaggacctactctcttactcactgatgggggagctggcctgtccatgcacagggcaaaggatatgacacccagacctggatcctgctgcaaggctgccttgggaaccatccttaagacccggtagctgttgtccaagctttggctctggctgctgctgctctcagcagaaaagagctcactgctcccatgcggatgctgagggattaaacagaggcaaatacggaagtgagcagatttttctctcttgctctcagcagaaggagaaccattctgcagagaagttttcaacatatgcctcttcagcattgctccagatgcgtccgtcttcactctgaaacccatatattgagcacctactatttgccaagcaccgtgctgagcactgatgtgaattggctcagtttctccatctataataggaatggctggttcattcttacacagatagtctttatgattccaggacactgcctgcttctgggatctctcctccattttgatgccatcacttgatcccaactagatttgacaaagggtctcacactgtctgcatggtggcatgtatgtagcactggggttctcaaccaggaatgagttcatctcccaggggacattgggcaatgtttggaaacatttttagttgtcataacttgggaaggggggttgctattggcatctagtgggtagaggccaaggttgctgctaaacatcctacatttcacagaatagcctcaacaacaaagaattatccagcctgaagtggcaatagtgctgaggttgagaaaccttcatgtagaaggagagaaatcccgttctgataacgagaagcacattgatcttttaatatgcaattcttttctgttctgcaccataggaacacctttgatgttttcacaatctccatggtctttgcagctcatgtagtggcatcagggcaggctgagagatgcagcagaatgggtttcatgggacatcagctctggggccatctcaggcaacatcccgatgctgagccccctggaactgactgtgtttctgctcccacttcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggtttgcttatctactcaagtggttgtcataaggtgttcatttgtccccttcattgcctgacctattaacacaagttcaaggcattgtgggtagttaaaatttcagatttggttatttttaagttcatcagtggaaaccatttcagataggcgcacagcaaaatcccaggatcgttttcctagatgggttatgtattacatagaaaccaaaatgtgcagttatatgctttatttgttccaggaaagcctcaaagtgttttacaaaatctgaaggcttgtaataagtcagtgatagaatctggaaaccagaacacagcattggggaagtgggtgtagtgagttagcagggccatgagtcaaacccacatctgtctacctctgaagcccacactgataaccacctctctacactgcttccgcagtgatctccagctctgcagtgaatattttttaagcacatctatattccaggctctgcgctatgtgataagataccacaaagaacaggcaaaacccctgttctcaccgaggttgagtgggagacagacaagtaaatgggcaacttcaacagtgtgaaaagtgccccaaatgggtgaaccctaggttaaagcaagcctgcaggagggactcccaaccctgtaggacacaattaagatgctcacagatgctagtgatgctggctaaagaaacaggaaccaccctaaccagcagactaaattttgacggctgggaggtgccatttctaaaaataagcattgggttggtttcttacttcctggcccctaatttctatttcctgtcaccatcccacacccagtgacagggcttaagattttgcttatctccttgaccccacttacttctctcacctctggggcccccagtagagaatttgggtggtttgccccttgcagacattattatctgatttaggaaactcagtgtagctgcaccaatgcaaataatggcatgagaacagtgtcccttatcatccagaattaccttgtcatttgctcagaacttcaagatggaaacacctaccaacctcaacaccataactatctacttctctccccctggtcacgagctccatcaaatgcctgtgccaatcacgaaatcatgactccttcatataccccttgcagcttcaaagcagaatgtttgagtcatgagagctctttgctgagatatttttgcttatgtgtatgtacgtatgctttcaagcaccatattgacatggccagagaggagagtgacaggggagttccgtgggggttccctgcatgaacaagctgaagctcaaactccaatatttatgaaacacaagaagagggatactggtcaaaaccttgatgcatctagcacagtattaacactccaagcatgacatcaggagggatttattttaattttttattatgaaaacttttaacacttggaaaagtggaaacagcaaaacagcaaacatttatagaccctcatccagcctcaaaaatcatcagtacacgtctgatcttgctttatctctagccccatctactttttcacctgccaccaggttactttacaacaaatccaagatgttgcatcatttcatctgtaaacttagatatgtatctctaaaaaaaagatccttttgttttaatattgccacaatatcctttatctccctcccttcctcacatccccttgcaatttatttgatgaaggatttagatcctttgtcctgtaaagagttccaagctctggatttttctgattgcagccctgtggtgctatttagcatgttcttctatcatctctctttcctataaattcgttttataagatatttaatcagatttaggtttgatttttatggacaaaaccacttcatggattgtgtggtgctctcctatcagaaggcacatgtctagccacctctctttttgacctttttgcagatattgatgtctatcgcttatatccattagttaattagaggttacaaaacaacaacgtactaattttattctttcttcacttattagctggaatactttcataaagagaaacttccctccaccactatggtattaactagcagtacaattcacataagaaaagcaggataaatatttgattctctcccttcatttgccagttttcaaaatgagtggtttgctattatcttcctatggtaaacattagggtctattttggttttactatctttgtaaactcatgagtttaaacatatatgctatgttttaatccattttgctgattacttttattgatgcttggattgggccatctctggccagttggctctttctgacacagccctaagagtgatctttgacatcatccaaatagcagggaagctaagatattccagtctttgcccttacccagaataagctgtttctccaaggatccctgattcctcttagtgagaaatggtatttagagactaaaatctaggcacttagagtgtttcattgttcctggattgtttatcatttccagcccttttcagtcgacagagctaggaaatgtgttgctgtttataataaaaatacatcctgagttcatactgatacttttaattcaaattctgacctacaggggattttatttaaccgcttgtttcttacacctgtgcctcttttctctatgctgacaatcctgactttcaagggcactggatgatagcataattactcatttgctttatactacacagagcagtctctaaaccacaatgctaaaaatacagcaacagtatgattatcgcctggttctttaattgttgcatagtattccgttgtgtggaggcaccatagtttagtcaaccagtcctctcttcttggacatttatgttgtctctacttcaagaaagttttgatggaagaagtggggaagtcagcctaacgaaggttacatattgacaagtatctcaatatccaacctacagtgctctaccattttccaagtacttctaaatacattctatctaatttctacagcaatctagactagacatgaggatgtcttaagcatccccatcttcttcattatctgctaggattagtctcccatgaattcaaataaaacactcttcctaagccaatccctattttcagaccaatttcctattgcttctgaagtgtatttccaccataaatatacaaagtgttcctttctagcagagtgaccttggacaagttgcttaaattccctgagtcttcctttcctcatctgtagaacagggatacaatggagcctacacataggggtggaatggggaccaggtgaaaggaagcatgtcaaccactaacgatgtctggcccacaataagacagagtaaatactaccatcttatttttctaatgtcactaatattctctttttaagccgtagtgtttaatgtatttggtaaaaatttttaaataatttcacataaccttagcacccagagataacccctattttggtgtattttcttccttgatttatgtgtgtagctacgtgtaaggtctgctcaggctgctaccacaaaatagcacacactgggtggcttaaactacagaaatttatcacagttctcgagactgacaaatccaaaattaaggtgtcagcagatttggttgctggtgagggctcacttcctggcttgcaggtggccgccttcttgctgtgtccttataactctggtctctcttcctcttcttataagaacactaatcccgtcataagggcctctctcatgacctcatttgaacctaattacctctcaaaagacccacctccaagtaccaccacactgaggatcagggcttcaacaatatgaaatttagggagacacaacattcattccacaacagggcgattttgcaaatagcgtgatcctgtaacctgccttttacctaaaacaggggtcagttaaaaaactatacttttcctaaaaagagccagatagtagacattgcaggctttgtgagtcatgtggtctatgtcacaactattcgattctgcatacaaaagcagctacaatgcaacaacatagcaatgtaaacaacataaatgaggacctatggctgtgtttatttatgaacagtgaaatccaatttcatataatttttcacaaaatacaattcttcttttagtttttttcagccacttaaaaacataaaaactgttcttcgctcatgggatgtaaagatctagatcacaggtctgtatctgtagatttgaatcacagactgtagtttgtgaccctgtgctaaataaaatctagcacatggtcatgaaaattattgaaatgcttcaagaaatccagaaagctacaggatagaggattgggcataaaggatcttcagtttttgggggagagtaagttagaggagacttggttttgacgcagccatggcaacacagcaatctgaattgtgaatgtttctacatgaggattgagtgttgcggagcagaggtcagcaggtgccaagagactcacactgccttaccttcctggacagcactggctgcctgccccagcaaagtaggtgcagttcagaagttcccaggtataaaaaggaggttaaaatcctcagcagcccatgaccagccaggacttgcactcagatgtcctcgcttgctggccaagattctgctcagaccacactgtccctggattgttagtgctgagggcttggtggtcgcactgagacctggagaagttctagtccctagagaaaggccaagagtctgggagttccttctagaattatccatttaagttctttaaactttctcttctcggtttgcctctctgttaaatggggatgttaacacctcagcccatggggctcaggggctctgggtggcttcctcagctggtcatgatggttctcataaaccccctgcagtggtcatatgctttaatattagtgctcagtagcctgagagaaagtacagccagatttatggattcactggaagcagggactgggggtggggtgcagcctctctccaatgggttttgtttcttatttgaccacacgcattgttagagccaagttaattgcctgtatttgcttcctgtggaaatatttcacaagacaccctgttatcgtgggcccagcatttgtacttgtgttttgctgatccgtttagcttttttgaaaattttgggccaagaccaaatcttccataaaggtctgtgggctgtgaccatagtcctcagctgtttgctgtgttgttccaatttcatagatttagccttgtgaggggagaaaaatatataggccatgattatttttttttaaggactcagttctttatgctatggatttaattctctgttcccaaccatgtggccttaaaggacctgcattgtcacctgcttgctatgtggtctgaggcaagggccttgaccttttgtgccttagtttcctcatctgggtgatgggggtgatgtcttctttacagcccgctaaggatttcagagaaatcagatgagctaatagccctgaaaaatctttgaaaaagtaaaaagtgctatatatttgtaagtgtgaactcacaaaaattaatgactttagtactctctggggtttcgtaattctaagctggatccaaaagaaattctctcaaaatatctgcccttagatgggaaaaaatgccagaaaaggatgtaagaactgaattttcaggtcctggaatgcatcctaaggaatttgagcttctcatcctgaagacagtagcaaagcattgcaggcttttacctggaagatggtgaatcccatggtgatgggcatagtaggctggagccaagagagagttctgaaccctggggcatgtcatataaagctctgctggcagttgttggtggagagaattaaaccacaggaagtattgagaaccttcagcttccttgtagggcatttgtctctttccaaagccttcacaggctctagatgagatagaaatcaaatgccagcacagtggctgcctggcttccattttaaatctcagagtaccaaggatgttccaaggactatctccctggatccattcaatcatttgtccatctgcccatacacccatgtcatgaacatccattctcccattcaagttgggaaaccttgacccgtgcggcataatattctgtgcagagggaaataacatgagaaataggaggcccagatggctttttttttgccatcaggcagagcttatctaaaagcacatcattttcaaacaaaacaaaccagacctaagaaagcacttcattgagataggattggattggaaatctgtcctttaagtggactgatagtggaataggacaagccagtccagccccattggctttgatccttgcagtttcccacctcaccttcctactcgtcccagccccactgctttcctgacctgtggtacctgctaagatgccccaccctgccctgtacctggagtgtctgggccttccagacctctggatttgaaagttatttcatgggagcagaaatttggtcttctttaccttttataagttcctgcatcacaaaggtaatgctgaatgctgaatgtcagctaaatgctgataattcattccagaattataacattttcagctgtgcctatcaaagaagcgggggacaatttgtcccttagctttcaactttggagagacaaccttggggagtacacctagtagatagtcaagaaaagcaggttaaattaaattcctacaatgtgccgattcagcaaaacttggaatacccactaagtgtcagatgttctaggcgctgtgaatatacaaatgcgtagggaggttcctttccttaagcggccctgggtctgacttaccacagctctgcttggccttgatgaactcacaaaaggatcaaagagcatgctcaaggccagaatgaggtctgcgtgataaaagagctgagaaagataccgtcaagtccacatccgccatgagcagacaagaagcctctagcaaaacgtttatattattacctaagtgtagatgtttaaatgcaacttgattaaggaatgcaaggtttctaccatttgctttgtttaaaagccaaagcccagtagagtatgattttaggtttgcccagattattcagaagtagaagtcttcccagctgttcatctttgctccagtggtggaggtggcggcattgcgtgccagtatcacaagaccacaccaagtttcctggtattaatcctctattggaaggcatttcctggtagactctcatgccagacatattttaataaggaattctgtgacactgcttgctctgggggttgctcattttatcctgtaggtggttttatttttgggagatgaacagcagagggagggatgcattttgcagagaataaatcagtcatttgtgatccagttctgtttattaccacacagactagtagttcctgacagctactgagagaagacgtcaaagagttcaattccaaaatttcttggttgctacatctaagcatagattccttataccaaaccccatgacctccttgaggaggaaatgaaaatacttttcttcttttttttttttttgagaaggaatcttgctctgtcacccaggctggtgtgtggtggcacaatctcggctcactgcaagctctgcctcctgggttcacgccattctcttgcctcagcctcctgagtagctgggactacaggtacctgccaccacgcccagctaattttttgtttttttttagtagagtcggggtttcaccatattagccaggatggtctcgatctcctgacctcatgatctgcccgccttggcctcccagagtgctgggattacaggcatgagccactgcgcctggccaggaaaacacttttctaagttaacatccctggtatttgggtaggtgaaagacaatatgcaaagctgtctttgaagctacacttttctaagagtagggattgaacagcatgaaaatactgtgccctttggccagttaaattaaatctgtttttatagatgctttgcagagtaaaggcaaaggatcatttactctcacatcctcttatgacctggaatgatgccttatgtggaaacacagggctcccatgtcctacttaggaggctaaggaaatccaaagggggcacttcccattttagatccacatgatcccaggttgttcatccaaagatacatccagaaggagcaacagcttcctatctttcacttatgtggatgtccatattgttgcggtatcttttctgttgcctcttctatgtttgttaagcagatactgatttgtgatccacttcaagtcctcaccactgtgctgtcctgcaagaaccgtgctgaagaaaagctcattttccctaggcttcagctaaccatgcctaaggtctgaggacctttggtcaaacatattcaagtctcttgaaaggtgagactcaaggatacagacttatgacttcctaagggcccatcagccctcaacgctttaccaggttgggaccttgtttccaaagatgttcatagctcccttcaagtatagatggcaagttgtgcatggactgcctgttaagtgagaaaccagagcctgggccatccctggtgtcttggccattaccattgctaacagcagtgatagtgaatagtacccaaaagggaattgtaagcagtggccacaccttctactaggatgactcagatttaggactcaagaggaggctcctaactttcctgcaaccacacatggagggattttgtctcagccaaccagtactgactccccttgggacccaagtaaaggacaatgaaaagcagcacttcaatgtgagaagagcgtgagctttggggtcacagagctctgggttcaaatcctggttccatacttaccttgggtaagccacttgacctgttagagtttcagtatcctcatttgtaaaatgggggtgtttaaacctaagcactacttcagagcaaacatcaccaacaactgaaatagtacagctagactctgctcccaaatcctctttgcttctttctccagaatctctctcatcccacaaatcatcccttgcaaggacagtcacagcatgaaattattattgccacttgacatgtataatcatttttgtagtgcttccacttctacttccacatttaattgtgtgattgacaggactagaaaggtgagcttttggctcccagtccagttccttgtccatcaccccacacagcaacaccacattctgtccacacagcctcattttccttcaagagactacatgggacccaaaagctcccaaagtctggatgtgattctaggcagcttaggtatggagggcagagatgaggcacacacacctacaaaaagaaaaataggatacttgaaaatcacaagaagagctcttggccgctgtgcaatgctccagctgggtggttctccactccaggaggacgttctgaagctgggaaatgagatctgtgctgtcttaggagcccacagcacaggggaggacataagggtcttcttgaggagttcagctgcatgcttgtggcccagggccccagtcatttgtctgattagcttccccacctcttgagagagtcactgtgttttgtctaaaaagaaaggagatttccaaatgaggactctctgagcaaaatattgattttcagcaggtgtggttttgagacagtttgtactgcatgctctctccagctctcactgtgcctcggactctattgattctagttggttttgatcctgccttagcattccaggaaagcagagctctcctagcccaagaagagaaaatgaaggtggagtggctcatcggggtaacatccctccactacagccatcaaccactccagggatatgatgcctcccactgctgaggactctggctaagacactggtgtgatttagagccctagagcattggtttatcatcatatagagaaccaccctcatcttctttggaggaggtgcctctccactgcatcccaaggtgggagtgacctctggtagttctgcttgttcatagtcagcttagtcatctctgttgtagaaagagaaagagagagagggcaagaaagggaaagacggagggagagaggaaggaagtgggaaaggagggaagaagataaggcaagacaaaataagacaaagcaagaaagagagagagcacgcgggccagcacgctttttctccatccccttaggaatttactctcagcaggggcttggcttggctggttttgccagtgactcccttgcactttgcagattctgaatatacatttcccttaagactggttgtctgcagaataggggaaacaaaccagcacccccataaatcagcagaggtcactgccaagagctttgtacacttgctgtccctggcagtgataaactcattgcatttgggaaatggccaaagaccctgagtccaatcttaattctcattcccagaaaaatctcagttttctgttcacccacccccgtttactgtctttgtgtttcctagacaaagctggcaaggaggaaagaacacagttcaataactggatcatcaaaggctgcatttcgttgcttgggggaggagttgcagggcaggaaagagtcacagatccctaggctgtggaaaagagaggcccaggccagagggaggctgaagccatggggtctgcatggggtgtgagagatccgcagaggttctcagattctggttttctcagacccgcaccttggatctgctattactgctgtggtcggttgttcccttgaagggtggttcaggctgttataatggtggtcaagggctagcagtgggattggtgtggtgagaccacctcatgggactcatgctccagtaggttgtgttcttattctcttatctttctccccacaccatcctcaccttggtatctggctttggagttggccatatgacatggagaagatgagagtggtgtccaaactgctcctctgacccacatgggcctcctgagagtggacaacctctctctgctgccctttcctccttgccccttgattgtctttctcctctgattgatcagactgtgaagctgcaagaccagacccccccctccctgcaatcccacagaattaggagacatatttctgtctctctacacagatctttccactttgatgaggatctttctggttgagagaccaccattccccacttgtagcaggataggtcatccccaggtatacacattcataccctgtgcctgtacttcatctctgcagcccttagctgaattggctaaatgcgtctctgtgcaaagtctatcttgcctagttggatctaagctttatgacattagaggccgatttgtcttattcaggctgttatctcagcgtctgacacagtgccctggcacctagtaaatgctcaataactatttgctgaatattattttgattcagtgtttagacatctgctttatcctgctctattttgattgacaagttctttctcttcatgaaccaggcttttccctcctacaatgagtctataagaattagctagatcagaggggaatttggtgctgagccagaagagctgtctaggggaggtttcctcacttcttatggggcagcagaggggtattgtgagatattgagaagtcagaacaagaagcagggaactgttgctttggagaagggtctggagaggttccaggcactatgataggcttttccagatgactcaggagccacctggctctgtcagccagaaagaagtgatgcctgacacaaggagacagtgtgtcatttttactgtggactaacatttgtacctaagctttaaatgttaaaataatttggctgggtgtggtggctcatggctgtaatcccagcactttgggaggccgaggcgggtgaatcacttgaggccaggggtttgagaccagcctggccaacatggtgaaacaccgtctctactaaaaaatatataaaaattagccaggcgtggtggtgcatgcttgtaatcccagctacttgggaggctgaggcaggaggattgcttgaacccgtgaggtggaggttgcagtgagccaagatcacaccactgcactccagcctgggcaacagagcgaagactccatctcaaaaagaaaatgttagaacaatttaaagagacaacaaatgaaaccaaagaccaatgatacccctcagcctgggctctgagaccattagggatggctgagccaagattttcatgctcctctgagctgagtgtaatcctcattctccttctgtgcagagagcaggaacttgatgcagtcataaacccaagcaagtatggagccagtaaacttgctgaacattaaattccaaccggcatttcagtgaacatgtatattcgactaatatctgagcctgtgctagacagtatgcatctgtaaaaataaacacatactgttcctcaaggcacttaaacaagagtgagctggatttttgtctgaaattttcagaaaaacacttagtgaagtgtgttcacactaagtttgttaaatcagaatacgtctggactatccaagtagtctcagaaccaggccactattggaggctgggcgcggtggctcacgcctgtaatcccagcactttgggaggctgaaacaggtggatcacttgaggccaggagttcgagaccagcctggccaacatggggaaaccccgtatccactaaaaataaaaaaatcagctgggtgtggtggtgcatgcctgtagtcccagctactcatgaggctgaggcacgagaatcacttggaacccgggaggcagaagttgcagtgaactgaggtcacaccactgcactgcagcctgagtgacagcaagactttatctcaaaaaaaaaaaaaaaaaaaaaagaaccaagtcagtatttaatttcatttgagtccttccagtgggtttattcccattagtggggtaactcccctgcttttgtaaatatgagggtatctcaggaagaataagtcccaaaacaagattctttgggttccaaccaaagatgaaaccaagagggcctcacatgtgaccaagacattttctgctttctactttcactttctttttgtttattttttaaattgagatgtaaaagttgtatgtatttatggtatatagcatgcaattttgatatatgtatacattgtggaatggataaatcaagccatttaacatatgcgtggtctcatacacttattgtttgtagtgagaacacttaaaatctactctcagcaattttcaagtatataatatattgtttttaactgcagtctgtagtcaccgtaatgttcaagagacctcttcaacttattcttcctctctaattatgtggtgtcctttgaccaatgtcttcccagtccttctcactccccacagcccctggtagaatggccattctgctctctgcttctgtgagtgtgattgtcttagattccatatacaggcacatctcgttttattgcacttccctgtattatgccttatagattctgtgttttttacaaattgaaggtttgtggcaaccctgcatcaaacaagtctatcagcaccatttttccaatagcatgtgcttactttgtgtctgtgtcacagtttggtaattcttgcaacattaagcttttttagtatgattatatgtttatggtgatctgtgattggtgatctttgatgttactattgtaattgctctgggggtgcccaactgcacccgtataagacaatgaacttaatacatgttgtgtgtgtgtgttttctgactcctctaccaaatcagccattcccccatctctttccctctccttgggcctctctactccctgaaatgacaactatattgaaattgggccaattaataactctgcagtggtctctaagtgttcaggcaaaaggaacagtcgcatgtctctaactttaaatcaaaaactggaaatgattaagcttagtgaggaaggcatgttgaaagccaagataggctgaaagctaggcctcttatgccaaacagcctaggtgtgaatacaaagaaaagtttattgaagattgaacatgctactccagtgaacacacaaaagataagaaagcaaaacaaccttattgctgatatggagacagttttagtggtctgaatagaagatcaaatcagacacaacattcccttaagccaaagcctaatccagagcaaggacctaccttgcttcaattctatgaaggctgaaagaggtgaggaagctgcagaagaaaagtttgaagctaacagaggttggttcatgtggtttacaaaaagaaaccaagtccataacataaaagggcaaagtgaaacagcaagtgctgatatagaagctgcagcaagttatccagaagatctagctaagatcattgatgaaggtggctacagtaaacaacagatttgcagtgtagattaagcagccttatattggaagaagataaatctagggttttcatagctagagaagagaagtccatgcctggcttcaaagcttcaaaggacaggctgactctcttgctagggctaatgcagctggtgactataagtcgatgccaatgctcatttactattctgaaaatcctagggccttcaagaatgatgctaaatatattctgcctgtgttctataaatggaccaacaaagtctggatggcagcacatctgtttgcggcatggtttactgaatactttaaggccactgttgagacctactgttgaggaaaaaaataatatttctttccaaatattgctgttcattgacaatgcaccaagccatccaagagctctgatggagatgtacaaggagattaatgttgttttcatgactgctaacacaacatccgttctgtagcctatggatcaagaagtaatttcaacttttcaagtcctattatttaagaaatacatttcataaagctatagctgtcacagacagtgattcctctgatggatttgggcaaagtaaatcaaaacccttctagaaaggagtcacccttctggtggatgccattaagaacatttgtgtttcgtggaaagaagtaaaaatatcaacattaatgggagtttggaagaagttgattccagccctcatggatgactttgagaagttcaagatcctagtgaagaaagtaactgcagatgtggtggaaatagcaagagaactagaattagaaatagagcttgaagatgtgactgaattgctacaacttcataataaaactttaatgaatgaggagttgcttcctatggaagagtaaagaaagtggtttcttgagatggaatctactcctaatgaagatgttgcaaacattgttgagatgacacaaagaatttagaatattacatcaacttagttgataaagcagcagcaggatttgacgggattgactgcaattttgaaagaagttctactgtaggtaaaatgctatcaaacaccatcacatgctacagagaaatctgttgcgaaaggaagagtcaattgatgcgacaaacttcattgtcttattttaagaaattgccacagtcacctcggccttcggcaatcaccaccctaatcagtcagtatccaacaatgtcaagacaagaccctcccccagcaaaaggattatgactcaccaaaggctcagatgatccttagcattttaacaataaagtattttttaattaaggtatgtaccttgttttttcagacataatgttattgcacacatcattgactacatatagtgtaaacataacttttatgtgtactgggaaacgaaatatttcttatgacttgctttattgtggtggcctggaaccaaacccacaatacctccaaggtctccttacataagtgaagacaagtggtattttgtctttctgtacctgacttatttcacttaacctaatgttctccaggtttgttcatgttatcacaaatgacaggatttccttctttgttaagaccaaatagtattccattatgcctatatactgcatttcctttacccatttatctattcattgatggactcataggttgactccatatcttggctactgtgctctccctttcttttgtgctgggtaaggagtgagtcttggtgaatccttgtcattgctctgtctttttctggccaggcatctctaaaatgtgtcccccagctgatgggaggtctgtgcctcctccttcgatcccttccctggaaagagcaccaaggaagaggtccttaatgaccagtcctgcctctcagatgagcactctcctcctccctgaccagctctccatccccctcaccactagggcctttgtctggcttcatgagaagaacaatgagcatacatgggggaagatgcttcctccaccaggacagccattaactaacaagcccgccctccccagtgaaggccaacctccctcctaacacattctctcttggaacagccaagctttcctgtgcagctgagctgaattccacttcaatggataaataatcttgcccactgacaagtcctcttttctaagggaccaggattttccaacccttgatgaggacagatctgtttggaagggaccacaagattctaggaattagctggaaatcaggggtgaaattatttgccaaggccagaatgtataacaaatgcccctgggagccgaggaaaagaggcggcaccttgctgcagcacctgcccctcctgggtgttagttacatgtcctgtgatgtggttgccaagaactccttccaggacgaggtggtggccctgaaatgcacaaactgacccaattgcattattgcctgtttttttaaattaaactttttattttgagatacgtattgattctgatgcagttataagaaatactgtgctgtttacccagtttgccccaatggcaacatcttgcaaaactatagtaccatatcacagccatgatactgacatggctacaatcccctgattttattcatatttcccagttttacttgtgccccatgtatgtatgtgtgcatttagttctatacaactttatcacgtgttaagatgtgtcaaaatacagaaccattctgtcaccacaaagatccttcctgttgccttttataaccacacctcccttgctccctctacttcctcatctctaaccccaggaaccactaatctgttctttgtctctataatttgtcatttcaagaatgttatgtaaatgaaataatatagtttataatctggagcttggcttttttactcatcctaattcccttgagattcatccaagttgttgttgggtgtaagaacagtttgttcctcctcattgccatgtctggttttaatcattaagcaccccaacatggcacccaagcccaattacaaatccctcaggacatgatcctcagggaacttttattctaagagagcccatatgttttgtttggtgctgctgagtttgggggtgtggggatggaacatgttgcaagtttttctaggtacatgcaaacatacctaggttccttcatctccttccccaaaacagtgatcaattggattgtaatattctttagcactggttgacagcccttccttgtgtctccttgtcaccttcctccccaggagcacatctacaagctgatgaagagtgacagctatgcccgcttcctccggtcaaatgcttaccaggatttgctgctggccaagaagaaggtatctttgggaagggcaggcttgctcttagcactgttgactcttgcctgctgcttgctgctggtttgaaatgagaatatcatcccttgggttttatttatttcctactttcttctttcccttctctatctgctcccattctaatggaaaacagttaggattgtcaccaccccagccccactgcaaggtccaggatggggcatcctacctccacatccctactgcctctctctgcatgttctgcccatggtgggggtgggtacgtagggtgacaaaagactaaggccacagtggctcagcataggagtgcagggctggcagtaacaccagcaaaacccttaggacactggagagagcccctcactgcaaagtccagccccttcacctcagacttctctccctgaccagcccagagaggagtatgaggccagggttggggcagctctctcactggtcagaaagccttgtcagtttcaagagcacaatcaggtacctaaagtcatcctggggtttctccctccttgacacccccttcctctcccgcacctgccccacggtgttgcctttctctcttaaccaagaagtaactgcacccagctccttcctcctcctccttagaactcagccatggttccttgcagcccatggagtcatggatttgaggtgcaggggccctcagcatgcaggtgaggggtgacagaagcaggaataaattcagctagattcctgggaagagaggaggaagagtaggcaggagaatagggtccaggaagggaatggaaggcaagagagagggctcctggtttcagtacacctgcccaccctctgtgcttttcagctctgatctgaggcccatgtgtggttaagtgtggctcaacttgcaccaaaccctatgacttctgtgccatggcacttagggagcacaggcatccctttctcctccctcctggactcccagccccaggccctaagcacgtggttgcccatcacatgctctccgctgggctgcctctcagccacgcaagccttctctctgtgtgctgtcaccctcatgtgccaggatcctgtctgcgtatctggttgggaccacacaactccagagtcctggagagcatttataacctgctctcctgcccttgtgtagccctggaaagaggccatggagtctgagaaaggaaagaggacttctggggtatcccagttgtcagcagctctctgggtttcctgcatccctccccacaggtgtggctactgtgatgggcagtgtggagcctggcctcctgtcgattcccctgctggaggatgccaatggaggggctcctttggaggaggccgacaccctcatacatggctctaatgcccattttttctaagaactagaggaaagaaaaattataggaacttttgataactccagcccagatctcatggatgaaggtcaaagtaagtttttcttattttctgtggctcaagacccctgatctgatcacagtttggtgactttctaaggctctggtagtttaaccagtctaggcctgtctacacacctagaagaagagaagctagaggccattgattctccttgtgggtttgaacacaaaggaaaaatgcaccccaaaccaggctgagacccctgtggctgcagatcctcccttccaagaagaaaacctctcagaggaggtcacttgagtgaggaaggaactggcaacctgcctgggaaaagttccttagagttatcctcccagctcccgaagtaagggatgttcttgagacagaaagcccttgcagataccaacaacgtctcaatactgaggagttgtttcccaaaacagtgacaaaacctgctttctccttctgtttcttcctgagagtctccaggtatggatctgatttgtaactcggcactttcaggtaggcctagagtattcttctgatttcagggacgggttcaccgtatccaggtcataaaaggtatgtgagattcacaacctccggcggagagagggaatatgaatcagcctcacttttctgctgagaactgacctggacggagtcttgaggcacagccttctgatccttcatccctaattcagcctcttttctaatattttccaaataaatgatagtcacactgaagaatcaggttctcagggggtaggtgagctgagtcctgagggctactctaggaaacttcagtaccagtgatgatggttttccagggcagctcaatggccagtgcaaggcagaggagccaagtgagccagaccaatggccaccctctgtgagccagaggataagaataacaggccgacaatgccagctgcagggcccaggactggcctgacttgagccaagtgtatgccacccaggctggccacagggttcaagctgagtcctgccatccccagaatagagacttggtatggtacccggggccaagcatgagtccttcagttcctagtacaagaagaaaggccagcccaactctgtggtgttatgtcgtttgtgttgtattttccttctgcaacctcatatctgtcttctggcagccagctgagctgacaaggggcctggctgccaaggaagccccccaacttcatccacacaggcggctgcctttggcctgtcccctctgctttcagcacagtccgcagacccacagacctcaggctgcctctttagctccctcatttcagttatttgctgggtgtatgtttgtgtctatgtgagtgtgtgcactctccgaacttctcagcctcgggctcaggaccctggaacgggatccaggatacactagcaggtatttgagcggtcattctactctcccggaacccctgcagctaggaaatgtggggtgaaaggaaagtcaggagcaccccacacctctcttcctcctgtagtagagggaggctaggcctggaaagacattcaagggctttgcctctcctcgctcctgttctgggaaccccagctaagagttccccacaatggtttctgagcttcctctagcctgtcgtacgtacatcttggcaggtgttatgtcaccttttggatactgagaaaacacacaatccccatgttattgtcttctgagacccaagaccctttgtccatggcaaaggctatgagtagaccctccttgctctaaggacacagaacgagggtcactaggaagtcactgaagttagcaaactttctggctgcctctgggcaggggaatctcaagagagaaaacagtcctaaggcagactcatggatgagtagataacttcgcttccccggcagccccttcctgacgtccctcccacaccctgctggctctcagagccagtctgttctgtgtcaggacttggggggcccccagggccccagggccacaaccaccagggctcctgcctgtgggcacggcaggttgaaagcagcaagcaagctgctcaaacccaccgactgtggtcctgcagcaaagtcatgatggttctgatccaagccccgcaagcaccattcatggcccccggagaagcaaagcccccctctctgctccctgctccaaggaggcggcaccatttctcgtgggcttctgtcttctgtctctcccattgactcttccaacagctctggctgcttctcttttcccatttttcgccccattttgctttggtttttgttattctttagctgcagctgctgctgtttgggaaccacgtataagctgaagattttttttttctgtatttttctccctacccttttttttttttcctaaagccagaaagtgagcaaggtcgtagaacttccctagaaaagttcactcgcagtgtggtaagttcagtcggttttcttccctcagcttttcttttggttttggttttttctttcttcttcttttttttttttttccctttggttgttgtttcctttggggtgggagggagtccagtgctttctccctcgactcagcccttttcttttgcgagtgtctgcagcttctcttctagggatgaaaatgcaaaaaagagcaagcggctccctctgcagaaggtgcacccttgatcgcccagcctcaggcctgggcatttgatcatctgttcagggctttgaggaggagggaccctgctgccctcggggctgtgcggtttgtgcatcttctgcagcagctcagggagaagccatcgaactataccgtgaaataaattggctcagaaccatagctcatcgaaaaaaaaaaaaaaagccaaaatttccctctgtgaaccctggcagtcacgccggtgtgggtcgcgagctaatgttgctgtgtaggcggcttttgctgtgtgcagaaagcggccgtgctgcatgggtcctggcgatgtggcctagctggcgtgtgtgttagtcgcctctgcatgagtcccttccagcccccatcagcctcatgtgcacagtgtgatagggagaggagggaagtagctgaatccctgcggtgtcctgggtactccccgggggcaaggtcctaccggcctcctcaggccttgattctaacaggctgggtaaagatgggcttcagattcctacaggttcatggtacgccccagctagagaggtagagctccccacagtggcacataaagacagccgtggcaacaggtgggagtggggagtccgtggctgttccctggggtgcatggctgagactctctaccatggtttgtagaacaacacaggccaatctcctctttccatgctggtcggcccaagatttgaacattgagctcagtgcacaagaaatactcaatcccgctcaatcacggggcccatcctgtaccatgaacatcaaaccagagggaaccagggagcagggtcccatgcagggagctggccacattcccttcccaaagggtggcagcccattgatattgacttgcctttgttccacctctgttgaggaggaaaatccttgtaaaacctgactactgtgtgactggtatacgtatttcatccttttaagaaaaagtctaaggctcctgggttgaaagcagcctagtcatttacgtgtcgtagctagatgcattttaagtgcatttaaacattatcttgaatttgctacatgtaaacctcaaataactctagtgggtggcaattaattaaacatcggtatccatcccttcccttcctcggtcttccctctctgtggcctttcctcatgagaaatcagaatgtgcagaacacaaggcctgcgggtgcctggtctatcttcatggctgctttgccaatggccgtgtggctccgcacaccaagaagctgccacgggctgtcagagtcaaggcttctgggacttccttcactccatgatggcctgagagaaggtagtgggatcccatctctctctgtttgtctcttttgaggactggctactgtgcgggtggaggatggttagggattttgctgacaagccaagggtgcctgtgtaagcagagccttgacagcccccggaagctcttgagggtgaccgtgcaggccacgggtgtgagaggggaagcctggtacttggacaaaacgtccagacattttcaggctgtttttcaagagaagtgagtatcaagaaaggcaagaatggtctcgcgaagctctgtgaggagcatttattgatttcctttcatcccagaagtggtgttggcttgggggttctcccaaggtctgttagcaaagcatttggaacaagaaagcaccaagacacccctaagtgtctgaagtgcacacatgggagagcttccagagggagtttcagagtgagctgaaggagaaaagtatcctaagctcctgagggtgtggataaaaggcccaaactattaaaaaaaactaaattcctaaattccctgctattttatgaacaagaaactctaacaggtgatgcattcagaatttggggttccagtggtggagatggattgccatccatccatgctcctcctgctcttggggtgacaccatagccccacaagatgtggctaagtttggggaataatatgacccatgtgttggctctcagattacttaagattggaacccaggaatctggtctcaacagcccagtggtctcatcaaacagaactaactaactgatcaaccaatatgccttgcaatttgatagccattctctgactatcatatgcctaaagtatttgatttctctaagagaagatctacgtgaatgttttatctgctatatactgcaagctataaaactaaatgaagggccagttcaatagcattcctgtgttgctgggaaagatgtgtaagaacatgacccatgtcatggggctaataatggaaacaggggagtgaagctgggcagctcacggaccaaagacgtgaggccaattaccatttaggattaattgatggcaaaaagaaataatgttgatccaggtgattggataactcattcagctggaggcttgtcaagactgaatctgaattcagaatttctccccagaacatgccaatgtcctttcttttcttggtagaagagaaacacttggaaaaaacaaattgttctttccaagtcttatgttgtgccatgacatagagggattatctgttaagaccacatatgcccccttttccatgagatcctaaggagacatttaatatggttcatggaagcttttagggccatgttagtttgggtgacgaaggggcctggtactccccagtcaatagaggaagtgctgtatgagcttctctttccaatgcaagcttcattccaggttactcaggacttggatatacaaagcaaatgtctggggacactgggccaagcatcctgtcattttgcagactgaaaccacaaaccctgcttatttgataaggcccaggttctgaactaaacatgactgaagtccacgacagggcgcaactagcctaccatgtacgttcatccaaaatggaaaacaagactccctctggtgggcccagcctcacagatgcccagctgaccaggcaaaacacaggctgggtttcagcccctattgatcctcagctgccctggtgcagtgaataacccacgccactgtacatggccacccttgtccgaggagcctgtttcagaaagagctgtaacacacagcagcttctccagggcccccaatacatggcctcaggtcatgtgatttggagcctgtctctgcctaatcctgctcatggggaagcttcctttcacagtggctgtaacatatgaaaaccacagtaggagaaatctggctagtcactgtgggttgcctttgcttcaccttccagctgttcttcagattctttggtgggaagtctcaggcattactgaccagggagaggaggtgccttctctcactgaagactctttcctgttgcttggtgatgtctagcctgccactctctgctatcttcctggttttgcagttgacagaggacaataggagcatgaaggtggccagagctgaaatgctcaccctcccactgcttcttgagacagagtctcactctccgagcctggagtgcagtggcacaatcttggctcactgcaacctctgcctcctaggttcaagcgattctcctgcctcagcctcccgagtagctgggattacaggcacacgccaccacacccggctaatttttgtacttttagtagagatggggtttcaccatattggccaggctgttctcaaactcctgacctcaagtgatccacctgcctcccaaagtgctgggattacaggcatgagccaccacaccccgccctctgctctctcttaagtgtgcttgttgcttcagcttccacagagtctaccacagtggggtggggggcctcaccaaagagggcctggctctgacatagaggaccaggagcatgcgtgggagggagagggggcaagaggaatcggggccaagccacagcagcagctcccttgttgagatagatactggctgaagccatctggtgagagctccaatctggggaggagaagctggagaaagtcctttgctcctctgtccagttccacagaaaaagccgcagagggtgatagcactgaagttaggagaaaatggcagccccgagtgaggctggtgtcagcctccctgggtacctttggaggctcagttgaaaccttacctgccctcttgagagcttcatcagctccagccttgggctccaaagatagatagatagaaaatggggttgctggtgccagagcaagcactggaggccacggaggagaagggagaggaggaccaggcgttcatccacctcctaagagagcatcgaagtttagctttgccaaggtgctccttggaattgcggcaggaagggccggaagctgcagaaggcttggcatgtgatgggtggcatctctgcgacaggctttcctgtcctgcctgcctgccaaggaatgcagcaggcaagtcagatggggagcgggaagctctgggagccagctgccactcagcctccctcgccccctccttccatccccctgttccttcccctgccaaaagccaaggaagagctaatgagagccaagaagtcaacagctcactcatccccctccaggcagctctgcagagagaaactcccagctccaggcccaggtgctgaccggaagtggagggctaaggctctccgcaggggagggggcaggcaggcaatcagggcagtcagccaaccggcagaagcagctcctgcccccaggaaggcggtgttgttttcccctcctcctcaaggtttcatggggaacagccttgcaccctggtggaatgagttcccaaatacctagactcagcagaatccccagagggctttgacctcagttgaaatgatctttctgtgcctctggcaagggccaattggctaaaaatctttccaaagggttagtttttattgcaaacagtccttggactcctttgggaccactgggtcacaaacattagtgccagcctctcccatctcagagcactgagatccagctgcagtgaaaccctggccctggctggagctggagggagacttccatcgaagtgtttgggaaggaaagcagggaaacctgcctctctggagcagcaagtgcatgtcctgggactctgagacacctcagcagccctcctgcagactggctcctgcttccagcctcagcttgctagctatgtgacctcaagcaaatcactagccctctctgagccctggttttctcctctgaaatgacttggactaggtcgtctcgatggtcccttccagctagcggtgttctgcaggtctgtgcttccctctgtcctgagatttctgagttatataactcattccttagaatgggagaggagctgtcttcttgcccagttagttacctgattcagaagtgcctgccagcctgtgaggctgggaaataaactgtggatagacttgagttgggtgtatttacaaagcctggacatgcactggcaggagaactgagtgccccaggctccccacacctacaccacaggccctgctcagttgttcagggttcactcgtccacggtgagtcgccggagggtcagggaggactcacagagaacagggtgagtgccctacacccttcagcttgccagttctgcagtccccacccttccggtctggatgcccagctgtgtgtgtgtgtgtcaggtggggtcagctgggcagaaaggtggaccccagggtcggtgttgccgcatcactgcatgcactgtggggtcccaggggccctatgggtataggaaggaatgaaatgtgagcacttgggaatctcagcacactctgctgctcacctgctaccaggctttctggttccccagggaaccctgggccagcttgttgctgtcctcttttagcgatgggaaataagagtatgagagacagtgttatcctgtttacaatcagtggtgaagtccgtggttaagaccaggttacaactcctctatgcttcgcttcttatcttgactctgtgtgaaattaggaaaagcatatttactgttatagttttgtagctggaaaatgaaaatataaaagtctattttttataaactacaaaatgtaaaacaacagactcagtatggctggtgggtacagagaagacaaagtggctcctcacggggttgacaggagtctcgagacttttatcaaaaaaggccagaagttggttgtcatttttgagacactgggccctagaccctgacgtttccgttggaaggaggagcccccagctgttcccgctgatggttcaacctgtccgccaaaagcagccaaaatgctctccccacggagtgcccacttggagaaaaaccccactggtgactcaccttctggacatgtggggcaatcagggcccggtggaggcagctgctcctggctttccctggtgggccctccctcgacccccgcccaggccctctcctgccttccccagaccccaatgtgccaagcagtcaagtgaaaatcaaatcctctgaggcagaaagacacagctgtgtgtttacagccactgattcagatccaaatcgcgtaccctgccagtctctagcaaggcaggctgggggcaaagtgtgtgtatgccaagcagggatctatttcgggaggtgacctgcaggccttcgccatgacagtgccttcctcccacccactctcaggaaaggtgctctcactttacaagcggctgatggggttgtggggtctcggcatgcttgtcacttgtgcagtcagaccccagtgccatcctcgtgcagccacatgggaactgtgtgggctcccacctgcctagtaagaaggcagagagtgaaggggagtgcagggccccccgcaggataaacagcgggaaggccgaccactcagaagacaggatgcccgcctctgcctaggacagagcctgcctcagtcctgtccggggagcagcagcaccgcagcagagggggccagagaaagagcatccaatggcaggagtctggcaaggcgacagcactgccaatgtcacggtcaaggagaggagacccaactctgcctgtggtccagactggaaagttcaaagagaagtcagagagcttcaagtctgaggacttcaaaggctaagaagtaagacccccccccgacccatggaagtccccccaaaatgagctcctggtggaaacaacaggggatgcttcccccttttaaaatagtgatgagtgtccctggtttgagttgagttaggaaagcatgacattttggaaggaggccaggatacctgtccataggtaggaatagcctgtaagatgttgccctcctgcagtgtggctaaatgggacactgccgggggtgggactcagagcagtgggatttttagttttgtcatgtttgcccaaaggtggatgagagaaagacccttgggtgtttgcttagtggcttcccaatgggtgggaaggtgagacggggttggaagcatggagccaccccagcagtggcagggccacagggcagcggttcttccatgccccctaatcatggccacattgtatcagcctgagcatgagcaacagcaccatggccacatacgggaatgggcctcattggtgtaatatttggcagattctctccacaccccccgtggcggtctggcttactgttaagaagggtaaccttaaaaaatacatttcccactccagaaaatactcatatgtggcctgttagcagcacaagaagggtgaaagcaatgcccattcctgcctccctccccctgctcacctccacgtccctgtttgcccctttgtaggtgaagtgagtatattcagcgtcttcatggcaggggagagggtgtattaatccgtctatgtccgctggaaaggcagtctctgagcgggccacaagggttcagccatggcccatccaataacctttttgatgacttggatgaagagacaaacattccaaccacattcaaagatccagacctccaaagtgtggctcatttggtagataatggaattatatttggaaagcatttcccgcagctgggatgatgggtcaaaaacagatagcattttaccagatcatatttgtgtgtgtgtgtgtgcgcgcgtgtgtgtgtgtgtgtgtgtgtgttttaaattcagtttcccaactacaggatggcatttgtagcctttcctaaaaatcaagtttaaaaaaaaaaaatttcttgggttgtaattgacgataagcttagtgtaagcaaatgcagaatgcagctgctttccaaagggcagctttaggctatataacaaaagtgggaaaggaaaagtgttccattgctttttgttgctctaagcaatattaagtcttggttctaagcccccacattatcaggaactttaacatctagagacaattgagagagaagagctagagagagaaagtgaccctggaagccacgtcggaagaggctggagtaaaaatgtctagccccccagcagacttgatggccaccgtgagctctttgcatttgtcttcaagagtggacacttccgggttgctccagagagcaaggctagaacaaatggctagaagatagataggtagatactaaaaatattctaacaataacagaatattccaacaatagactatgtcccctcaaagggcaacgagctccatgtctagccgtttagaagctgaatggccaaggatagtgcagagtaggtttctacaccagatcccatgatcttttgcaactggaattctatgctgccccaaatacttgttaaatggatccgactgcatttcattctgtggtttataaataagtcctggaaaaggagaatgaattataaggaaggagtttgctgagattggaggagagggatctgaaagactcaggactagactccgccttgagggagaaaaagccacaagatgacacactcaaagcaagggaaaccgtcaggaagtggaattactgcccttcacatgtcatccttgccttcttttctgttttttgtttttttttttggcatttgctgccgcagcagctgagctctgggcaacagggctctctctcccgaatgtctgaaaggaggtcagcaagtggaggacacaggcgcccactggcacagggcattggcaaccatcgtgcagtgagccccagcacagccagggtggccatgtgcgtggggcgtcctggcccaaggttgaagaaaactcatcctgtcatagttcccatccggaaagggtgttttgttgaaagcaaaaaggatcataaagtcatttgccttttacccaatgccagttccagattccaggtaaatgagctaacatcaaaaacacctcagccggctgggcgtggtggctcacatctgtaatccgagcactttgggaggccgagacaggcagatcacctgaggtcaggcgttcaagaccagcctggtcaacgtggtgaaaccccgtctctactaaaaatacaaaaatgagccaggtgtggtggcacatgcctataatcccagctactcgggaggctgaggcaggaggatcactagaacaagggaggcggaggttgcagtgagccaagcttgcaccacctcactccagcctgggcgacagagcaaaactccatccccatcccacaaaaaaccccccagagacctcggactgaggagaaactatgcccccaccctggcttccctcctctagggccctgccagggggacttgtcctcagcccagctcagggaaagggaagggttcccatgtcacattctttccagctgtcctaagaaccaccccgattgccgatgacactccctcctctcttgggcttcaccagggctgctttcaactcatcgtgggattgtgtaattatggtgattacagcttgtgacttttttcctctccatcttttgctttcaaattctttgaggcctctcattaaacatggcgatcccggtaaagtcagcaaagttttaataagacactttttacagctaaagaaagcccagtcagggttgattgctactatgttctctcagatactccattaaaactctatcaggtgcagttggtgcctaggtataagaggtgggggagagggaaggcagggaggcagagggcacctgtacttagtgacagggctggagaaccattccacaccatgcccctggctttttttgtttgcactaagcaccaagtacatctgagcccccgtgcctaacaggaaaagacagactgtcaagcaaggaccgaaagcctggccttaacatcatagcacattacactgggaaatggagatggagcatccaagacaacacttaacccaaccttgtaatcttctgcagcaaaagtggtgggggaattctgatacgtgctctgtcctggttaatactagaaggttctgaggcatccataattctaaataattaaaggagtcaatcaatcactagcctttgtgagtcatcacaatccggtggttttacacctgatggaggttttacacctgatggaggtttccttggtagtgattcagcttcacatctcattcttggctaatctttaatcatagcttgcttgcttgctttttgttgttgttttggtttggtttttgggggggtgttttttttgagacagagcctcgctttgttgcctaggctggagtgcagtggcgcaatctcagctcactgcaacctccacctcccaggtttaagcgattctcctgcctcagcctcctgagtagttgggattacaggcctgcaccaccacactcaactaatttttgtactcttagtagagacggagtttcaccatgtcagccaggctggtctcgaactcctggcctcaagtgatctgcacacctcggcctcccaaagtgctggagttacaagtgtgagccaccgtgcccagctcatagctttcttgaatagttatcatagctgtaggacatcatgagaaggaccatcaaggagtgtggcttgtgtgtgtgagccccgtgacccacccttcagcaggttcatccaggttcccctcatttctatattccctggggactacacagatgcccgcacagtgaagtgcatcttgctccagcaggactgtgtttctgagaggtccctgattggctgctcgtggctgaccgtcccataccaaccagactgccttttaccctgcaggtagccagttacctcactacctgtgtctcaaaagagcaaggagctggattgtgactgagcagcaccaaccacctggagttaaatgtcaaaaacgtggcagggacatttcccccaactgcattcccatccactactgaaggtggcctgctcgtgtgaccccttgagaacaacggtccctttagtacccaccagaatgcagagaagtaagctaagttcgagacaggcaaccccagctgaatccctttttctccacctgatattatgtgaccctgggcaagtcacttgcatgtctgacaggtacaacaaagcccactgcacagggtagatgttggcattcaatgaggatgtgatcacaagagctgccatttattgggagctcacactcacagtgttggactgtgtcatgctggctttgcctgggatggactttggttctacttcagctccatcacttagttgtttgaattgcacagcttctctaagcctcagtttcctcatccataaaagggagataagagtaaataagtaggaataaaatgcataacgtccttagcacactgtgtgcagtgcgtgtgcttaacaggtgtagctcttagaatcagtttcatcattatgatattatttgcagctcatacttaggctgcgcttattaccttatttaatttccaacaatattctgcaagataggcatcattatatacatcttgtggttgagggtgggtacgtgggtatctcctatatgacagtctgcacaaggtgcatgtattacagagatcagctcatggtaactactcaataaatggcagctatgattgttggcttatttttaaagtcaactcagagagttagtttttctgcatttcctggaaatgaagggactgtggtgcccagcaggccagcttctgttctatggtcgatttcctggggcccctaagcacttcccgggaagctgtgggaactggggggcttgtcagcctgtaaggtgctgggaggtggggagggccaccaggcaaatggtgcacgtgttgtggggatctggcatttggccgcctactgagttgaaggactcgaaggtgcctcctgctaccagagacagataaggaatgggtctacccaagataagaagatgaaatccactcctccaaatgtagccctccatgtgacagaaacactcacctctcagctgtctgcttgcctggagccaccctgagcaatgcaacctcaacaagtccagttgctccgtcagtccaataaacagaggtttctcttttttaaccacttattccaaagcgaggtagtggaggagtcagaagcacgtggcaggggatgctttgaaattccttgataaaccggacccctggggtgggcactcctactgcctatagtaccgacagaaacagaagtggagaagttgtttatttccaatgaggtcaataaatgcctttttcatgggggagaattccatttttatatatgtattttaaggtgaatgctttaagtttgcagtatttgtcagagtggcatcttaggagctgatagaaaactctacagccaaacaagcgattgcctgtgcaccttgcatgagatgcttctgtaagtgcctgtggtctcaacatgcacatgaacgcatgcactggtgtatgcacatgtgcacaggtgtatacacaggtgcatgtgccgcctgcctgatgttcgcctctgtgttcagtgtatggtgtgcatataaccataagctgcaaacctgcaagtatctctgttgcatggattgcatgccctctgcagctgtgtgtgtgtctgggcaggggctcctctaaagccacaggtcttcacagtttcagctggataagttattcttcacttcccttcctaaaaacacaattgcctagtgctgctggcgcagagtcagaatggccgctgcatttcacccccgaggtggcttccttccagcagtgggtgagtgatcccggcgttcgcacactctctaatctgtggaatccttctgcacagaaggtgttccaaaatccaaaagagatgatctgtttgtccatggcatcgtctctgcccaccactcctgttctcatgccctggttccagggacagtcggcagcacccatttcttggtgtctctgttttttctgcccattttttgtacccatagtttttctctcctaagaaacaaggagctgaggggtccagaaatgatgctgagatgagtcccttgtcccagaggcaatgtgcagataacatccttagatattgacccagtaactctcttctcctagtcccattccctagcagaacagggaatacccactacctttgaagatgcttctaaatccaataacagcatccttaggcttcatttcctggtgaaagcttccataactcttcctctgtgggccctgggccaaatcctgcaggaaacgtagcaatctcacatttctacacactacaccatcaggggagaaaaaagctgggaaaccgcccatcctctgtcccatggggaccaaaagcatctcagcagcacgtgaaaagagcctgtagggaaataaggttctctgtagctaagagttccaatgacctaagtttctgtccaggtatctcctgaaaacgctgcttagtctgttccctggtgtacttcctccggttaggaatccatgtctgataagtgcctgctaaattgcattcctgatagtggggaagaaagaaatgagccggccctctttgcatatgcatccaaatgggcatggacattcactgaattgttatgcttttgtggggggatgagaggtcagcaattctaggctccgccttttcagctggctaaaccaaggaccccaagaaatgtacgtgttttgggtgaacacatttgcaagagataagtgtcctcaggaggatggggtcagagtcctcataggtcctcaggagaatcacatactgccaaccaaataactttctcttgccgctttgtccacaatatcaagtaactaaattccagcttcactgtctcccgtagtcatagtcaagggttacttgaatttcctagttggaaaaaagtagcatcaacttgttgccaatagcaacacagccatgtccctgtttcctagagccttttggtctttgcctaatttggagtgaaccagagcttagatgccagagtccatttgggaaggaggaggagaagaggaacaggcgggcattaagtgggtcacaggaaggcatgccaccgagaggccttacaggcagaatgccaccctcattccactcctgaagccaccaagaatttcctgcaagctgagagaagaaagagcaacagggttgttccgtcagatgagaggagggagagaagagagagctggtgtgaaaagggggcatttccaccacacagggatgcagagtagcagggaaaatggagatgcacaacttggacgcgagaccggggagtctggacctggcattctgccactcatgtagggctcagctgctgagtccttgtctctcccaccatccctacccagctccggatttgtccctgcacagctggggggccatggagaaaggtcccccatcactcagcaaaactgacaggcagaagaaagtgatgagcatggtgaggccagggtcagagatgccaggaacaccagcagggagggcttcctccacctggctgggcaccccgaattaggcacttggcctagaatgatttaaagtggggttggttttcattagagtaaggccaccctgcctgccccaccttagaaagggaaacatcacacctgctcctgtcctccctggggcatttgccatgtgtgttcctagaggcatcagcatcagtaacacagggccacaaacagaacggtgggttcacccagcctgtccagcagctaccacctgaaatctacatgcaccaagccatggtgacctgcaccccagctcaatgcagtaaccaaaagccccttttgccaggcttgtcagccagcagatggcacctcctttctctcaggatttccaaatgggatgaggggaagccgcttcgcagcatagaacctgcctgagataagctcaagcatgctcaagaacttaagttcttttctcagggaagttgagaaaatcaccctgcattgcccagagaggttgcccagtacgggttgggcacaggggactccttcatccctgagtgtttccatctgcctccttccttgagagtgacagccatgtgcaaagtaagaggggcatgggtcgtgaaggccgaccaactcagctttgccactgactagccatgcactcccaggcaagttactcaaactccgtttgagtctgtttccttgttcgtttagtggagtttatagaaatgcctaactggcaagcatgttgtggacataagtaagtgcgggtgcttgtaaaatgcctcgcatgcttgacagacacacaatagttgctcaatggtccatcagcaggtggctgtttgttagtaactgtcctcacagctacctgtgtacctagtgggggaccattcccaccatgccactgtcaaggcctgagtgatttgaagaacaaggcacttgaggagagagggtccatgagctacccgtgccattccatcaaacaggcccatgggagatcaggggataggtgggtccttttacatttaatccagataggagaactggcaactcttcttttgtagattcaaaaactttttaaaatattttaaagcactggtagttgccaattatattagtccattttcacaatgctataaagaaatacctgagactgggtaatttctaatgaaaagaggtttaattgactcacagttccacatggctggggaagcctcaggaaacttacaatcatggtggaaagggaagcagtcttacttggcagcaggcaagagagagcgagtgtgtattaacacttaaaaaaccatcggatctcatgagaactcactccctatcacgagaatagcatgggggaaaccacccccatgatccaatcacctcccactagttcccgctctcaacacatggggattatagggattacaattcgaagtgagatttgggttcagacccagagccaaaccatatcaccaatacaggatagagtaaggtgtctgagcctactagtggtcccagtgacattctgtgggaattgctttcagaagacgtgactgctgggtacctcctccatccccagtgtttaccaggcagagcctgagtgtttacaccacacacagcctgagtctttataccactgtacatgagaaggtaggggtcgggggggcggggtggggggtgctgttgcaagaaaaaaaaatccattacgtttattttgatcaaatttattattttttaaacaggttcagttttaagtattcatgaatgtaccatttattaattctttaatcagtgaacgtctcttttttgattaattcacttttcatctatcccttgacttttttaaaaaaattggggtattgttttatgtttgtgatatagcttcctatttaaaaggggtcaaataaaaaaatattttaaaaccacataaaatgcccttaagcccctgcgagagttgaggaaggttgccaaggccctacaagtaacacagaccccaggaatgggtcagccacaggctcccgcccctcctcactgcggaagggtgagaaagacaggaatggcctctcttccttcccatgctgctctgacctacctctgttgtggaggaaccataacgggttccatagcccggtttttccatttcctatgccccaccttgtttcacagagttgagttaatagagggtgataagaaatagagaatttaaaaagtgttttgaaattattctaggttaagtgtggattttcccaccatcccctgccagcgtttctccgacatctcagactgcactctctctccccagttttagacatcattgaggaagaagatgccacggaattctttgcattcccttttaaaatcatttcttttgctttgctcagtggagaaggagcaccaggggcagcaaccttccgggagtcacccgatgaagtcaggcaggcctttggcttctcccatcctgctgaacccaagccaggatcccctacctttccacctggctcttgggctcctgacccttatcctcagcaagtctcccccaaccccaccccaggcctctaattccacacgtatacatcctttatgaacttgagcaccatctattcaaaggtgaccttcaggctccttgagagcacgactcatctctctctggggcctccacttcttgcctgctaagttgcatggtgagctgtattcaacgaaacacgatttttcatgagcagggatggaaaatgcctgtgtgtcacaccaaagggatccgtttgcatcaatggaggctagaaatagtgttccacattagttctgttgcgagttcgaattccccaacagaggaatccaggttcctcctgtactggagggggaagcattgaatttctccaaacccagggatgggcccagcaactgaagaagggtaaggagtgggaaattccaaggcatagatgtcatagctgggacttttttttgtcctaattttttttttcttttgagatataattatgcacggtaaaatgaacagacctgaagtacatggctcaatgaatttgacaagtgtatgcacccgtgtaacgtataccccatcaccctagaaggctccttcatgtccctttccaatcaatttcatccttctcccccaggggcaaccgtggttgatttctttcccccataatagcctggattttgatttggcagacttgagatctgtaacttcggtcttagttcatctgagcagatcagcaaaagaatctcatcagaagctcagatgtctttactctcttagcattgaaaaagatcctccctgagccgctagtgcttggctctgctgtcccccagtatgccccaatctgacccccagggctactctctgagccacagccctcctcccagccaaagaaagagtttagcatcagtctcccaggtaagtaagtggcaaaagctcttggtaacccagatagtgcatgctttgttgattaatatgtggaagtgcaatgcacagagccacagcatgtcaagcagcatgttgatttttctcactgcacaaaagggggctattccttttgtgtgtttcctttcagaaaacaaaggattccatgaccaccttcttccaggctcctagccatcaagatggccacagagctgaaatgattaatcagagcggagggtgggaattgaatgtgtgggtgttagtgaacccagcactgagcccatggtccatgaaattgaaggatcccaaattctactggattacactttgccaaatgtctcaaaggtgaaaagcactttgtcggtatgcaaagctttggtgtctctggaatgtaccttctgcagctcagttcttaatcactgtatattttttcacttggacaaaggctgcctgctaatagcattttcaaccatcctcagctgcttcgctcagctacgccaaggcctcgggctgagctggctgcggtttcctggcaccatgatccattcccaactgaccaacactgaggaacattacacactcacaccctgaaaaaaacctgcttcctctgtaactatgcaaatgccagacacaggcaggcagaattaccattccccttctgaagtggttccttcaggatcatccaaactggagacagagatgagagtaaagagacggggcagtgccctggagggtacaggcaggagctcccctctctctgggcacagcggattcctcgggagcttcctgcaagcctataggggcatgcactttggggcagctcatctctgaacacaggtagcctctactatcagatttcactttgatcactgaaaactacaggagtctcagctcttcagaagggaagcagctgctgagcaagtgtgattgcagtatttcttccccaaagccccgggccaggcatctacccatgcccgcatcctgcatgattaaccgccttccagtctgagcctgccctcactcacgcgggaggtcactgggtagcgagtagattgcagctgggctgagctgcctctcaagccgacctgaaccctcatgacctccatctttagcagcaagctggcatttggtaaatgcgcgaaagcaggagtggggagagggagacaaaaatgccaagcagcaccgcctgggttgctgagaggttgggaacaatcccaagggtggcccctaagctggtcagctgcaccatcctaccctgaaatcctgggaaataaaagcagtcgggggaagcgaggagcgggcagtgacaggctggccacaggtccttggagtcagagcggtgaggctgagctccaggatttagtcaggaagagaataattagcaccttcaagcccagcccagcccagcccattctgtagaaaggggaagggttgagggtatggaagcctcagggccaaattcacctaaaacaaatagacacataatcctccagaaatagaatctccaacctccctcaacccacagtcccctctccagccaaaataaccttgttaataggaatgaggctgcagtgaaggtttgggcaactggtaaacctcacctcctttgtctctgggctttgaatgtactcattggcaacagactcttattcagaagcttgagtgattttttttttcccatccaccagctaaatgagagccccaaacgctgtggatagcaaactcagaacatatatatttgggtacataatgtgtgatttgtggccctggcgaaggagggatgggaggaggaggaggacctgatattggtgtgtggtggttatcacagcaataagtggcacctaaaaggagagcaaacttcctttgtgcctttcataggacagggatggacataggtaaccgggggtaggggaggtttgtaagagctctcacacaaggaggcccctaggctcagcagccccgtgtttccccagcaaggatgccccacacccccatgtttcctgccttcaggcctgccccaggaaggcacattcccgagtgacaaatgcctcacactctatgtaagaaagggcactcaaggagagtcaccgctgggtgtgtgccacagaacccggggctggggggagcccttgaaggtcagcctctgccttctaagagctattgttgtacctaacctggtctagacaaaggagtagtcattcttagtgattttcaaagactgacaccataaccctcttggattttttaaaaatctgattaaaaactccttagccaagtataaatgtatcctgctgcaggctaagtttagtgcacttgaagattcagataaggttgctgatggggtgattttgtggacgtgtgtgtgtgtgtgtgtgtgtgtgtgtgtgtgtgtgtgtgtttaagatggggagaaaaaatgaaaagttttgtctcactagtgaaaatggggagtgaaagcaatggggaggaaaaaggtcaaggagaggtagggaaaggcagactttctgacagctcctgagggcaatttcatttttggacaaactcccatctatagcaccagaattctcaaagtcaggctggccatgcctctccatggagatctaagccagatgccacattgtcctgtatccagcaaatccacagcccgtgttgtttattagataaacccgttatccatcaattcatcaatcagcaggtttattgaggaccctaccaggcttcacaaacctgatcaattttttaaattacatctagcttacacgcagccaagcccagtaaacaagacgagccctcacaccccacttggaaatgaacatgaggaatcgctggcccttgcaatctcacggccaaacactgcagccccatgctgacgagctatcacgtgctgcccttcacagatggcggtggtgtcgctgacccactgtcaataatatgggtttggagtgctttcccagacacagtgatcaatctgcctgggtctagccatactgtcctctaaagccctgtgcaatgatgcggatttctaaagagggtgagctggagaacgggcacacactatgtaagggcaataagcaaagcgacggagcctcgctcgtgcccctcaccctcctcctggtgcccagtcgcaactcccctcctagatcaggggcttctccgccatctctccagggcacatacacaacgggactctcctggcacctctatggctgatgcaccaggcctcatgatccagttcactgttttagtttttgagaagaactgccacatgggttatagttgaagggcttgtaggctttcctggtatggggtcatcaaactctgcctctgggtgccacagatgggaagccaagaacataggagacagcaggagtgcactgccctggggcctacagtggctctgagccccagcaaatgccccccactttcatggtcccagaactggtcatcaagaggactcaaggtctttgtgtctaccctgcattccaaacaggactctgccttcttaagactagttcattcattagcttctgatcagccagatccttggccaccctctatttgagtcaagcccccgtccctgatctcagaacaccccaagtccaccttttcctcccccacgtgaacaaaatcaatttcagggcagcccgccggcattaaaaattgctctacctaaaggtttaaatacctggtttttggtaagtaaaattcccataccacaaaaagagtaccaacaacacaccctcataaggggaccctccaggactccctgaaccttccctggagccctggtttctccagctgtccaaagttaaggctcccatacacctagagatcaaatatcaagatggtcagttgggttggttggtcgtttggcctacatggctcatgcaacaattaattcacctgtctggctctctgtctctgtccctctgtgtgtgcgcctgtgcgtgcctctctgtcgctgtctctctgcagggaaagtcgctggcgggcaagcgcctcacgggcctgatgcagtcctcctgaccgttcctaccgcaggtccagggcctgggcccgcggaccccacaggcaggcggcggcgctccacatctgcggacagagtttccttacgaggagacttggtcactgtgaaggagaaagagtgagggcaatgaagggcgatggtggggagactcggtgggtgaatggggagaccagaaagaaagagtccacagagcctgggctgggcccggtggaggctcctgtttacagccctctcttctttgtacagttgtattccaacactccactcgctaagaggccctgatccc

SEQ ID NO: 2369 - DNA, 629678 bp, Homo sapiens; identical to SEQ ID NO: 2368

SEQ ID NO: 2370 - DNA, 633454 bp, Homo sapiens
catttcagatgcgtgacaggtgcccgtgtgtgtgtgtctgcagtttgggactgtggaagcacgagcttacataagtggttaggcaagctggcgtgtggacttgtgtgggatgggtgcaggtctgcatataaatcatgttcctgggtttctgggtgtgaagcgcacaccgacggggacgagagcgcagaggatggcgcttttagatacttccagtcttccgatgttgtgatcgcaggtagggcagctttgcctctaatcaggcgttcattaactttttccctgaacaagctcgcccatttgtggtttggaagaaaagaaagcgagtctccgcggtgaggtgtggagggcaggggcgggtggggaggtttgttgtttgggaactgcgctagcaaaggaagcggtggctattcgcttggagaggatgacaaatgaactggttgcgtgaggagtgaagagaccgtgtttacagtcaccagcaggctgcgtaaagaagtggcccagtgagacagggaaagtgacccagaaaatttagttttgttcagaatgaaagctgctgtatttcatttttgtttcttaatttgacggagtaggaacgttattttccttctctgtcattgagaccagtagcatttctatgttacaaactgaagatatttggggtctcgtcggcttgggattatcaatgcttgggaggtgagttctgatcaatacctttaacaaccccaaagaaaaacgcaaaaataatcaagtttaggtaaaacttccactggactttctttccagggagggtgagagatggaagaactgggcttgtaagtatcaaaatggagttagagaatgagctacaagtttgtgtgtgtatggtctgtcaaaaagtgttaagactgaaaggaaactgttaggtttagttaaatgtgttgacaacacggctcttacatatcaattttcataggcaaataggtaattacatagagtgggaactgggactatggtgggaaactttctgtaagatgtatattctttattcttaatttatcactttttcaatgggtgggactactctgtgaaggaaagtagagggctgagggacatttggtgagactcttgagagagaaacctttgcaagccaaatctcgcatgctatagatgataaattctaagttctttgatattgtaccactcttaagctaaattgtcctgtaaatatgatctcatgcaccataaactatatatatgtagagagagtctattcccaataactcatcctttcctgaaagagtctgcaagttctataaatgtcagctgttgggaggtattgtgatgaaggagagaggccaccagtgtttccttttatatatttattctggcagatcttaactttacttctgattttctttaaggaatttcagttaacattcactgaatttatattgctgagagtttcagtaaaacaagactagattttctttgaagcaataaattcatcttatcaagtgaaacattatgacaatgcttttgtggcagaaatgtttatttaaatgagtccattttaattatttatttatttttgacttgcagaataagatctgcaacatagatgtttttgaagtaagtagacgtttcttgagaaagaaaaataaatttaggttactgtggacaatttgccagtaattttggatgtctctttgtctacagggacataattttgtgtgaaagtagaatcattccatttcttatgtctctcatcttctcccatgcattttatcccctgaactcctaagactttgccaggaattgctgaacattctgtttcgtgccaggggttaaatatcaggggatggaataaggagctgtgtgtcacataaacatttttcaaaaggatgctgtcagagatctcaataccgggattaatttttcctttagctttgcagttagcttgtcttaattggtattgctctgaacctaggaatgcatttaacctcttcattttcagtttccagctggaaggaatatatttaccaaatttcatcttctttgtaacatatggcatgatataaataattactatacacacactatcctgctgtaaggaaagaaatagaattacaaaatcaactttcgtgttgagtgatatggatataatatttcaaaaaacaattttaacttttcccctgattccaaaagtaatatttagctattgaaacagttcaggaaaatacaaagaaaaaaataaaggttatccataatctgctagggagagggagccactgttaacatatctttaactgtatattcttccaaatattattctagtcaattatttctacccagtccccctcccccacacatttttataaatataaaatatagcttggaaatataacttggaaatgtgttaaaggcttgggaatttactgcttgtttacagaatgattttgatcagatattagtttttactggtggtccttattttcaaaaagagtaggttctttctttttctgttctttgaaaacaagtgtttgcactttgggctggtaatgcttggggcttccttttgaatttagggattaaagcatcagaaaagaagtagaaaggtcattggccattgtgggtgggagacctgagttctggttgcagttactccaacttctcctgtggcctctgggcctctgtttccctaaagggcaaaaggtacttttagatttaactaattaagctaatgacgtatttattgctttgacatgagaatgatctttgaagagggcttattcaaacacagaaacacctgggggtcatcctgggagtctctgattgattctgtctgagatggggcccgagaaggtacatatctaacaagtccctggatgatgctgactgctggtttggtgacagtgaaaactagagggttaagtgtactagggttctcttagagggacagaactaataggatatatatatatatatatatatatatgtacatatatatcatatatacatatatgctatatatatgctatacatgatatatatacatatgatatatgtacatataccatatatctataaaggggagtttattaagtattaacttacatggtcccaaggtcccacaataggctggctgtaagctgaggagcaaggagagccagtccaagtctcaaaactaaagaaattggagtcagatgtttgagggcaggaagcatccagcatgggagaaagatgtagggtgggaggctaggctcatttctccttttcatgtttttctgcctcctttatattcgctggaagctgattaggttgtgcccaccagattaagggtggatctgccttccacagcccactgacacaaatgtttaatctcttttgggcaacacccacacggacacacccaggatcaatactctgtatctctcaatgcaatcaaggtgacactcagtattaaccatcaaaagcccaccccttgtcaacttgaacccatacatatctcctgagatcatacataatcttcaaataaagacaataatgaggtcaaaattgtgcataacataatacaactatcctttgtacaaccagaaatgcaccaatccccaatgcaaatactattacataaagttaacaatacttacatgctgttgtgaagtcaataaatcttatgtcacatgataaaggaaaaggaaatgaagatattttcttagtatgagtgtatatatacacaaacatgtttttaacaaaagaaggaggaaatactcttgacaattacagtctgtttctgcagctggtcacatggtcgtagctggtattgatgactaccttcttctacccattcagtattccttttgcctacagcaagcacctcagcaggttcttttccctggtggagtgacccaaacctttattcctgaaggatctggaccatttgtagtcccgcctggattgggctgttgtagtttcctgttgaccttaatcacagggcatggtaatactgagagatgccctaatggatttcctgtgttccatatgtagtcttccttacctctgctgtggagtagtagactgatttcctcttgatagtccaggtcaatcatgccagccaacacagtaattttcttcttagcctgttgactgaaagataggagtatcccaaactgtccaggtggcaatcttaacttccagtttaatggaatcgttgtgtttcctggtggcagtgttcctccctctggaactaagatctctaggccagcagaaggtaatgtcttgggaacaggaagcaaaaattttgctagtggatcagtaggggtgatggtgagtggtgccacttccacttccgccccttgattcctggacctgtgaatcctggctataggagaaacagtaccatatattggatgctgattcagagcatacacggccctctggagaactctgccccagccctgcaaagtattgtcacctagttggcattgtaattgtgacttcgaaaggccattccaccattctatcaatataactgcttcaggatgatggggagcatggtaagaccagtgaattccatgagcatgaacccactgccacacttctttggccataaagtgagtgccttggtcagagacaatgctgcatggaataccacgatggtggataaggcattccgtgagtccacagatggtagtcttggcagaagcattgtgtgcaggataggcaaacccatatccggagtaaatgtctattccagtgaggacaaacctctgccctttccatgatggaagaagtccagtataatcaacctgccaccaggtagctggctgatcaccctgagggatagtgccatatggaggggtcagtgttggtctctgctgctggcaatttgggcactcagcagtgatcatagccaggtcagccttggtgagtggaagtccgtgttgctgagcccatgcataacctccatccctgccaccatggccactttgttcatgggcccattgggtggtgacgggtggctggggaaagaggctgagtggtgtccacagaacaggtcatcctattcacctgattattaaactcctcctctgctgaggtcacccgttggtgagcacttacatgggatacagatagcttcacagtttttgaccactcagaaaggtccatccacataactttttcccaaatttctttgtcaccaatttttcaatcatgcttcttccaagtccctgaccatccagccaagccattggctacagcccatgaattgatatataatcgcatattgggccatttctccttccatgcaaagtgcacagctaggtgcactgcttgaagttctgcccactgggaagatttcccttcacctctgtccttcagagatgtcctagaaaaggcctgtagtgctgcagctgtccacttttgggtggtgcctgcatatcgtgcagaaccatctgtgaacaggccctagtcttctcctcctctgtcaactgatgatagggaactccccatgaggccgtgggtgcaggctaggggagagaaggcagggtggcaggagtggagaccatgggcacttgagccacttcctcatgtaacttacttgtgccttcaggacttgcctgagtcagatcacgtatataccacttccatttgatgatgggatgctgctgtgcacaacccactttatggctagatgggtcagaaagcacccagttcatgatagaaagttcaggttgcatggtgacttgatgacccagtcaaacgttcagtttccaccaaagcccagtaataggccaagagctgtctctcaaaaggagagtagttacctgcagaagatgacagggccttgctgcaaagtcctagagtactccactgtgattcacctatgggcgcctgccaaaggctccaaacagcatccctatctgccactgacaactcaagcaccattggatctgctggatcatatgtcccaagtggcagagcagcttgcatagcagcctggacctgttgcagaaccttctcctgttctggaccccactcaaaactggcagcctttcgggtcactcaataaatgggccggagtaacacacccaaatgaggaatgtgttgcctccaaaatccaaataggcccactaagtgttgtgcctctttcttggttgtaggaggggccaaatgcagcaacttatccttcaccttagaaggaatatctcaacaggccccacaccactggacccctagaaattttattggggtagaaggtccctgaattttagttggatttcttatcctctggcttgcaaatgtctcaccagtaagtccagtgtgtttgctacctcttgttctctggatccaatcagcataacgtcaatgtaatggaccagagtgatatcttgtggaagcaaaaagtgatcaaggtctctctgaataagattatgacacaaagccagagagttgatatacccctgaggtaggacagtaaaggtatattgctagccttgccagctgaaggcaaattgcttctagtgggccttatggacaggaatggagaaaaaggcatttgccaagtcaatggctgcataccaagtactaggagatgtgttaatttgctcaagcaatgaaaccacatctggtacagcagctgcaattggcatcaccacttggttaaacttatgataatccactatcattctccaagatgcatctgtcttctgcacaggccaaatgggagagtcaaatgggaatgtggtgggaatcaccatccctgcatctttcaagtccctgttggtggcactaatctcctcagtccctccaggcacatgatactgtttttgatttgctatttttctaggtagaggcatctctaatggcttccatttgggctttccccccataatagccgtcaccctactagtcagccaatgtgggggttctgccagctgctaagtatgcctatgccaattatgcattctggccctggggaaatgaccacaggataagtccagggacccactggacacactataagctggacctgagctaaaactccattaattatctgacttgcataagcccctagcttaaatggaggaccacaatgatgttttgggtcccctggaatcaatgtcagctcagagccagtgtccagtagtccccgaaatgtctgatcattttcctttcccgagtgcagttaccctggtaaaagaccagaggtctccttggggaaagatgagagaaagatctactgcataaattttcagtcatgtagtggagtccttccttaaggggacccagcctcccctttgtccaaagggttctgggtctgtaaactggctcaagtctggaaattgaatgaggagccgtgattctctgtttttataattcaaattagtcttttgtccattcaacctagaagttttctgtttgtgtaattgaagtaggaatgcagtaggcttcctatcaatttcacttttaggaacaccatgattaattagccaatgccagagctctacatgagtcagactattctgattgccactttgcctctgctgtccattatggtagttatgctcaccttgcctttgatggttgagtgctgccacttgacccctgccacctggtccctgccacctctggatccaattattcccattttgtagttgagtgactgtggttcccaccattagatctgacatacagagaatggcaattacagggctcttcaaagatgcaggtgctgccctcccaagtctattttgcaaggcattggtcaagggtatatcttctggaccctcccagctgggatgagtaggtctaaagggactaatccactccaccaccccaatctccctaagcctttggattccttcctgtacattaagccaagggagatcaggcatttccagctcactcacagtgggccgcctttaagagcttgtgtctatttttccacaatttcggctctttctctaggagataagactctcacttagtgtaatcttagcagatttgaggctcagtatctgcttctgaagctgggagacagaatccctgagttcatcattttctttcatcactttgtccgttgaacttaagagcagccaacctgcttcactgtgttccttggttctccacatatggtcaaatgtgctatgtacagagtcgctaaactccctgcctctcatgagcggtgaattaggagtgtcaaaggcatttattttgcataactctctaaacagtttctgccaaggactatcagtgttttctatactattagaagtagagtccttagcatttttgggtctaatcatattaagcagccaactccagaaaccccaaaaccaacgaaagaactccattcttaatattctgttcatctagaaccactcctggtaccaaaatctgtattaggtttctcttagagggatataactaataagatatatatgtcttagggagtttattaagtattcacttacacaatcacaaggtcccacaataggctatctgtaagctgaggagcaaggacagccagtccaagtcccaaaactgaagaacttggagtcagatgtttgagggcaggaagtatctagcatgggagaaagatgtaggctgggaggctaggctcctctctccttttcatgtttttctgcctgctttatattcgctggaagctgattagattgtgcccaccagattaagggtggatctgccttccccagcccaatgactcacatatttaatctcttttgggcaacacccacacagacacacccaggatcaatactccgtatccctcagtgcaatcaagttgacactcagtattaaccatcacagtaagctccttacaggccaaaatgcctgtttgacttttcacaggctttcacagtaagctccttacaggccaaaaagcctgtttgacttttctttgcagccatccatccagtgccccaaaatatacctgccaataggtgttcagtaagcattggttgaatcaatattagttttctcttatggaggaatatctttctggagtagtcaagacaaaagaataatcatccagaatttggaaacattaagcctgtaataagagttataatcattcatggaccacactacttcaaactgcaaagaaagcaaaaatgcttataagtaggcaattaaattgaacattaaacctaatgagttacattaaataataactaggaatacctgtttgagatgttacaaaccacaaagcctaccaaatacttcaccgttacctctctcaggtctggaagaggccatttattttctaccacatacacatatttcaaaaaatggaagtttcactattaattaccctaattaccaaggcagcagataaagcaagcaatctccttgctcccctctcctcatcccccatccctcccaccaagaaaaaaggctcattagaactctaccaccattctataagataggtcccaattttatgaatgaagaaatgtaaaactttagagaaagaaattaacctgcataaatccacaaagtgaagtagcagcatcagaagtaagatccaggcctcctgataccaaagggtgttgttctttaccacttccctctggtgacattgaatgtgtatatttgatagctgggagattctagctggctgaaataccccagttagaacttttgattatccttatgtggctaccttttatatagaaaatatatcttttccttctacttaggtgttagtaacatagggtggtaccaagaaccaccatttttatgtgtggtaacttcaaaaaaagtgtaaatatttggatatgaacaaaatagatcctcattcattaatagctcaggctatgcaaatgaattgtcttagaggctgtcttggcatttcacagtaatttggttaaactatcaaagagaaagccacctttaaatctgtccatggtagagttcactcattcactagtatctgcttgacccaagaacctattttcttgcacacatggaagcatgcattctacaaagccagctgaggtgaggtcccctgcatgaatgagagctggtggtggcactcccttggaaataccccaggcacctgtgttgctctcatgaagacctggctagtctggagctcagacagagaactgctattatttgttcttaaaggagcacaacaggcattttaaaatcctgttaattgtgtttctgaaccttagttttctcgtctgtgaaagaataatttaaaaaataccctttgagtatgtgtgaccatgagaatagaggaccctgtatgaagtatggggcatagaaagcacagacacgtaagaagatgggactgtcacagcacagttcctgttttctaataatttttagagtgagtctgttgagaaataagtgtttcaggataatggttcctctttattttctgttcctgaggcattgctgtgttagtcaagcatttgatggactcccaagtctctgagaatcctgctccatagttctcacattgggatttgaggaggcttgtagaaagcaagtggcccacacatctaagtgggagaaggcagcgtgggcaagatctctgtggtagccaaagatgcctctgtttcctggaggcgaaaggccattaatcaccagcaggaagagaagtgaaaaaggagactgctgctgcattgatagggcttatgccagacacacagagcaagcccatgttttttctctgcatccttgggatttcttacagtgcttggcacatagtaggagtttggtaaatgtttgctgagttattgagttgcagagtgacagctgtgggtggaggaggaaggatgggctagtattggtaggaattcatggactagtgggggtgcatggattggtatgagtgtggatgcaaggtgcacgtggttatagccttcattcttattgcttgcttgattttgcctggcaagatccacttcatatccatgatatagtgagactgtcatcctagtttcacattattgtgtgtctattccattgggctttggtcggtttggcttttttgttttgttttataatttatgtttgtaattttatctccacctctagcacaagaccaatacacatagtaaatgcttgataaaaattcgttgcctaaacaaaaacttgctcagcctacaaaactatgggtccgtcatatggttgtgggctgatcttacaaaataacaatcagcatttgttaagctttttgcaaatcaaagtcctttaagagatgttgggtggtattatgcccattttatagatgaggaaaccgagtggaaacgaggttcagtcacttgccctaagtcagatagtcattgaggagccaagatttaaactcagatcttttctgaccccaaagtccttgtgctgttttatatagcacaaggtggggaataaacagagaccctacccttgagatcatttcagttgtattggagagatgataggaataaatagaaaattagcaataaaagatgttaaatgatagtttaggaaaaaatgcaggggattttgtaagtcagatttggtagcaaatagatgatgaagacagtaagcacattatagtttagttcagagacagcattttatcatcagatctggaagagacaggcttcaggaaataggaataaactttaaaggtgcaaaaagggataatggcaaagttttcagatgaaaggtgttaataatacagtcacgtgtcacttaatgaccaggatacatttggagaaatgtatcattaggtgattttgttgttgtgtgaacaccctagagtgtacttacacaacctagatggtatagcctactgtacacctaggccatgtggtatagtgctcctaggctacaaactgtgcagcatgttactgtactgaatactgtaggcaattgtagcgcagtggtgttttgtacttaaatatatctaaacatggaaaagatacagtaacaatatggtgttataatctcatgggacccccttcatgtatgtggtccatcactgacttgtggtgcatgactgtaattggttattaaaacaattgtttgatttcagagtaagggctaatataaactccttatagttaaagccatctcagaccaccctagctaaaataataactcctgccccttctcattgctcttcattgtcttacttgccctatttttgatcacagctttatcaccatgacattgcattatatgtacttatatattgtctgtctccctctgctagaatatacattccataaaagcagggactcttttatttcctgttgtagattcagcatctgtcacagattctgattcatactaattgtttaagaactatttgtgaaatgaaggaagaaaatgcattttaaaaatgagttgcaaactcaaacactcaatagaccagttaggtaaaggaaatgagggaagcaagtgaggtttcttccacaatggtaacaagttgtaatttttacaaatcaaaagcatgttttgtttgtacattacacagatagaaagtttttactcccagaaatacatttatatctatttttcttgaaatatggggtcatctgactcattgtcaagagagacctggataccaaataagatttccttttttctagaagcagaacagccatccacgtgtgatgatgaatggcacctgaccttggatctcagggttggggttgcattagggacaggtggagaatgtgtttaagcgagaagtatgtgctgctcagaaagccctgttgttgccaaattttaattcatttaaaaattattaaccaatttcaattagaaaaatattatgtatatctacactgcccaatccaagagaaacaccttttgagctggctgtattttatggtgtgacctctgtagaaaaaaaagattaaataacatatgcaatatattttctccttaaacttctatggaaatgctacagtgtttagattccaaatcaagcaggaagatgccattatattattttgctgaccatacatcctaatacaaagactgattcagcagctggtcaaaatagaaaggacgcattcacaaagaataaatatattgattacattttagacttttttttaggtgaagggactttcattttcaggatagcaggtagtttagggcttggctgttggtttctgccgatagccaggggtatgtgacaggagacaaagtagctgaactctcttgatctgcattcttcccagttgcagaatagggctgagaaattgtgattgctttgagatggttactgaaagagagtgtgtacctggaaacaatctctggtttagtcaactattaatggggttgcgggggcgggatgttccgtaccccaggtcacagctggcctggggtctctgctgctcctccccactccttgtcctgctggtccgtgtcagacagtgcatctatcttcctaccaaggactcatttccagataatgattaattggatatggctcctgtgttcaagaaacttaaaattctgaagaaggaaaacaaatggagagacggaatgtggtaagcaaggcctatatatggaaagttagggagagatgacttcctgctgagggatttcactgaagaggctaagtagatgaattggactttggaggacctagaggtctggggcctgcagaaatggggccaggggacagagatggcaagaatgtacttggggcatttcaatgtaaacaaaattatacaggtgatcaaatgcaaggaatgtgcaaagaatatttaataccccccatacagagtgaggtccttaaaaacctttctggcaggaggagtccgtgttgatgaacttaaaactttaatgaaaacaaggataggggaaacctaggtttaagcaaaactgttcaataagtatttgtcatatttactgaaagtaaaatgagaaaacaaaagtagattatgagtgacattttactcaccttatgttggtaagagcagtgtgccacagtgaatttccagttacttcttgctgtttttcaggctgtcagccccccttacagtgaaatgcttacaggtagttttgctttattacagttagtgtacaattcttatgcacaagggcactcctccatgccaggctcactatacaaatgttcaatgcctttcagtcagagaggctgactgctgactcctgggtctccctgtggctaaagggtaaagtggatagatacatcttggggtaaactttatttaacttagttggcatgactgatcaggaagtcctcagatacctcacccccatgcctagggtatttagtgtcatgccaaagcatatgctgccaattccaggttttcattttttggtttcctttaagctttcaaaagcttctctgcaaaaatcacttccgctgcctgccatctgccttaaaaccccctcccccacttaaaaaaaatctgtttctaatcccaagagtcttttttgttgttgttttcgagacagggtctcactctgttgcccaggctggattgcagtggcgtggtgttggctccctgcagccttgacctcccagactcaagtgatcctcccacctcagcctcccaagtagctgggactacaggcgtgtgccaccactctgagctaattttgtgtttattgtagagacagggtttcatcatattgcctagactggtgcgagattcttatattttctaattattcttaaaatgaccaattgactatcaaaaatgtatttggaaataggtataagttgaactttgcttattgggaattcttggttgggggagttttctgtagttgagattaccatgttgttgggtatatgaagatgaacagtgacggataaaactagaagtgcaagttgaggccagtgtgcgaaggaacttgaatgccatataatagtgttgatagtgatggggatttagtcttctctctgatgcagactaaacaaaaaaataccaataacccaactgaactgaagcaaaatccaagtatctcgagcagaaataaatttatctgaccacataatctgagaattcaggcttagctggatccagggacttagatgatgtggtcagcactcttactcaacaccttgtcttcttgacttcctccttctatggcacgagagaagaagaagatggtcactaatatttctaccctcacatcttttcaacagtcacctcacaggggaggaatcttctttcttccagcgtccttatctcagtctcagggaaggactttggtcctgattagtcacatgtctacgatggttcgatctgtgtgtctgataatgaggcatactctggccaggacagtccacagtggtaacagacacaacctctggctccttcatcatccctgcaattataaccctgccatgatgtcattttttgcatcactgtatgtgagagggctgcaatgccaccttgagaacccaatatgctgcatccttcctccagatctgcatttatttgcactattctttttcaaacatacagttctactgaagtataacatatttacagaaaagtattcaaatcattgttcaataaattttcaagcagtaaacacatccatgttatctctctgagatcaagaaagagaatattaccgttcttccagaaaccacctcatgggccctcccagtaagtacatatttcttttttcccattggtaactgctaagctgatttcctttctctctctctctcttttttttttttttttttttttttttaaagagatgaggtctcactgtgttgcccaggatggccaggaactcctaggctcaagcagtcctcccacttcagcctctcaagtagctaccactaacctgatttctaacactgtaactttctcttttttgaaacaaatgaaataaatatgaaatcatacatatatgcctgtacactttctttctagatccttatgcacaacattgtttgtgaaattcatctatgttgcaatgtgtagcagtagactatttttattactatatagtattctactttgtgatattccacaaactattcatctactgttgagggacatttgggatatttctaggttagacatatgaatagtgctgctatgaatatttttgtatgtgttttgtgacacacatatgaatgtgtttctgtttgatatacacacctaagactggattgctgggccatggggtgtgcatatgttcagctttattcgatccttacaaagagttttcttaagtggctgcaccaatttatattcctatcatcagttcatgagtgtttcagtttctttatatcattggtaagacttgagattgttaaatgtttgaattttagccattctggtgggtgcgtagtgatgtcttattatggcttcaatttgcatttttctggtgactgatgatgatgtgcctttttaatttttttttgccacttttatttgtcttttgcagtgcctattcaagcttattgcctattttaaattagatttttaatctttttctcattgagttgtagaaatcttcttttaaaaacaaatttttaatacaaatacttttgcctgtcatatgtatttaaaatatcttttcccggctctagtggtttgcctttcactctcttttgatgaattggagatctcactttgaatataatctaacttatcagtctctttctttatggttattgtttcctgtgcctacttaagaaattgttgcctaccctaaggctatgaagctactctgttttaatttatagaagctctatttttttttttttttgccttttagccttttatctttaggttgtaaaaatctacctgtggatgattgttgtttgtggtgtgataaaggcatccgtatttgttttgttttacttatggatatccaataaacccagcaccacttattgaaaaatctcttcatttctactactctgaaatgtcacctttgttatcagtcacatttgtggtctgtctctgtgttttctagtccattccatttttctatttctctaatataatattgataacgcactgtcttaattacgtgagctttataggaggtcttgatattcagtagtgtgcaccctctagtttgttcttatttaagaataacttctaaagaacaaagctggaggcatcactctacctgacttcaaactatactacaaagtgacagtcaccagaacagcatggtattggtacaaaaaacagacacatagaccaatggaacagaatagagatctcagaaataagactgcacatctacaaccatctcatcttccacagacatgacaaaaacaagcaatggggaaaggatttaataaatggtgctgggagacatggctagctatatgcagcaaactgaaactggacctcttccttacaccttatccaaagattaactcaagatggattaaagatgtaaagtaaaaccaaaaactataaaaaccctagaagaaaatctaggcaataccattcaggacataggcacaggcaaagatttcatgacaaaaacatcaaaagcaattgcaacaaaagcaaaaattgagaaatgagatataattaaggagcttctgcatagcaaaagaaactatcatcagagcgaacaggcagcctacagaatgggagagaatttttgcaacctatccacctgacaaagatctaatatccagagtctacaaggaacttaaatttatgagcaaaaaacaacccaattaaaaagtgggcaaaggacttgaacagacacttgtcaaaagaagacatttatgtggccagcaaacatgaaagaaaagattaacatcactgatcattagagaaatgcaaatcaaaaccacagtgagataccatctcacaccagtcagaatggtgattattaaaaattcaagaaacaacatgctggcgaggctgaggagagagagaaatgcttttacattgttggtgggagtgtaaattggatcaaccattgtggaagacagtgtggtgattcctcaaagacctagaggcagaaataccatttgacccagcaatcccattacagggtatcaacctaaaggaatataaatcattctgtgataaagatacatgcatgtatgtgttcattgcagcacttttcatgatagcaaatacatggaatcaacccaaatacccatcaataatagactggataaagaaaatatggtaatatacaccatagactactatgtggccataaaaaggaacgagatcatgtcctttgcagggtcgtggatggagcggaaatccattatccccagcaaacaaacgcaggagcagaaaaccaaacactgcatgttctcactcataagtgggaaccaaacaatgagaacctgtagagagagggaggggaaaaacacctgaggcctgttggggatggggggatggggagagggacagcatcaggaaaaatagctaatacatgctgggcttaatacttaggcgatgggttgataggtgcagcaaaccatcatggcacacgtttacctatgtaacaaacctgcacgtcctgcacatgtaccccagaacttaacataatatataattaaaaagaatagcttcattatttctaaccatttgcattactgtataaattttaaagtcatcttctgatgggattttgattgggattgcattaaatctctagcctaaattgggagtaaattaatgtttttacagtgttggctattttaatccattaatatggaatatcccttcctttatttagatctgtctctcacgtctgtcagcatttttgtatccctctatattgtaaaattattgcacatcttttaaatatatattcctagtatttgaaattattcgatgctattataaataatacctttaaaaatatatcattttctgattgttgctgatatacaaaaaatacaattgagttttatatattgaccttgtattcattgactttgctaaattcactgaatcctaatagttctgtgtattaggttggtgcaaaagtaattgcattcataaattattatgaatttccatgtacacagttaaattacttgtaaaagagttattacttttacctttctaattatcacgacttgtatttgtttttcttgcctgttgtataggctaagacctcaaatataatggtgaatagaagtggtgatagtgagcattcttgtctaatttccaatctcagtgggaaagttttccatgttttactattaaatattattaaatatttctgtaagtgttttacaaataccgtttatcagatcaagcaagcccccttacatttaaaattggccaagagtattttcatgaagaggtgttgaatttgattaaatgccttaaagccataattgcacagaatagcgggctcacctctgtacttcctttttctcttggatcatgatcccatgtgtcctcattgccttgggagctcttctttttataccatatctacctttctagattttcttgagggttggactgttacaagttagatcatcattgtaggaattggtactgtaaattcaaattgtactatttttgtctgccatctacacggtatgagtaaaactgtaaaacccccgagaacctattcaattgttatttctttgatctatattgcttttggctggtaagctttatgaaaagattttcttttgttaaattttgctatcttaagaggaaaagtctaccattgctgctacaaatggaggcattatggagtcattgaaagggtgcaccttatattacatttaaatgccatgttttacatataaacatactgattttacctgttcctttttaaaaaagaaagaaaacaatgaaatcccaaggaataaaactgacattctttaaaaaagaaaaagccaataggagtgcttttcttcttaggtcccctgggaacatgtcatcctcttcatctcttagtcatccacttcttgtgtataaaaattggcaacgcttctctgtcactcccacttcttctctagcagtgatacaatctttcatgcgaaataagagaataataaaatgttatttctgcagtcccaatagtcagtagtattagaaactataatcttggaacccatacttaacaaaatataagccctctcatgtgagaagagagggaagacccaagctctaaatgctgactcattgctaaccaggagggtggcattagaacgcaacttgaccttcccaggtcttagtgccatcctctgaaaaccaaaggcttggacttgttcaagggacagaaaaaattgtaatgtaaagggctaaatagtaaatattttgagttctgtgggccatacagtccctgttacaacaactcaattctgctgttgtggcacagaagtgatcatagacaataagtaaacaaatgggcatttatttataaaagtgtatttatggacacaaactcaaatttcatacaattttcatgtgtcataaaatactgttctttcaacttttttttcaagcatctaaaaatgtaaaaacaattcttagcaaagagatcatataaaaagaggtaacaggcttagatttgtcccatgggcccaagtttaccaacctttgagtcagttaaattgtcaagggctgttccagagctctgtgttaggcattcatatgctagccttttaaaaaatattttttttgtcctatgaacattattcaaaagggtctatttttttcttttagaccaattatgaataagaaaaatacaatatgttgtttttacctttattccttcatcagtgcttgttctttctttttagagatccaagtttctgacctgtataattttcctctgcctgaagaacttctttttgcatttcttgcatagcaggtttgctggtgataaatttcctcagtttttgcttgtctgtgaaagtctttattttttctccacttttgaaggataattgcactagatgtagaattctaagtgggcgtttttttttttttttttttccttcaacattttaagtatttcactccacactctggcttgcatggcttctgtaattcttatcctcattcttctataggtaaggaatctggcttcttttaagatttcctctttgtctttggttttctgcagtttgaatatgatatacctagatgtagtttttctttttttgggtgtttgtcctgattggtgtttactgacttttctggatctgtgatttattgtatgtcattaattttggaaagttctccgtcattattccttctaatatttcttctcctttctttcttctcttcttggaattctgattacatttatgttacagctttttatattgttctatagttcctgaatattctgctctggtttttttcctcccttaattctctctctctttttagtttggaaattcatgattgactttcaagctcatggagtcttaaaaaatttcttaaatttttaatttttatgggtacatatgtgtatacttatggggtacatgagatatcttgatacaggtatgcaatgcataataaccacatcatggaaaatagggtgtccatcccctcaagcatttctcctttgtgttacaatccaattacactcttttagttattttaaaatgtacaattgagttgttgttattgacattagtcaccctcttgtgctatcaaatggtaggtcttactcttcttggccatttgagtctgctgatgagcccatggaaagccttcttcatttgttacagtgtttttgatttttagcatttccttttcaaaggagttttaaaaaaatgtttccttctctctggtttcattaccatttactttctccattagaatccttaacatttttcatcatagttattttaaatttcctatctgttaatgacacagataattccaacatccgtgacatatctgagtctgattctgatgattgcttgtctcttcagaatgtgtttttcttacctttcaccatgcgttgtaattttttgttgaaagccagacatgatgtgttgggtcataggaactgaggtaggtaggcacttagtgtgaggttttacttaatctggctaggagttgggttgtgtttagtgtttgctgagctgtaggtgctagaggcttcaaatccccccaagggtccttgtttttgtctcctctcttgactttaggtttccctaactactattcctcagggacgctgtgtcttggaagtcttttatctgtaatccactgttacacctgagcccggctggtgtggtggtagggcatatgtgagcagtaatgttctattaaccatctaattaagagcaaggatggaataacttccctttggtaaatggtaacgttacaggaaaggggtcccaatccagaccccaagagagggttcttggatctcacgcaagaaataattcggggcaagtccgtagagtaaactgaaagcaagtttattaagaaagtagaggaattaaagaatggctactccatagatagagcagccctgagggcttctggttgcccatttttatggctatttcttgattatatgctaaacaaggggtggattattcttgactcccctttttaggccatatagggtaacttcctgatgttgccatggcatttataaactgtcatggcgctggtgggagtgtagcagtgaggacaaccagaggtcactctaatcaccatcttggttctggtgggtttcagctggcttctttagtacaccctgtttatcagcaaggtctttatgacctgtatcttatgccgacctccagtctcattctgtgacttagaatgcgtaactctctgggaatgcagcccagtaggtctcagcctcattttacccagcccctactcaagatggagttgctctggttcaaattcctctgacagaaaaactttcccccataagaaaaaggaagatggagaacatggtggcttcagtgagggtgtctgaagatgagggacttgccttctgctggcttccatttcttccatgaattttgaagtgagctcatcagctaagactatgtgttaaatatgagctgggaaaagatatgacatagccatctcagaaagggagaaacaagcttggtaggaaaacattttgggtttggcaggcagtgttgactattcatttaatgtttgtggccatgaatttaatgcagctagtcagcctggttgtgtgacttcctctccatcccaaagtgttcatctgtttggatgggagcttggggttggtggatagttgggttccatcagtgttggaatttggtaaggatagtgtgacacagaaagggggtgtattagtgttccctagagggacagaactaatagtgtgtgtgtgtgtgtgtgtgtgtgtgtatattctatttttatatatacaatagtatatatataacagtgtgtgtgtgtatatatatgtaggagtttattaagtattatcttacatgatcacaaggtcccacaagaggctgtctacaagcttgaggaagaaggagagccagtccgagtctcaaaactgaagaacttgtagtcccaagtttgagggcaggaagcatccagcaagggagaaagatgtaggctgggaggctaggtcagtctcaccttttcatgtttctctgactgctttatatttgctggcagctgattagattgtgcccaccagattaagggtgggtctgccttccccagcccacggacttaaatgttaatctcctttggcaacaccctcacagacacacccaggatcaatactttgcatccttcaatctaatcaagttgacactcagtattaaccatcacaaggggagatgcaggagtagagggtatgtgcaagggagtgattatgagtgagtataatgatggagccagtgtgaatagtgaaggtgaagcgaagggtaggaatggatagtaaaagtgctgtgtgttcaatggattaaatgtctaaataagtttgaagattgtttgcagtgaatgcagagtaagtaagtgagctgaacagaggaagggtggacagagtggaggatgcttgtagtgggatttgaggtgatgacaaagtttaggatgtggccatgtgagatagtgactcagaaggaaaaagcttcaggtgaggaaataaggaactgagaaactggcttttctggtaggtctttgactctgatgttaaagtcactgaaagtggtgaaggtgttagggaagcagaagaaaccctctgagaggcggaagctggagtcttcagggaatgagaaggcataagcaggagggaggtgaaaaacagcagtgaggatgagcagaaagtggcagagccagatggcctgagtgccacagagcagggatttgtgttggagggagggagggaaatcatttgaaggagcggtggagagccaggaggctgcctgccctactccctggtcttcagatatatgacgtgaggacagagggctgtaggagaggagaaggcaagtttccattaaggtcacagaaggttaaagttcagagaggagatggaaggacatagtgggcatactatttacagaaatgttgaaagggtgggatgagtctgtggggagtcggaggggttggggtttccagagcagcgtggagttcagagccctggtgagagaggatgactgggtagacctggctttccagcagagattgcagtaacaggactcccagggccagcatgccctgttacatggctatctttccacttctccctcctagcttaatttttagaaactttaacagatggaatgcaaaatttttatttttatttttacttcagagatcagtcctcaccctgtcgccctggctggagtgcagtggtgtgatcatagctcagtgtagcctccaactcctgggctcaagtgatcctcccacatcagcctcccgagtagctgagactacaggcaacgcaccaccatgcctggctaatttttgtatttttttgtagagattgggtcttgctatgttgcccaggctggtcttgaactcccaggtttaagcaatcctcatgcatgcatatatatatatatatgcagctttgataatttaattagtttagcctgtcaggcagctgtgatagtgtagagaacgttgtatttatttgtaagtcttaaggtaggattggaatggagaagtcaacttcactgaaaactagcaagtagaatgaaggaaacacagattagttgaggacctactatgttccaggctttgtgccaaacatctactttatgtaggtgatttcacaagatggacatgttggaaaaactgtgggcattggaatcagtcctgggtttgaattttagttgcttggctgacaaactgtgttactttgggcaagttacctgtgctcttcagtcttacttttctcatccatagcgtgggaataataacatccacctgttgtggttgctgtaatgagctgtgcaagaaattctaatcagcaggccgggctgagaaccactgctgcagagtgattagcatttgttccattttataggtgaagaaactaaggcccagtggggctaaatatgttgcttacggccacacagcacttaaatgatatagccaggattgaaagccagttttttttgaccccagaaccttgttgtatccatttcattgagtttttgccttaatacatgggaagctaaaggagcccccccattagcatgtctgcccaaacatcaggcagcatgggatgggaggaagggatcaagtgaagggaaggcaggctccatggaatctaggtcagcggtttccaaacctggctgtacttacaaatcatctggaaaatggttaatctgtaaatctccagggaccaccctaggcctattggatcagaacttctggagcatgggaaccgggagtatgtatatttagaatatctcccaggttattctgagactgctagcctagttccggtccttgggcaagtttttgggaaccactgaattctaatcgatgtcctaaaatgattaagtgattatatcccagtaaaatactgggtgtcttccagtgccaccaaaattggcctttaggggttgagtgctattgccgtactttaagatcttggtgcattacctgaaacggacactctgtctgtcattgaacatttgaacttcgaatatataggaaatgtcaagttggcatactctgctataacaggaagagtgatttgttatttagagctgttgttcttccttctttccccttgggattcctgcccactcagtcagattagagctatataaacaagctcgtactactgagctagcacacatcttgtaaattttttttcctgaagtgcttaacgttgctgatgtcagaaaaaaaaaatccattgggttttaatgggctgaggcaaacaatgagaatttgatataatatggaggagaggaaataacttcaacagaaattcttatttggcagcataaatattcaaactatattacagtcagagtttgattgcttctcctacatggcatttccctgaatagggttttgagggctgggcactaagagtggcaggcatgatgtttaaagcatttagttgcaagccatggtaatttcagtgacattgtagggtaattgtagttggttctcctcttagctctgtgtcaggatcacctgaggaggttgttggaccgctgaaggcttcatctctgatgcacgagtcagaacatctgagggtgggggttggggtgggattctccattgaatctgatgccagtggcctgggaatttcacttggccaaaccctggcttagaacaaggtcactggtcagtttcgatattcattctgtgctggggcatttccatgacttagtgtcttccctcttcaaaagcaaccctgcgtgatggaggggtctcatcttccaggcaaggagctggaaacgtagggtgggagagcccattgtcaaaggccacatagtagccttaatgaggctagagctgagatgtgattcccagtctgacttcaaagcccttccttttcctataccatcgaggcccttccttcctgctctgctcaacattgttagctgccgaaccctaggctttgcttgttccagaggggctggcattataaagtaaacagcaggcatttattgtaactgcaagttacagatgcagtgtcagtttggagtagacttgcaggcacaatcctgactttcaatgattcacgaatctgtttgtgtcacaggtgctcaattgtcctattatgcatagagcatccccttcactatattttcttccctcaccacatattccttcttacctaaattgcttatgaattccagaagtggattgctgagtccaggctggttcatatcaataaaccttggggaaaatctttatgtgtgatgctatacatgggtctttgttgatcaagagtcttctttattggccacttttaatggcttgttatccagatgaatcttctggaaggaggacactgcatcctggtggaattttatcagttccatcattcattcaaacatatttaagtaccttctatgtgccaggttctgctctaggtgccagggagagaggggtgaaccccaacgataaagtccctgcctatgaagaactgactttctagagaggaagtccctgatagacaagtaaacaaagtcccgcagattcagatagttgcgaatccctgttatctcactctccacacttggctgtctcccacttaatctttctgggatcagattatctttgtggcttttttctcttgactgtctagcacaaagctgagccgcttctggggcttcagatttctatgcctgtgtgtgtgcatagccttggctggaatggcaaactttgcctctcccaggcttctgctcatctgtcacctcctcctactctgtgccatcataattgagcaaccacatattacagtgtcctttctgtgaacacatctgttattcctaccggtctctgaacattttaaggagaggatctgtgtctgacttatctgtatatccccagggcctagcatggaaccttacaaaagtagatgctcagtatatttgctcaaagaataaatgatgagttccaaagaacctgagggtgggtggtgtggtataggaattccgtcatggggagggatgctgagtcagatgggggatgctccaccgcagtggttttgtgatttattctttgagacattgagtgctgtcatgaatagaggagatgggctgggatataggcagtattgacagagacacgtggcatggaacattctggtgagaacctttgaaggaaagttagaaatgtgaggttctgagggtctagctcagagctggaaggaactctaaggttgctggattttatagccaatgcccaactgaggtccagggaagctgtgtgtcctggttctgatagttggttagttgcaaaggagctaggggtggggtgataccaggactcctagttcagagggctttccactatgctggggctatggtgtgtgacagataacagattaaaggcacagagaggagaaggaacttgcctaagatcacacagctaggaagtggtggagcctggatttggacatggatctgtctaatgagaggcatcttgtaaccatcaagctgtattgtctcttcttgaagactgtgaaatgcaaggtcctagcccattttcagttttcctcttgggttagctgtgagtccatataggaaaataatattaacatgctttctttcttttggtatgcagttacatgttttcagaaaaatgttcacattcttcaaatgttaatattgaagcccctgggttgtttactgtgtgtatatatatgtatatataagtacaatgaagaacattctgtttttctctaccactaaatttaaacccatttctattgtactccatttaaaagaagtattttacatcatactataatgaatgaaaacctagtcctttaatttcacaagccccagctttaatagtcaatgaatttaattagaaaatctttacctatgtaggtttcacatccagttctctataacatctgttgacctatggactagaaagtatattattattttagaaatgattctttctagacacaggaaagctaaatagcttgtctgagtttcaaaacgagttaatagaggaaccaaaaatagaaacatttctactgaatacgaggcttactaaaattcttcacacagagactatctgcattcacttagtagtttccagtctagactctggaacatcagcctgttttaacacacacaaatgcttctgttggtgggagggggtggctgggcagagggaggccgggcagagggaggcctgacacgtttgtttctaggtcatttctaaccttgctattataatacagttttctagatagaagagaatgtgctcattaaagtgttcattttaaaataaagcgacagaaacttaaaacgtctctattacatggatacatgagtatatataaatgaactcaatttttgttttcatgctctgttgtattctgtattaaggcaaaggagtaggcaactaagtagttgtttaaaaataaaactgtgtgttgttcatttaattttaaaagccattggttagaatggtaatcagtgtttccatgtagtactatattcatagaaatcctgatattacagtgtatagagataatattatagaatgatgctctttacctctttatgtaatctaattttaaaaaacattgtaatttataaatagtgaagaaagcaggtagtgttattcgaatgggatattttcggcaattaaattcttagcataaattacaaattcctctctctcccattttccacccaaatttgtttttatggaatgacctttggtagcaacttgttttataataaaatgtttcctgaatttgtattttgaattgaaatggccttttctgtcacgtatggtatttataagagtttctttgatgaaaagcctctgaattttgtgcaaataacccaggcagcctcttagatgagggataacatttgtataggacttttatggctttatactctgctctcatactcagcttatttgacccttacctgcggggaacttggtggaattcacattttactgctgaggacaatgtagaggaaggtgccttggcatgactcagagcatatagcaggtgtttggtatgtttgttttaaagggaaattaacaaaagaaacccaaaagattcttgtacttgctcaaggtcacacaataaatatagtgtcataccaaggattgaacttccttcttcactcaaaacttccatatacttgttcttatctcactgttatcttttcaggcttttcaaaaaggccacattaaatatatttatttttcttaattgaggtgaaattcacataacacaaaattagccatcttaaagtgtataattcagtggcatttcatgctttcacagtgttctacagccatcacctctatcaaggcccctgaaggagaccctgtatccattaagcagtcacccattccatcctccctgcagctactggcagctaccaatctgtttcttgtctctgtggacttacctattctggatatttcataaaaatagactccagcaatatgtgacgttttgtgtctggctttttacacttagcgtgttttcacttagcatgttttcaaggttcatccacgttgtagtgtgtgtcagtactttatttctttttattgctcaatgatatcccattgtatggatatacacgttttatttatccattcatgcactgatagacatttgggttgtttcccccttttaactattgtgaatagtgctgctatgaacatttgtgtacaagtatttgatatttgttttcagttagtttgtgtatgtacttagaagtggaattgctagatcatatggtaattctgtgttcaacttttttgaggaaacactaagctgttttcagcagtgactgtgtcattttacattcctaccagcaatgtttgaggattttgatttccctgtatccttgccaagacttacttgaggttttttttttttaaattataataatcttaatgggtatgaagtggtatctccttgtggtctggattttgatttccctaataaaatattcatattttaatgcatagaattaatcagaaaatgagctttggcaaggtgaactcaacagcaaaatgattggcttcaactgtcttcaggagattatttaagactgccgtggctgggtgcggtggcgcacgcctgtaatgccagcagtttgggaggctgaggctggtgcatcacctaacgtcagaagtttgtgaccagcctgaccaacatggagaaaccctgtctctactaaaaatacaaaaatagctgggtgtggtggcacatgcctgtaatgccagctactcgggaggctgaggcaggagaatcacttaaacccgggaggcggaggtttcagagagctgagatcgcgtcattgcactctagcctgggcaataagagcgaaactctgtctcaaaaaaaaacaaaacaaaacactgctgtatattcactcctggggtgtgcgattctgagctgaaaatcaataacatgttgtttggggattagaagaatatttgtggatagtaagactgcaatcatcccctaactttaaaaaatgtatcatgtaatatcatgtttttgttcatggcatctgccaaaagttacttaattctttgcatttcaaagccctctttatataattccttcgtgacttaatggtttattcatttatttttgcagtgtgagtgaagacactcaggatggctcaaggatccggggatcaaagagcagtgggggttgctgacccagaggagagttctccaaacatgatcgtttactgcaaagtaaggcgcctggtcaagtgccgtgcgtgctgtccgtgtggactgttgtgttctgtgtagggctgataaaaagacaaatgttttctgcctaaactgccttactgataaatgcatattttcttctcacatcctctggttctctagttctaaaattcaaggaagttcatacttgagcacttggtatttaacacttgaaaaatattatgccatttagttttctttaaacccaaaggttgcctaagcaatgcagatgggaagacacattctccttcagtggaaaggccttagtgtaagatgtatgaactgaaagttcttcagactcgtagtatgtacaaaatctgggctgaatgctgtgggagatagagaggtatatttgtatgagatgcttacagttggtaggagacataagatgtacacaaataactgttatagagtctaaatgttaatttccaaaatagatgtgcaagtagagtgttacataatttcagaggaggaggccagttctcccagcctcagaggtgagaatgggcttgtggaagagtggtctttgaactcagttttaaaatatgtgcaggattgctttatgtggaaagcagagaggaagaacataccaggtgatgagatgtttcagcaagggcacagagctgaggaaagtaacagcaaccggaactggttagcttggacataggatgcattacaaggagtaaatggagataggattttgggaagagaggctggctggagccagatgttagtgttgaattagacaatttaatcaagaaaaacttctgtgccaagagttgcaagattgagatctctttgggattatgactgttgccccattgtgctgaatggattgttatcaagatagagcggaggctctaggagagagatttctgtgtctgtgtgaaaggtaaggagggaaaggagagacactaatccagcctgtgaaatcaccttcagaattaagagaaactgataagaggaattaaagtctggattaaaaatgacttggaaactgaaggaatataggcggcaagtagagggtcaaagatgacggggtttttgacgttgggtaaatgaaaatcattggtgctattaattcaaattgggatatttggaaaaagaatacattttaaaggaagaaaatggcacataagtttattttagtacatgctgaatttgacataattgcttcttattgtacacctttttgatgtttgcatgtttgtgaaaatttaaactaactctcttgtatgttaataaggaaataagttaatgttcatttcactaactacttgagtttctactcagttctgtgcattctgagaggctctgtgtattacttatatgggcaatgtggaactagatattcctggatgatcaatatggtgaatttttctcttttccttgtaaaaatagagttctcaaattattctggctttgagtgtaagattctgtaattctttgctttgcaagagaatgtctagataacccatctctaagaatcatgcttattaaattgcgataaagaaaaaaataggttaatgggactcagcaattagtgaaacatacagaataatagacattgagtcattgttactttcttaacccacccccaaactgggagaccccgtgccaggctggtaggaacatgggctttggagtgagacttaggttaaaatgccaactttaccactctttagcagtatgactgtaagttagttctttaacttccatgagccacaattttttcatctgtaaaaagaaaaaaaaatgtgggaggaaggtaattgtgaagatcactttagataaatcgaatgaggcatcttatatcctacttagaccacaatgtggtccgtaatgaatatctctttttcttttcatgtttaggtcttgtagagtcagtgacacttggagaggaaataaatgataaaatctctaaatgttggtgctgttaataagttgtctagagcaaatttatacagtgagtttttttttaagacacaggaaaacaataaaaatatttttatattcttcagaggattgcaaattcatggattattaaagaataagaaatgcaaaggtcatgtaacccaaccacctttctactagaatgtttgtattatgtttacaggaaaaaaaaacttcctgcaggtttatgagaacttggtttttactttttggtggtagtaaggggcccttttctggtttaatttagtaactaacatgtcaattgctgtagttctttagagaaatgacaactagtaatgaaactatatcttactttcgtgtgacaaacttgtgtaaagagtatatatatatatatatatatgttcatgtttatttgctatattaattaccataaaagggacattgaattggttcagtctgttagaaagaagacacacttattgcacagtgtgagctcaggtcctgacaccattttaaacctagttaacctgactgacttaaaccatggttgtacttgaactatgggattttcatatagttttctactcctgatgctgtaggctgccttttggctacaaccaagaacttacttgctgtaggacattatcctcaaggtatcatcagtaagggttggattgtgaagccaatgacaattcaaagcattttctttggaagtccttttgtgtaatcaattattcaaagtcatagccataaacccaaacctttccttagatacccacgactacaatttacatttaaaaaattgtgctttcatttttgttttctttctcttgtttgttgttgttgttttttttctcttgttgtcagacactttcagtgtgaaatttttgcttggactgcattgtgttgattcagatgctgacatttaaaaagccaaatctagagaaatgaagcttttgggtaaactttcgagtaataagtggatgattatgtccataatgttgttgtgacttttaaatgacatttaggatggtaacctcctgacatatgagtaatgatgggtgggtttttaaagcccacacttttcagaacactcttcatttccttttcatgttttcatgtcattaactgtgagaagttgtactttcccaaggcatgacttatttattgacttgaacagactttctaatttagtttttcatccctcatattcacagtttggattggaggtgtgtatgaaaaatgtattggtcacattaaagatctatttaaaagaaaaccttaattattcatgaagacacccagacctgttaaccttttttatattcctgtatccttaggatcctgagttactgaattgcccagtgtaatgatgatatttgaacctagctatacatcacatcatttagggtgctttataaaaatgttaatcctcaaaggaccccctccacaaggtatttctatttaataggtctgagctgggtcctaggaatctgagtttcaagatgttctcaggaaaatctgatgcccaactaagtttgaaaagcacttacttagtcttttacaatatccagacatagtatgtgttgcaaagtaatgagagagttggtgttttgaattagatttttgatttcataattatttgtagatctctcaaaacgtagaagaaccaagctcttgtcatagggattttagtagcttttccttagatattttctagtcttattttatagatgaaagaactaaaagtatagagagggtgagtaacttgattaaggctcctcagcactttcccatggaagccataatggtgtccagggagcctggccactccaatcagttgcctttctagcaccctatgcgactaccatgttatcaaccacagactactgttaccacattgttggagctgagtagccatggggcacattaaattaatgaaaataatatgtggcagatctttgactttcatgtttcttctgggagagttgacttggattaatgtctcacttttttattgatttttaaaaaatactttaagttctagggtacatgtgcacaacgtgcaggtttgttacatatgtatacatgtgccatgttggtgtgctgcacccattaactctcatttacattaggcatgtctcctaatgctttccctccccactcctgccaccccacgacaggccccagtgtgtgatgttccccttcctgtgtccaagtgttctcattgttcaattcccacctgtgagtgagaagatgcagtgtttggttttttgttcttgcaatagtttgctgagaatgatggtttccagcttcatccatgtccctacaaaggacacgaactcatccttttttatggctgcatagtattccatggtgtatatgtgccacattttcttaatccagtatatcattgatggaatgtctcacatttttaatgctaaagtttcattctactcattggtgcttttgcttcttcggtaaagattttctaaaatgtttacataggtaagattgcttttgagtaagagtaggttgctttctgattttgtttggatctttggtgttaacaatgcctcttgacaaagttctcctaactagactggtaatttgatttgtttgggtcaggaggcatggaagacatcacactctggatgtcttctacatccagaaggatggaggcatggcagatgtcacactctggatgtcttctacatccaaaagctggaggctctgcctgtctggtcccagctttgtgtggagaacttcactttcctgattctacttcttgttttgttttctaccttcttcattcttttcctccttccttttcaattgtgagatacttctaacacaaaaagaatatattcagtgtccatgtaaagtagaaagaattaaaaaatgaattatatgcactcaccattagcttaataaataaaatgtaatactttggcctcatttccccttctgtaaagggaggaaattggtctaaaaatgtacaaatacctttctgcaatgatttcaaagttccattctataactttttgatctttcgtaaattagtacacttccctgatatcaaaacaatgttgtgagactatatgcacgtttaaaggtcttttgagcttttgaagaaatattttagatagttgtaggtaatctaaattggattgagataaagcccagttaagtcaggcattagaataaaaagctttaattgtaattatttaatattcaacagtggaatttagatgacatcttggtggcaacctgtttctttggcttgctaataacatttaagacatttataaaattatcattttgtagtattaattatatgctatatacataacaagtggtgtttaagtagcaacactgtacattgccagtagtatatagtgtcatagatgaaataggggttttagaggaagacaaaaaaggccaatgttcttgtatatcaacaggttagttgcctagcctcgtcactgatggcttccttcacctattcatttctagttattgactccttttctgctggaatttgagtctagcctttatgttgctctgataccccaaggtcactcttcctaatgatttagggcccttgaagtcctgggcagttgttggtttaggcatacatccagaaagtaaatgtcacactattttagttacattggctgtggtatgcagcaagaagggaaggatctagcctggaagaatccgatgctatggaggaagctagggatagagtgtggtttggaattcatagagggcagtggtagaagccagcacaattgagagtctggggacctgcaggtcctggtgactaaggcatgatgaggattagaaactgtcgaatcaggaaatacgtattgagtgtcatttgtgtgccagacactattagatgctaggaatgcaagatgagaactgagccctgaatgagcccacaggccagctgggggtaaatggggaactagacaattacagtgttggtagaagcaactgaggggcatgggaggaggtagaggggtcatgtagtccatcccaggagaggggatgatgatgtagaagacatccagaggatttggcacctgcttcgattcttgaaagatgactaggaattaaccagatggaggaggagagagaaggtgtaggaggcaggactagcacctgtaaaagagcagatttgtgatgtcgtataccgagttcaggagactttaagtggttgatatgaagctaggtttctgtgatgaaaggttgaggaatagagctagacagatggattagggccagatcacaaaagaccttatgtaccatgccaaggagtttagacattgtaaaagtatcttccctttgggcctccacacccaagttcaactcctttgcatgctgctgtctgccccagaggctgagctgtgaggactacatttacagggctcctgtgacctctgggtttcagttgggtttggttagtaaaagtctggaaagagatgggagggaaggagaatcgcaatgtcagagaatttcttctcctgggtctcactctgcaaaaccttgcactggccatatccgtctactgaagtttgttgattctctcaaggcagactactttcctcttctgggtccggacatcctttttgtctactcatccttttgggcctttgccgactactttcctcttctgggtccggacatccttttcatctactcatccttttgggccttggggtggttccagtttgtatttgttatctcttgctgtgtaacgagttatctcaaaactcaatggcttgaaaacatttattatgtcacaatttctatgggttagtaatccaagtgcagattccgtgagttctccagcacagtgtctttttaaaaggctgtgatcaagatgttgactcggattatggtttcgtctgaagtctcagctggggaaaagtctactcccaaacttacttgtgtgactgttggctggattcagctccttaggggccgttggaatggtggactcggttcttcgttggctgtttgccagaggccattcttagttatttatgacacgtgtctctccatatcgcagctcataatatggcaggttttttttttttttttttttttttttttatcagagtgacaacaggcagagaaggaagatgggtggtagtagtcttagtgttttataacctaattttggacatttttttctttattatactttaagttctagggtacatgtgcacaacgtgcaggtttgttacataggtatacatgtgccatgttgttttgctgtacccatcaacttgtcatttacattaggtatttctcctaatgctatccctcccccagcccaattttggacatattatcccatcccttttgatagtaagaagtcactaggtccacccctcactcaaggtgagggatttacacaaagatgtgaataccaagatccagaattcagaaaatctttgtgggccattttggaagccatctaccacacagctctacttctactagccaggggtttctgagtgttttttttttataatttccctgtaccctagaactcctttaaacttggtccttttggaaatacattttccttaaattgtcctatgtatatcatctgtttaccaataagaccctaacgaatgcaagtattatcccacaagcaaagggaagcgattgagactctgcgtttcttgataagggaattcttcatgaaagggtttgaagcaggggagtcatttgtccaaagtggaggatgggatctgaaatggggaagtcaatgtggagaagattcagtgtggaggtcaatgggtgatcgatgtggaagggttcggtgtggagggagagtgttggagaagtggtaggattggaggtaggaggacagtttagagattgaacaggaatccaggtgaggaaaaatgatgcccaaatcagtggcagtggtaatacagatgggaggatgtgtttgagagatgtttaggaggttcaggcaacagaatttgggggctgagaagacgtagggagaatttgagaataatgaggaggaatgaggagtcttttccctaggctatatctgtgattctcagaaagtctcctgggataaacttttgaagcaaatagctgtagaactggattgcctgcccctctcttccctgtatgtagataaattgagagagcccaagacagagtctgtaaatggaccaggatatctgggtatttgttctggctgccccactccactagctcatttatggccatgcgtaagttgttcctactttttgttaagtctagttctttaatttgtgaagtaaggggttagctatgctgggtgatctctaaagcatttttttagatctaacattctaggtcttttgtaatctaaaatagagaaacccacattttattattttactacttcatagcctcctttactttatttttaattttctttaaaaagtgaaccgagccaaaactttaaaaacaggtaagtcagaatgtttaaaacaaatggcttttggtcttcagcacttagggcttgttttttttcactctttttttttttttaacattaaataaaattcctggccacatgcagtggctcatgcctgtaatcccagcactttggaaggccaaggcaggcagatcacctgagatcaggagtctgagatcagcttggccaacatggcaaaaccctgtctctactaaaaatacaaaaattggccaggcatggtggcacacgcctgtaatcccagctacttgggaggctgaggcaggagaatcacttgagcctgggaggcagaagctacagtgagcagagatggtgccaccgcactccagcctgggtgacagagtgagactctgtctcaaggactaacttcagaaagtgttcagggtaactaatttaattgttcagtctacattttaagattcctttcattaaattttttgaagctttttttattgccttaggaaaaaactgttctgttttccttttcccccaggattagacttgctggaagaaaagctcccccatcacattatcttggttggcaggagacaggcatgcaggcaagtcccagaccagtggtatcagtgtccacagatgaaagggatggtatttttagtgtggggaatagctcagtgtggtttcatatgatgcattttgatgagtataactttctaatttgaaaagcctttggtgtgtttacgtcttcatttaatctttccaatttctccccctcatttcatttcaaggagtctaagatttttcattttggcaggcagttgatcactcttgttattgacactcctttgcagtattcttacactgtggagaacctgaatggctgtaaattccctattggcaggattttggagaaaaaaaaataaaagcgaatagatacctgtgaaagaaaaaataaatacattttaaaataattggaggatagaaggattacttttaaaagttctgttagtttgccagtacagagcaaaacagaaaatggacacatttttttgatcagcattctctgttctaaaaacttatttcaataagggaaagaatatgcaaagacatatatatagatatagacatacacccactccaaaagaatagtgatatctttctggtaaataatatccaaagtttggaaagaaatcaaatatccattgaaaggaaactaattttagggggataggattcacatttggaatgatctcatagttagtttactggatttctgttctggtcaacctaataattgtcttgaaagtgagatggctactgacattctagggtatggttagggagaatattctttatttttaaaaccctacaagattttttcattttttaaaataaaatgtcttatttgttaaatatgatggttatgtaggtttactcaaaagtgattttttccattgctctttattattttctgcatctctgtgcttacagctgaaataatttttagtattttctttagtgcaggtctgctgaagataaattctctcagttcttgtttgtctaaaatatctttgggccaggcacgttggcttacgcctgtaatcccagcacttgggaggccgaggcaggaagatcacttggcccaagagtttgaggccagtctgggtaacatagggagacaacatctctacaaaaagaaagaaataaaataaaaaaaaattagctgtgcatgttagtacatgcctgtagtcccagctactcaggaggtggaggtgggggaatcacttgagcctgggaggtcaaggctgcagtgggccatgattgtgccaccacactctagcctgggcaacagagtgaggcatggtttcaaagacaaaaagaaagtctttgtttcatcttcattttgtgaagggtgttttttctagatttagaattctagattgtcggttattttatttatcataactgtcattgtctcttggctttcattgtttctgttgggcagttggctgtaagtttgattattcctccttcgaatgtaatctgttttttcctttggctgcttttaagatttatttcactttggttttagcagttttattataaggtgtgattttctttttaatttattctccttagagcttatgagacttctttttatttggttggtgcttggggattctttttttttttgatggaggcttgctctgtcacccaggctggagtgcagtggtgcaaccttggctcactgcagctgccacctcctggaatcaagtgattctcctgccccaacctcccgagtagctgggactagaggtgcgtgccaccacgcccaaataatttttgtatttttagtacagtcggggtttcaccatgttgaccaggatggtctcgatctcttgacctcgtgatcctcccacctcagcctcccaaagtgctgggattataggcatgagccaccatgcccgactgtgcttgggaattcttaaccattaacttttcaaatattgtttatgcctagttttctcatttctctcttcttgggattgtgttcatatgttaggacctttttcctctagatttcatgtgtttcttatgctcttttctgtattttttattcctttgtcattttgtgcttcaacatggatattttctaccgacttatcctccagttcactaattctctcttcaatatattagataatctgtggttaaagtcatcccattgaatttgtaaccttagttattgattttttaagttctaaaattttcatttaattttctttttatagtttctagttttctgctaaacttctctattttgtcatttaattcctaaacttattaatcataattgtttcaaagtccatatctgatactttaaagtctttatcacttgctggactgtttctactaaccttttctttcttttttttcttttttttttgttcttctgtttatttattttattttttattttttttaattattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccacaacagtccccagagtgtgatgttccccttcctgtgtccatgtgatctcattgttcagttcccacctatgagtgagaatatgcggtgtttggttttttgttcttgcgatagtttactgagaatgatgatttccagtttcatccatgtccctacaaaggacgtgaactcattcttttttatggctgcatagtagtccatggtgtatatgtgccacattttcttaatccagtctatcattgttggacatttgagttggttccaagtctttgctcttctgaataatgccgcaataaacatacatgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacagtgtaaaagtgttcctatttctccacatcctctccaacacctgttgtttcctgactttttaatgattgccattctaactggtgtgagatggtatctcattgtggttttgatttgcatttctctgatggccagtgatgatgagcattttttcatgtgtcttttggctgcataaatgtcgtcttttgagaagtgtctgttcatgtccttcgtccactttttgatggggtggtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgacctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttctccattgcttgtttttctcaggtttgtcaaagatcagatagttgtagatatgtggcattatttctgagggctctgttctgttccgttgatctatatctctgttttggtaccagtaccatgctgttttggttactgtagccttgtagtatagtttgaagtcaggtagtgtgatgcctccagcttcgttcttttggcttaggattgccttggcgatgcgggctcttttttggttccatatgaactttaaagtagttttttccaattctgtgaagaaaggcattggtagcttgatggggatggcattgaatctataaattaccttgggcagtatggccattttcacgatattgattctccctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatggagttcactcatgatttggctctctgtttgtctgttgttggtgtataagaatgcttgtgatttttgtacattgattttgtatcctgagactttgctgaagttgcttatcagcttaaagagattttgggctgagacaatggggttttctagatatacaatcatgtcgtctgcaaacagggacaatttgacttcctcttttcctaattgaataccctttatttccttctcctacctaattgccctggccagaacttccaacactatgttgaataggagtggtgagagagggcatccctgtcttgtgccagttttcaaagggaatgctgccagtttttgcccattcagtatgatattagctgtgggtttgtcatagatagctcttattattttgaaatacgtcccatcaatacctaatttattgagagtttttagcatgaagggttgttgaattttgtcaaaggccttttctgcatctattgagattatcatgcggtttttgtctttggttctgtttatatgctggattacatttactgatttgcatatattgaaccagccttgcatcccagggatgaagcccacttgatcatggtggataagctttttgatgtgctgctggattcgttttgccagtattttattgaggatttttgcatcaatgttcatcaaggatattggtctaatattctctttttatgttgtgtctctgccaggctttggtatcagggtgacgctggcctcataaaatgagttagggaggattccctcttttcctattgattggaatagtttcagaaggaatggtaccagctcctccttgtacctctggtagaattccgctgtgaatccatctggtcctggactctttttggttggtaagctattgattattgccacaatttcagatcctgttattggtctattcagagattcaacttcttcctggtttagtcttaggagagtgtatgtgtcgaggaatttatccatttcttctagactttctagtttatttgcgtagaggtgtttatagtattctctgatggtagtttgtatttctgtgggatcggtggtgatatcccctttatcattttttattgtgtctatttgattcttctctctttttttctttattagtcttgctagcggtctatctattttgttgatcctttcaaaaaaccagctcctggattcattaattttttgaagggttttttgtgtctctatttccttcatttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttgaaagaacatctttatttctgccttcatttcgttatgtacccagtagtcattcaggagcaggttgttcagtttccatgtagttgagtggatttgagtgagattcttaatcctgagttctagtttgattgcactgtggtctgagagatagtttgttataatttctgttcttttacatttgctgaagagagctttacttccaagtatgtggtcaattttggaataggtgtgatgtgctgaaaaaaatgtatattctgttgatttggggtggagagttctgtagatgtctattaggtctgcttggtgcagagctgagttcaattcctgggtatccttgtggactttctatctcattgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatctgagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggtatgattttgcagcggctggtaccggttgttcttttccatgtttagcacttccttcaggagctcttttagggcaggcctggtggtgacaaaatctctcagcatttgcttgtctgtaaagtattttatttctccttcacttatgaagcttagtttggctggatatgaaattctggattgaaaattcttttctttaagaatgttgaatattggcccccactctcttctggcttgtagggtttctgctgagagatccggtgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaaagttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcacttcatttcattcatttcatcttccattgctgataccctttcttccagttgatcgcatcggctcctgaggcttctgcattcttcacatagttgtcgagccttggttttcagctccatcagctcctttaagcacttctctgtattgattattctagttatacattcttctaaatttttttcaaagttttcaacttctttgcctttggtttgaatgtcctcccgtagctcagagtaatttgatcgtctgaagccttcttctctcagctcatcaaagtcattctccgtccagctttgttccgttgctggtgaggaactgcttccctttggaggaggagaggcgctctgctttttagagtttcccgtttttctattctgttttttccccatctttgtggttttatctgcttttggtgtttgatgatggtgatgtacagatgtttttggtgtgggtgtcctttctgtttgttagttttccttctaacagacaggaccctcagctgcaggtctgttggaatacccggccgtgtgaggtgtcagtgtgcccctgctggggggtgcctcccagttaggccgctcgggggtgcctcccagttaggctgctcgggggtcaggggtcagggacctacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggtgggcacccctcccccagcctcgttgccgccttgcagtttgatctcagactgctgtgctagccatcagcgagactccgtgggcgtaggaccctccgagccaggtgtgggatataatctcgtggtgcgccgttttttaagcccgtcggaaaagcgcagtattcgggtgggagtgacccgattttccaggtgccctccgtcacccctttctttgactaggaaagggaactccctgaccccttgcgcttcccgagtgaggcaacgcctcgccctgcttcggctggcgcatggtgcgtgcacccactgacctgcgcccagtgtctggcactccctagtgagatgaacccggtacctcagatggaaatgcagaaatcacccgtcttctgcgtcgctcaggctgggagctgtagactggagctgttcctatttggccatcttggctcctccctccttctgtttattttttattaagttctgggcattatacaaataatatagaagacatcatttacggctctaggacaatgttacgttacttctgagagaacttaactatttttttcttttatgtcagtcaaaataggaatggattaccttaatcaagtcagacacaaagattacttgtagctggacttcagttcttcttagggctagatatatttctagatctcctttactctctgtagggagcccttctggttccaaccaaaaccctgggtgcccctcctccttggaggactctgacctctaatttttgtcctttaaactctatgacactgccaaaagctctgttcagcttcttgatcatgccttttgtttaagaaattgacaatgctcttgagaagaacaagcagctccaattgctgggctcatcttcttagttttcttctttcaggtcatggcctcacaaactcttactgtcttggttgcttttcagtgccctcaaacatgtttaacaaaatgtttttcagcatttccagttgctctcatcaggagggtgtttctgaaacatctagttagccattgtcagaagtagaaccccagaacattggccttgagagaaggtggatccatcttttatagccttggtttgctcttaaaatgttttagaaaagacatatcctgagtgtcttagtggtctagcgtgatggtggtagaggtgaagaaaagtgaaacttccagtatatttaaaaagtggaattaacccgttattagttttagatggagatgagagaggaggattcagggctaatggccaggatctggactgggcatctggatgtccagtcactaggataagtggttgggttagtgacactggagcctcaagtcaccacagtaacagaatgacattcaccacagcctagttatgtaaaactctggacagagggaataaatccaggcaaatacctctacgtatgaaatggacctgaaaagaagctttacctggaggaaaccttacctgactccagagacctttttggtttagaaaacaggaagtaacttgtatctgtcagtatgacacttttgaacatttctgtattagtttgctaaggtgctgtaacaaagtcccacaaactatggcttaagacaacaggaatatattctgtcacagttcaggaggatagaaatctgaaatcaaggactgggcagggctacgctccatttgaaggcttagggaagtcccctttcttgcctcttccaggctttctgtggctgctggagatccttggtgttccttggcttgcagcagcatcaccctggtcttcgcctttgtcctacctcaccttcctcatgtgcctacctctgtgtttcacatggccttataaggacactagttgtgggatttaggcctacatccccatacccccaattgattgtgacctcatcttaatgaattacatctcaaagaccctaatttccaaatgaacttacatacgcaagtcccagggtttaggactacaaaatatctttttgacagacacaactcaatccacaacaatttctagtttatcaccgcgtgaagcttagtgctctctgcaaagatcaaatgaacaagtagtgtacttattgagctgttgcttctgacaaagcactgtgtggggaataaaaagtagcgtggcacacagtctctgtcctagacaactttactgtccaactggggagaccaagagtgatgcagaactcaggaggaaaataagctttggttggccacctaccatttaccagatactgcagtgggggctatacatatattgagccatttaatcatcagaatagcttgctaggtaagtggtattcaccctatattacagataagggaactgagggtcagaaggagtaaataactagtattaagtggtgctatcagaatttgaatctagatttgttgtattctaaagcctgtggttttggggaagaaactgaattatgttaaaaaaaaaaaaaaaaaaaaaaaacaaagctgttagaaattaaccataagagagttagtgtgagagctgggtgtggtggcttgcatctgtagtcctagctactgaggaggctgagatgggaggatcccttgagcccaggagtttgagaccagcccgtgcaatatagtgagaccctgtctcaaaaagaaaaaaaaaaagttggtgtggacaaggaaggcttattgaggaagaagaaatttgaagagaaatcatctgaactgtgtttttaagaaagggtaggagttggctggtggaaaagagccaaaaactgattccaggtgatgggagctacgtgaaccaaggcaaggggatagaatatatcagatgtatttaggagaaaatatattttataacactatatataagatacgtgctttatataattatagcctcattcttcatatggagaccttgaagtaagaaaacaaacatttttagctctgtgtctcacatggtaaggtattggtaaagctgagccttctgccaatgaattttttttccattcctcttcagaaataatcgctttccatttaaaaagtaataattcaatttagaaagaatcaaaatataaagtagagaaaaaatctcacatattcctatcatgcaaatatgactaaagttaacattttggtctcttcctcccagtccttgaatatgtatcagtagtatacataacacattaacctagagagtaatcatagtgtatgtgctattttgtgcttttctaccataacctaagcactaatctgtgccataatatgtcatcattatcatagttttatttatttttattatttttaattttgagatggagtctcgttctgtcaccaggctggagtgcagtggtgtgatctcggctcactgcaaccgccgcctcctaagttcaagtgattctcctgcctcagcctcccgagtagctgggactacaggcatgtgccaccatgcccagctaatttttgtatttttagtagagacggggtctcactatgttggccagaatggtctcgatctcttgacctcatgatccgcccaccttggcctcccagagtgcggggattacagctgtgagccaccgcacctggctatcatagttttaaaggttgaataatattctaagtagataatgtaccatgatttacttatttagggtttgttattaatagcaaattaaaaaattcctaggtcaaaatgcatgacctgtgttacaactcctattatatatatggttttctggaaggtcaatattgattttggcatatatagactgggcttctctgggttgttgtaaaagttctatgtcattgaactacagaaagagggtgaggggatttctaacaattagggccagtgttttcttcacctctaaaccgcatccccatcctagtgtctgcttggctttgcaacaccatccttatcctgagagctttgttgatgcctggggatattcagaaattttcgacttggaacccttccaagacatttgctattttattctctatttgtttttcttaagcaactaactaaataagaataacatttcaacctctttctactccccacagcattttttcctgcctgcaccacctctgcctacagtttaaccatggggttgcttcttatattttaaagctaaatacaaaagcacagttctgagaagcagccaagttctgcagccaagtttgaagaataaaactttaaaacagctcttctgtcacacacttgagaggggaggcaggctttgctataaataagtcacattccatttctatctcatcctttgcagtcctcttgggtaatgctttttgtatatgactacagtgttctcgaactgcccactcacccctttcaaccttccattttgtgcctcactttatttaaatgttcaatagttttggagtttagggaccctgcatgaaaggagtagacctttcctttcattcttcaggcttagatgtaatgagattcagtggctaacttattagaaactatactttctctttgtctgtaacgttttcagcagctgcctggattagtttcctattgctgccataacaaattgccacaaatgtaatggcttaaaacaaggccaggcacagtggtgcatgcctgtaattccagcactttgggaggctgagatgggattgcttgagctcaggagttcaagaccagcctggccaacatgatgagaccccatctctatttaaaaaaaaaaaaatacaaaagttgtctgggtgtggtggcgtgcacctgtaatcccaactactcaggaggctgaagtgggaggatcacctgagcctggggagctcaaggctgcagtgagccatgatcgtgccaccgcattgcaacctgggtgacagagtgagaccctgtctcaaaaaacaaaaaaccaagaaaccccacaaatgcattttcttataattctagaaatcaggagtgaaaaatgatttggcagagctgcatgccctcagggggctctaggagaattcatttcctccccttttccagcttctagaggctgcctacattccctaagtcatagccccacatcagtcccacctctactcttggcatcatatctccttctccaactctgaccttcctttctctctcttataggacccccggtgattacatggagcccacacacataatccaggggtacctccccatctcagagtccttaacttagtcccacctgcagagtctcttttgccaagtcaaataacatatttataggtttgtgggattagggtgtggacatctttggagggccgttattctacttatcacactgtcttagaaaaggaaaggaaaataattttggaatttttgtctttttcatagctagggaggaggtacgctgaagttttgtttttccttcctgtatttgtgatggttgatatgtggcaatctaaactaagtctgggatgtctgtttgtattggctgaagttcattggagggcagaaaagaggagagtttcagagactggcagtgaggatgggagggtggcttaaagaccttcacaacctgctcactgggtgctcctgttaggccccacaaacaagcccatgccatcgaggagaagtgaccaagcagatacattcaaaatgaataaaaggaagacctcatttactgtagtcccatccagtgtggcttccttataggactatttgtctctaattattttatttattttttattttttcagagagagtctcactctgttccccaggctggagtgtaatggtgtgatcttggctcactcagccttgacctctggggcttgatcctcccgtctcagccttcccatagctgggactacaggcatgcaccaccacacctggctaatttttaaacttttttgtagagacagggtctcactgtgctgcccaggctgggcttgaactcctgggctcaagtatatcctccctcctcagcctcccaacatgctgagattacagatgtgagccaccatgcttgaactatattttaaaaaaatattaattatgatactaaacaatacagtgaataaataaccttctcatgactgtccatctggcatagtagaagactttatgtgcttttttcaaacaatgagagaaagtgctggcatatcgcacttcccttagcttgagagacatgtgccaatctgcttgttgactctgccaaggcctctctttccgtcattttccatgttctggtcaggatttgtgacatatagtggctgacaaaaggcacacaagtgatagtgttggtggccaatctgccagggaagagtctgaccctgggcgctaatgtgactcaaggtagatgagcccttcgaggagctagtcaaggaaacagatgataaagtctaactatcagtgagcgagcagggggtgagcattttctttctgaagggagttattactgtcattaacttcattgcgttgctgggaaggaggggtcagtagttgaaacaaaagtctcctatggctgatgacatgttacaactttaggacagttgtcagcaagcaacttgctgttgggcctaatctgtccccatgcctttgatcccttgagcctcaggatggtttctacattttgcaatggttgaaaaactttaaaagagaagccatattttgtgacatgtgaacattatgtgaaattcaaatttcagtatctgtatatcaagttttattgaaacacagccacatcatttgtttatgaattatctatggcttttttttttgagctaccacggaggagttgagtggttgtgacagagactgtccgtatgaccggtgaagcctaaaatatttactaactggctttttacagagaagtttgcagcttctgttttcggagatttgaaagagactgaaaaagcatcggcaaatgtccttgttgggacaatatttccataggaaccaagacccagtgattccatgtggtgctgatttatttccaggaacccatggagggtctaactggggagggggtatacaagataaattagaaacaagtgcacattcctgtactacaaaaaatatacaagacctgccattcacccctcaaataatatgtttcctttcctgaggggtcacataatttatgccagtacattattgatgagatttttgtttgtttttttaaaataaaaaacaggcatattgagctgctggaagtgttgagctggctgttctgaaatatcccactaggatattccacttgctggctggctacctccatctcagatgcaatgtccaaatggctgtcaatttctgcaggacccactttgtgccaggcattgggccagtgctttgggcacgtgaattgctcacactgagagcactgctgtaaaatcattgttattcccatgccgcatatgaagaaaggagcttacactgggtaaacccatgcctgggcctcccctgtaagtgggaatcccgagttgcaggtcaggctgtctcttcttcacagaccatgctctttcacaagacctggaaggaacaagacaaccacctggggagctgcttacttctgatctttcctctgggatgccagggctatcacaacctcataggcaagatactctaatcactgagttatggtgttcggtgataatatcgacttccatttttataatttcttctagcactctgcatcctgcatgttatatttgtaaaaggcctgtgaaaaacataaggcagacatatctatttctgctttgtaaatgaggaaactgaagctcaggggtaaagaggcctttctaggctcaaccagcttttagtggcagagccagacctcttgacctggggtctggtgcctgtacactacttcccatgggccaggtctttgggaatagagctgcgtcactcacacttaccttagcagaggctgtgatagactctaagccgtatggtttttagtttatcctcagtgaacctcaggtcatcaactgacctccagagacgaatttcacgttgtagatggttttttttgttggcattactttacaactgtgactctgctgaatgcactgtacctttctctttcctattaccacatccattgcttgagtttcagtcctgtcttagtccattttgtgttgctgtaaaggagtaccagacactgggtataaagaaaagaggatttataaagaaaagagggttatttagctcacagttctgcaggtgtacaagaagcatggcaccggcatcaacatgtcagagaaggtcaaaggagaagtgagtacgtgtgaagagacaccatacccaaagggcatcctggctttacataataataaaccaacctaatcccatctcgccagagtgagaacagcagcccagcacgaagtcattcatgagggttctacgcctataactcaaacaccttcccctaggccccaccttctgacaccaccacagtggggagcaaatttcaacatgagatttgatggggacaaaaaatcccattatccaaaccatagcaagccccaatccaaaccaaaagcagatccccattcgtggttcccctttccacatggttccaaatgaggaagggcaaaattcatgtgttctgctcagtaaaaggttgaaaagttattgggaaacacatcttccaaggtttgtgtcctttgggacatgggaatatgttattaaccaggacagctgctcacagctgcacagggatgtactgaaacagctcattttaagcaaattttaagtagtggagaggatcattcctgggcacatttcacaagcattctgtcttggttttaccccaatctctgcatattccttcttcgtcttcattcccggggcagcttcttctgcccaccccgtgaaactttggcccattcttttctgtatgctgtccaggggccatctcctcctctctacatgctgcattgaggatccccaaattgctatcctctctccaaactccaaatgcctatatccagctaccaaaaagacatctctgtttgaatcttcctcacttaccacaaacataacaggtagaacatagcttatttcttgccctgccaaaactgttctccttctgagcttcagtgcttggtgtagcatcctccacatagttggcatcggaggcagaacctgaacctgattctctttgacaggcctaatcactcaccactctacgcaatatgaaaatgacatgccatgtgaatccaatgccatgtaaaaaaagataacattttctgtttgtctccctaggatattgtaaatgcttggcaccaagtaggtgataaataaatgtgaaggacaaacctgttgattaagcgttcctgagacatatcctttatctttctcagatgagattctctgccacatagcttatccctgtattgggtggattgtgtaactctgaggttcaaacattgggtattgcctctaaaccttgcacagttatttatctcagaactattgagtttggcggctgtccacatcatgtaacaattctgctgttaccttcctttccttgttttcttccttccctctctcctcatcttccacattcctatctgtgagagaggatgagaaaaaaacagacaagaagacaaaccaatatttctctcaccaatgaaaaatacctttccgttctgtttttaccattaaatgtggtatttgccctctgtgtctcaattaaaacaggttatttccttcttagtttcttcttttatattttttttcttgtttcagaaatggttcatgttaattgtaaaagaaaaattccgaaattatagataagccaaagaaataaataaaacatgtaacaaccccctgctcagagagttgtggttaacttttgaagtacctacttccatgcttcttttctaggtacatattttaacagaaatagagacttactgtacttgctgttgggaagcttcttttcacataatagattgagaatattttcttgtgacagtcaatattcctctagaccagcaattggatcactttgtttaaagggccacatagtaactattttaggctttgtgggacttactgtctctttcagctaatcaactctgctgttataagtgcagaagcattcacagaaagtgtgtaaatgaatggacatgtctgtattctaataaaactttatgaaaacaggcagtgagccagatttggcccatgggtggggctgtagtttgcctatgcttgtctagaatatcttttttttttttttttgagacagagtgagacagagtcttactctgtcacccaggctggagtgcagtggcatgatctaggctcactgcaacctccacctcctgggttcaagtgattctcctgccttagcctcctgaatagctgggactataggcctgcgccgccatgcttggctaatttttttgtagttttagtatagacagagttttgccatgttggccaggctggtcttgaactcctgacctcaaacgatcctcccaccttggcctcccaaagtgttgggattacaggcgtgagcccacactccactagaatatcatttttaatgcctaaatagtgttctatcttattgatatatcattatttacttaaccagtcagagtaatagctaatgttgtttgaggccttactctgcgcttgcaacattgcttcgtttgttctatttgcattctgacttacacctgcccacagccctgtgtagtgtaggtattattctttctatttaacagatgagggaactcggataaagaacaggtgggtaatttgcctaaggttagatggttagtaaatagaaaactcaaaatttaaatttgtttgatttttagaagccatgctcttaactactcattatgtttttacgcacgttagtaattatttgcttggataaattcctagaattagaataacacatgcattttaaggttttgatatttgttgtcaggttgatatatttggccaacttatatttcttgagtggtatatagcagggctgtgtttctacacccttgtctataacaaggactcttttgacgctttgctactttaataggtaaaacaagcttcatctttttttatcttatgaatactctctatatttcttctaaggtgagtgtctgatgcatgttctttctccattgttcaataagagcatttgtcttctctattaatttgttggagccttttatgtaagggacttctgtggtttttaagttgatgctacatgacgtgttatgaacatagccttttactttaaggagatgttgtctttacaattgaagataattaaatggaaaagtatttagttttaatgcagcattaattagactcctggaattgaaaaaattcccagaaactgtaaggtaagggaggacttactcctgttggggaacttgtccctttagtttccatctcttaagtactagaatttgtgttctttaattggaaccattgctttgctgtggccatggcaacacatcttagctgccatgaacagcgcacactttgacaaaatattttttttagagagtggcttttagatggaattcattttccaatgtattcatggagtctagatgaattaatggatggtagacccatacttttataataatagtaataataatgaaatgaatagttactatctattgatcccttactgtattctagccacaatgctttattttatattatttcatcggatctttgtgataatcttatgtcatagatattgttgttatccttactttatacataaagaaattaacacagaagagttaagtggcttgctctggcttatacagatggtaagtagtggagtttgaccttgaccttaaccttgattttctactgcgtgagtcttacaggtttattatagcctttagggtatatactgaattcaacagtggtagcatggatggcaaatcttgatgtcatctagagtctaagatgacactagcatcagtgggccacagggaatctgacccagactttcataacttgtattattatgaagattagagttctgaagcttactggattagaagagcacgagggggtagctgccccaatatattctaatttctcttgaggaccaccaaattggcagagtgtctctgatagggaaaaggaagagttggaaggcatcttagcctctaggacagaagaaccatttttattggccaccaaagttacatctagttgcctacaaatttatatccaaactccttatcctgccaattcagggttctgcaaactgatgccaaactatagtttagtcttctatcacatgactgcattatacatacccaattatctgggcaaacagacctgatccaaacacagtttgtactttcctttcctttcctttgtttagcctgttccgtctacttggggtgtctttgatttctccagcctcagtctcccgctgttagaattctgggcctccctcaataccaaggttaagtagtacctaacgaagaattttttatttttacagacaaaagcagtttctctcctcctctttgattcttatggttatttatattactctcaagtcaatcataaccttcttatttgtaggatagtttctccctgtaggacttgcaggattcctcgaatacagtgcttttccaaaggtaaatgacgacataccttaatcttgttgttagggattctgactctgagagacatgaaaccactgtttagagtcttgttatgtatgaattgtgtccccctccacccagtccatatgttgacatcctatccgcccatgtctttgaacgtactttgaaatatgattgttgcagatgtaattagtaaagatgaggtcatacaaaagtagggtggactcctaatccaatttggccgtcacactggaaatttgggcttgcacccaccgagaacattgtggaaagattggaatgatgctgtcagaagccaaggaactaccagaagctagaagagaggcctgaacatacccttccccagagccttcagagggagcatggccctgccaacacctaggtcccagacttccagcctctggaactgtgggacgatacatttcttttgttgaagccactcagtttgtggtactttgttgctgtggccccaagaaagtaccacaagcctgaggttttcaccgtccttacagccagcaagacgggatgtttcagatgaccctgtcctatgtggaactgggggctgaggtggggtggcctgataacagagtcaccaaagagctgcctctcttatctgtactcctgagttctcacagccttctgggcatcttcagcaccagcaactcagcatgtcaaaactgaacatctttcctctccaaaccccttttccctcataagcccatctaaattatggttaccatgtccctctcagtccctctggaattcttcccttttctcatccccaattgaaaaaaaaatctggaattctatgttcttctggaaaataaggaagatctggcaacaccaggcctttgttactgcatggctataattggccagatggatgggctgcccctgaacatagagaatgtgtcctgggtcctgtttgacatcgcatgccagaccctgtgggcattggagcctggcccctggcagggtggaagtgattgcctctgcctcacagggacataagtggaaagcttcagatcattctctgagtcaagctgtccggtttatgtcctgctgtgtcgcttactggctgggggcagccatgggaagtttccttgatctccctgtgcttccgtttcccagtctgtaaatggagataataatggtgctcgcctcataggggtgttgagagaattaaatgatttaatgcgcatcaggagattggaacctgacacgtagcaggtgcacctgaaatgttcccttatattcttatgtagtcaagaaaatcttgtcaccctttatctaaactgctttattatttttcatgacgcacggcatatttacttcttggttttactttgctactctccatcccccaccagcttgacacacattcagaaaatgtggccatagtttatacacatagattcagggctggcctaccaaggagtttggacaaagctcccgggatctcacttggtggagctcctgggcctctcctggctgccgagtcccctgtgctttctgccttctgtgttgtttcggttccagtgaccaagggcacagcttggtgactggcctcccgaggccttccgagtcaccgggggatccctctaattaggtacactgttgagcatgcaggtgtatatcctgcaggcaagaagggctgctgaaatagtagcttaacatgaaatccaggcagcaagtcgggtgttcgttagaagtgtgtttttttttttttgtgatttgggacactgacaaagcccagacaaacctccccacaccaattgtttcccccagctgtattccccttattgggccactcctaagcagtgctgatgacttatttagctaatatttgttgactgaatttttattaatcaatagagatttgttaagtaaatggagcattattcagacatgtggcatcagatccattactagatgtaagtgataaataaagtggtaggtaagacacagtcctgcctgtaagagatgtgcaatctagtcattgagagagaccctatgagaaacagtgggtggagctgggggattaccggtgttgtttatgggatcccagagaggaaggaccctgactcagcctgaggttgggactgggggcaactgggggatcatcagacttgtcattattgatctaatgtcccagtaaaattgggcgttttcaggacagggactgtgactgtctttttattgctctatgtcttgtcctagcccagtggttgacatataacagacggtcaataaacatttgatgagtaagggaattaagtgacatctaagctgagaactgaaggatgaggagtctgccaggaggaaagtgtgggaggtaggggaggaagggggtggcgggaggaagtaaaatgatgacgaaggatggtacagggagggaggagcatgtgctccttgagggtgacaaggactgcagttctgggaactgttagcttgtatggtgggtggcatggagccatttcaaggtgggggcctgggcagagctgaatggtgagaataacatagagttcttagtttttacatgatgaggtttgatatgcatgatccaaggtgcaggaaatggattggagaggacagggtggaagaggagaggccattcgatggctattgcagcaatcttgagagatggtggtggcaggacaaattactgacacctgagatggagaggtgactagattcagaagcaactagggatgtagaattgtcagaacctggcaattaggtgtctgtggggaaggaaggagagatgtatgaatgatgctcaggcctccaggggatgtgggcaccacttacttgtgatagatgagaagaggagctgtgagaaggttaaattcacacttgggcatggtgagtttgagatgcctgtgggaagtccagagcgcagttgtatacagcaggcttcacctccagagagtgatcagatttgagatacaggtttgaacactcattggcatagagggtcagggcttcatagcctagaaggacatagataaaattaagaaggcctatgaacttcagaaattatattaaaatcataatgcatgtgcattgttctgaagagctagctttgtatcaacttttcaaaatgtctgtgtcctcaaaaaggttaacccttggtgcatatggttaatgaagccagaaggagagatgagatttttcaggcagcaagaagggaagagagccagggtttgtgctgcagaaaatatcaacatttcgggggtgggaggcactgtgctgagtcagaggcctgggggtcagagttctgggaatgagataaagacttacaggtagcaatagctttactgttcataaagcacttttacatacaatgccattttatctctcaggaactcaactagatctttataatttggctctgtatcagttagagttcagtacaagacatgaaaacttggctataaattttaaagaagggatttcctagagggaataggtgcttactatggacccagaaaatctgagataggtctcagttaatgtagaaagtgtattttgccaaggttgaggatgtgcacccatgacacagcctcaggagggcctgacgacgtgctcaagctggttggaatgcagcttggttttatacagtttagggagacatgagacatcaatcaatgtatgtaagaagtacattggttcggtgtggaaaggtgggacgactggaagcaaaggcaggaagactcaaagcggagagggagcttccaggtcatagataggtgagagacaaacagttgcattattttgagtttctgattagcctttccaaaagaggcaatcagatatgcatctatctgagtgagcagagggatgactttgactagaatgggaggcaggcttgccctaagcagttcccagcttgacttttccctttcacttagtgactttgggggcccaagatattttcctttcacattacaaaatctctggaagggcagccccagggaaagattcccagaacaatatagaactaaggtcagagtacatccctgtagctgccaccctggcatcgaaaagctgggactggaaagccaccatggctgcagctctttctcggccttcatggagctgaaggaaggatgctggacactactgtattaagaaatctgttttcgtgacctgccttgatagcagtgaacagtcaaatagaagccaaagcatggccctcatctcacttccaccttctagaactccttgcttgagtacatttaattagtggaatccacttcagtcctgaatctctagatgcagagaagtctggaagatatctttataccacctctcttcctaaaaggagtgtgaaatggagctagagaaggggtcttattttgtaagggtcaagttaagaactgtttcagtcttagtgagccatgtggtctctctgcagccttgccattgaagtgtggaagcagccagagaccatacagaaatgagtgagcatattgtgttccaataaaactttatttataaaatcaggcctggcacagtgtttcacgtctgtaatcccagcactttgggaggctgaggcaggagtgagcttgattgtgccacagttctccagcctgagcaacagagtgtgagaccctatctctaaaaaataataatgataaagttagttaattaaattaaaatgagtgatggggcctaaaggccacagtttattgacctctgaggtaagcaaatcaattctcaataattatcgtaggttcttttttacagatgagggaattaaaaccggagagcgtcagtcgaagtgaaaataagtcctggttatttagttttcaaagttcatgttctccaggaaatcctgatgctcagcctctcctcttacaaggcttgtgatctaaaagaggagataaaatatgtactttgttggtgcagaccatggtaaatgctcccgggatggtgcggaatgcttttgcatacaaggcatttttgacaggagaaatcagaagtatgatggtgaaagtagttttagctagatgttgaagaaaggtataactctaacaggtggagatggagaagggaggagtcaaaagagctgatagggtttggctctgtgttcctgctcaaatctcgtgtcaaatcataacctcaatgttggaggtggggcctggtgggaggtggttggatggtgggggtggatccttcatgaatggtttagcaccgtccccttggtgctatccccgcaatagagttctcatgagctctggttgtttaaaagtgtgtagcacttcccctctctctttctcgtgctctggacatgtgaattgcctagctcccccttcaccttccgccatgattgtaagcttcctgaggcctccccagcagctgagcagatgctagcatcatgcttcctgtacagcctgcagtgcatgagccaattaaacctctttttttttttttataaattacccagtatgaggtatttctttatagcagtatgagaactaatagagaatttttgatggagtcaaaaactgcaagagaagtttaggaaaacagctagaaatggaaactcatctgaacattgtgaccttctatggtgttagtggagataagactggatcagggagaaccttagatagtaggattaggaatccgaacttggaaaaggggaagcactgatagtcttcgagcagggttgtgatacacacattacctcaggaagaattatctggttttgttctacagaattttgtgtaagtcagaagatacagccagcaagaattcgctcaggcggttgttgtaatatctttacatgaggatgcaaaggaagaagtggacatgagtcttgggccattcatgggacagggcaacttgtaaatgtaggtggaatagaaggatggctttgatgggaagagatgaaatgaataacaatacttgggaaatttgaggaatgggagcttgttttgtgggtaaagtaatgggccccatcttggatatgaggtgctgaggggcagaaacggaaatatggagtaggcgattggaaatgttggcttcatcttcaagatggggttggttgggagtcatcccatacaggtggatagagagccaagtaagagctcagctctctgagggagtgtgtacagtggaggatgccggaaggagaacccaggagacaaaggtattccagaactgggagagggacaagagataggaaaatgtagtaggcagggtagtgagagtggcaggatggatgttgtaccagaggagtcaagttagggagctatttccagaaaaagaaagagccaggaatgttgcatgccacagaaaggtcaagaaatactcgaaaaaccactggatttggtgaccacatctcaaggtcatgggcgaccctgagagagctgtttagtgtgtgttcttctcttgaggagtttcatattgaaagaaaagaggagagaaaatgggagattgaaatttgtggcttgttttaaagtggattaattcttcagtgccagaagaccacaaagaacttggtctgagaatatatcctgatttctccccaagacttttcttaagaaaaagcaagttgaaagaggaacaccctttagtttcgttctctcttgatttcaggattcggtttttggtcagttgtttgtgtctgactccacttttggccctgtcgtggggccgctcctggcaacctgggaggtcacgcacaagtgtgtgcagttgttaagcaactgctcgcagtcgcggtggccctgctaaattgggaacatgtattcgtcccagtctgagtcttcattcagtgggaaacaatgagtccctgactttgaaatctcagaggttacacatttgtggaatatgaaatcagtgtgttgatgatttttcctacctcatagaattctttaaaaataacactggagaattgctatgcaattctgtgaaaatttagttctctctagggccttttctagaaaaaacgttatgcccaaatcccaaaaggaactgagtattttatatcaatgctttctaagataaataaaaacagaacacacacacacacacacacacacacacacacacacacacacacacacacaacgcagcaacaacagcaaaagtcaataaaacaactcaccaaactaactctagagtttcagatggaaatgatgttatcagtccaaattaaagacatattctcttattttcttttacaccttggtttgtggcttccataatacaatcatctgagtcttgtatggtttctgaaatggatgctagaagagataacttgaatgagtacttttcccctggtggaattctcttcctcatctatatttaaacagttgttttgcacctaaagggccctaagttacgtttctctggagatatttagagataagaagtgttgtaagtactctttcacatttgtgcagaactttagtctttgaagtgtttagacatccattaatctttttttttttttttttttttttttgagacagggtttccctctgctgcccagactggaattcagcagtgcaatctcagctcactgcaacctttatctcctgggctcaagtgatcctccctcctcagcctcccaagtagctggcactacaggcctgcaccaccatgcctggctaatttttgtattttttgtagagacagggttttgccatgtcacccaggctggtctcaaacaatctacccacccttgcctccaaaagtgctgggattacagacgtgagccactgtgcccagcatccttaatctcattctacctcactttctgcctattgagagataggcaccccaagtaggaagtccaaatgctgataaagaaattgggattcagagtgacttactaactagccccagatcacacagcttattagaggcagattcagggctaaaggtcagattttccagctgcagatttattctgctttgagtggcattttagacattagtgttttctttaatccttaagcatttcagtgtctaaggtttgtataacatcaggttggtttctggtagtacgttgattgtggagagggcccagaagcagaaaccacagtctttacatgatagttactcttatctgaggtttggcctttattgaatggaagtctcttgttaaagaagggtatgcattgaggcaagagtcttgccaacttttcaaaaaaaaaatgggaacccctgggctccttggggatggctaatgacaatgattatggaggaggctgcaaatgtgaagtactttataaatcctggaggtgtggcagtagactgtgtgtttctggggagacagatttttgcatacattatcctctggacacttctgcctttggtgcatgcttgtttttataaaaaagcttgttttgttcctcctgtagaaatgagcctatcatctagagtcatggtggttttctgtatgtgtgagcttatgcttcagttacactgaacactcgtactactgcaaaatcgaattcagtgacattgccaatatcttcgctctcagtagtctttaaatattcttagccctgggaactggcccaagaaactgcttattcttttccctgtatcacttagcatataaatcctgaattactgctgactgaagatacataaagtacaaatcaataagtattttgtttctatattttggagaatgagacaatgagtgaaagagaacccctcaatgagggctttaaaatattgtcattgttctatggattagtagagctgcggctactattttacttacccactggccaccaggtactcacactgcagtgaaaggattcctaaaaacatctttattaagatattcacatactatacaatccacccatgcaaaatttaccattcgacgttgttggtatattattactttgtaaaaatcatggccctatgcacaacatacaacttgccactttaatcattcttaatgtacggttcggtggcactaattatgctcacagttttgtgcaactgtcactgctacctatttccaaaactttttcatcatcccaaacagaaactgtgtacttattaatcaacacctccccgtgaaagaatttttaaacataccttgattattagctttggatgtatataaaacctttaaggaagattttgtttagtctgttttttttcagggaaagtttattttttaaggggcagttccatacagtaggtgacacaggttaggttcctccagaaagcagcctcttatagtagcatgtgggacattgccagagtctcaggagcaacacttctaggggatgggggaagggatggagggaggactgggtaaaaggagaacgtgtactgtgttgtcattggaaggcctcaccctacccagtggaactctggaactggcatttcccaagttggggcaacagggatggatctttgtaccatatcattcagtcatagggttcagctcccaggacggcgcatgagcttggacaaattctctccagccaagggtcagagaaggttgacagctgagagctaagagccagcagctgaggggtgaaatgctcagtccatactttgccaaactttgctctccactggaatcacctttgcatcctcaaaaatactacgcctgatttaattggtatggggtaagagacaagtggaatgcttccaaagctccccaggaggtttgaatgggcaacacagattgggaatggctgctttcagtcttgaaggggagtcagcatagtatacatcatcatgggaaatgcctggactttggattgaaaaaaagttgaacttggctcaaccatttactgacgttgtagttcttatttatgttctgttaagattttgctactaggctttaaaaaatatgaatggatggtgcacctgggtggctgagagggcacttacaaattaaaacaaaaacagtgaacacctccagaatttgatagaacacaagaatgcataattcataaagaagaaattcaaatgctttttaacatttgaaaatatagtcttaatagcaactgaaagaatgaaagttaaaactatattttgcttattatattagcaaagatgaaaaataattgctattgctcagtaatggtgaaggtagtggcagaagacactctcaagctcagcacagtggttcatgcctgtaatcccaacattttgggaggccaaggtgggtggatttcttgagctcaggagttcaagaccagcctgggcaacatggtaaaaccctgtctctacaaaaattagccaggcatggtggcatacacctgtggtcccagctactcaggtggctgaggtgagagaatcacttgacccccaggaggtggagcttgcagtgagctgagatcatgccactgcactccagcctgggtgacagagcaagaccctgtctcaaagtaaataaataaataaataaaacaaacataaaagaaggcattctgatcctcttggtatgtccattggtgtaacacgaatggtggaccatttggcctccattcatgtgtctaccaatgcaatgtagataaaaattcataaaaagcgaatgccttttgacataacaaatctaattctagaagtttatcctgaggaaataacagaagagtatgtaaaaatgtgtgcataagttgtaattgcctgggtcttgctggcaattaggagaagcacaaatggtcattaataaaatattggttaaataagttctggtacatacctatgtacttctaatgagagaagccattaataaaatagtgtgagcctatttttgcattaaaacatttgcattgaaaaatgactttgagaaaaatatcagatgttaatggtaaacagtgtttttccccctgagtataagaattatgggtgaattttattgtctaactcatatctctttataatatttatacttagaaagtattacatgttatttaattatgtgttaattttatattcataaagagcatagagctatttccaaaaattacatatttccaagattacacacctgcatatctctatctatctatctatctatctatctatatctccctattcattcagcaacctaaaatgaaacagcctataatccaattagtagttatccctagaatttgaggtcacgggtgatttttattttctttcttgtgcttatttatactttacagatttttataatgagatcatatctctcttataatgagaaatgttttaaaaaagcttttaatatctcagtgcacttgcctgacctattttatatccattcttgcatctatttcatttgaagggtcctttggatagcatttctttctccatgtctttcttcctgctgtcctatttaaataatcacaattctgtgttgaaatttttgtatgctttacctaattaggacaaatattctgactcttgcatttgttatcaagatgtacatttttactttattcattattgttttttttttcttaagcaaagtttggcctttagatgatgcatttccaagcctagcatccatcatctaccattatgcttttgactcatctattaaatagtaatgtgtcctccaaaaatattgatgttaaattaaatgactctatatttgtccttggaaaaagctttgaggctataaaatttaccaagcaggtaggacatgcaaaaagagaaatgcatgcaaatgcttcctataggcaggagctcttcaatgtgtctgacaaatctcatctatcctttaggtcctaaattaaacatcacttctctgtgatgcccaccttgactttcccagggtaagctggtgctgacttctccttatgtttattatgcctcttattaaatcttattttaagtagttattgatgtctaccaatgcattagaccaccagataggaaatatggttgccatccaccaacactcttccaacagtccctacctcctcatattcaagcccctgacaaatagatgatgacagacgcgaccatatgtcacttccaagattaggttttgaaagacagaggtttccgtgttgggctgtttctcttggcccactaacctatggaaagctagctgttgtgacgataggcaatgtatgcagagaggctcatgtggcaagagctaataaaaaatggaagctggccacacacatgtgagtgagctttgaagcagatcctcccccttgtcaagccttcaggtattacaggcctggccatcagcttgattgcaaactcataagaaactctgagtcaaaaccgtccgtctaaatggctcccaattcctgaccttcagaaaatacgtgaaacaataaattcttgttgttttcagttttgagttttaggatagtttattatgcatcagtagataactaatccacattggtactagaggtgcagtgcttatgtaacaagaaactaaaatgtgataggactttgaacgaggcagcgggctgtggaaaagctgtaaggattaaggaccatgttagtaaaagtgtaaagtgccttgaacacactgtccatagaagtttggactttgaggaggctgccattgaaggcttcaaggaaaatgggagaaatcctattggaaactggaaaacagagaatctttgttacgtagtggcaaaaaaaagaaagaaaaattaacaacactgtcacctgcagtaatgtagaaagtagaaaatgtgcctgataaactggtgatatagttaaggagatttctaaccagagtgctgaaagtgctttctgattttttttttttcctgttgcttagagtaaaactgcaagaagagaggagaaactgaaggtaaaactattaaataaaaaagagccaggacttgctggttttaaagattcccagcctccccacatggtacgtgatgctaaaattaagaaatggcatctgagcaaagaccaaattcagggcacttttaggaaaacaaggtccaaacattaagccaaggatgcgactataaagtcttttcttaacatctcagtaaacaaagatagtgtctcagaatactgtttagtcagaaaaacctaaagatactaagacaagcttgtccaacccttggcccgccggctgcgtgcaacccaggatggctttgaacgtggcccaacacaaatttgtaaactttctcaaaacattatgcgtggacctttatttttatttttattttttagctcatcagctattgttagtatattttatgtgcggaccaagacagttcttcttcctatgtatctcagggaagccaaaagattagacacccttggacgaagggcttgccttacagatcctctctatcaaccagtagtgctccctggaagctcacagacattgtacctcagtccaagctcaagaaggacctgtttcaaagagatttgtgggtgtggcttttgtgtagtggaattaagcctaaagggattcccagaagacccatggagttgaaagggggttgtgcttgaagaaacaccatcagctggaaagaaaagagacataaagagtacaaaatgcagagaggcctttggaccaccaagtgtcaacaagtaaaaagcagactgagaaaactaactccccaagcacatgttacctttcatgaaaatgaaaggatgcctgagagggcacactcaagatttcaaagggtgagactaaagccatagagaaatattcctaggccttaattagagaccaaatcaaggagcttccatcatttgcttgcctggatttcagaactactatccttgcatacttcccattttcccctttgtgagttggagtgtctatggcagttatcctctccttatcctgcccttgcatgttgggtgcatggggccagataacttgtttctttatttgcacatgcctctatatcaagaagaaccacattcaattgttgtatgtcagagactacacccaagaaggctgatttagatgatgagggtctggacttggaactgatgctctgttgggatgagacttttggggacagtaggaggggtgggagtccttgggagccaaagggtgtcctgtgttaggcagcctccaagatggctccctttgatctctgactcctggactcacagagttgttaatcccctccccatcccacattgtactagggttggcctgtgtgaccaattgcaaatggcataagtgatggtatgtcgctctcaatattagtttattaaagactgaagcttccattttggtcctgctctaatcccgtgctttcctggatccctcacggtggggaaagccagctgccataagttgaggacattcaggcagtctggtggaggcccacatggtgaagcagttccagccaatagccatgtgaccctctagttccaatcaaggcttcagatgatgcagaccagattgacagtttgactgtaacctcatgagatactatgtagaaaaaaactgctgtaggccttagacttctgtacttacaaagacttcttgcaaaattggcttggctggcatccaggaatttggatttaggggaggcctgacaccatttcctaatggataagagtggttcactgtgcctaaactgtaaacaatattatttatgctgagcacttgctttccatatgggagtcttggatttttatatgtgctaggcagagggtgtgtaatgagcaaccctcagtaaaaaccttgggccaggagtgctggcttacgcctataatcccagtgactcaggaggctgaggcaggagggtagcttgaggctgggagttcaagaacaacctgggcaacagagcaagatgccatttctgaaaacagaaaattagccacgcatggtagtgtgcacctgtagtcctagatactcgggaagctgaagtgggaagattgagcccaggaagtcaaggctgcagtgagccattaactgtgccactgaactcccgcctaggtgacagagtgagaccccccaccccaaactctaaaaaaaaacagacaaaaacattgagcactaagtctgtgataagcttccctggtagacagcattttccacttgtcacaatacgatgctggaggaattaagcccatgctgtgtgattccacagcgagagaactcttggaaacttgcatttggttccttgtctggcaaagagaaaaggtgctgattttgctttatattcttttgctataataaatcctagctatgaataatattatatgagtcctgtgaatcctcttagccatcactgaatctgggggtggtcttgaggacctccaacccagagctcctgagctaggagcacctagatcttcctagaccctcagaaaccataggataataaatatttgttatgttgaggcactgagttttggagtagtttgcttcacagcaataggtaactaattctggaagccagtcatttctctcttcccagcatttagtttagtgtcttggaacataggtgttaaagaaatatttgttgagtgacttgacactatttctgcctttgaagaagttcatagtccatttggttcctttgctggaggaatctaaatcctggcttggtattatgaagcaggcttactctcttttttctgtggcctagaagaatcaatcgcagtggcagcagcctgccttaacgttgtcaggttctgccatcttccctgttgaatgagatccatgggtataagaattagtgtatgaccatgcctcttctcttttactcacttcttaggtcctttgatttttattttctctcccttctatgtcatggcagtggtagctattcttactattgaaataaaaacttcttcctgctgaaaaattaattaccaaatgtttcagggccttataagatattaatatttccatatcgagtcttgcctcttactctatcatatgattgccttgaggaaagttcagacaaattaactttccattttacattgcaccccactttcccagcttctgcaaactgtcttgaaatagactttatagaaagataggaaccatttccactaaaatgagtttaatgtagggaaaaaactcaaagtatacactgaaagtagacttctttgagtcatttacagttaaaaattattttaatctaaaggtgtatttgagtgtgtgcacaggtatacacatagaccgccccccaccccatactcattcctgtggcacacttcttgctagttgttggcactgttaaataaaaattacagggggccatcgttttggactaagcttctgcacttggccccaacaaaccagattgaaaatcaaaatggagtcactcatgctaaagttccatgtcaccttccaataaatcaggggaggaagataacaatctaattttccaaacagggcagtttcaatcttcaatcagcctgatgaagttctctctgctttaatccttacaacaaaaagtaacctgaaggaacgtgatgttaactagatatttttttctctattgttctgttttcctgttcctggattacaaagaaagtaactatgcaatgaccaattgcttttgttctgtgtttctgctttctctagcccttttctgcttacaaagccaaccatctctgcccactcattgcagcacttattaatggcaaaaccgcaatacttttgcaccaaaatatttaatggaatgaagtgttgttctattctaaaattgcaaataaagctacttgagctcctgaaagtaaatttgttgtaattttgtcctttgacagatccttttcctcctctttgagtctccttccggttcagcagatgaccttggttatgagtttcatgagaatcccagggtgatctaatagaagctctctcatttatcttctttccatctaattttttacaatttttattgttttttcttgtgtcagagaatcatctacctttgtttcaaagggttctagtcctgctttcaatcccatatacttgggcctgatggatctttcgaaagtgaaattgtggcctcatgatggcatcatttgaaagcctccgatgactgtttcccgaggagggtgaactttctctccttacctgctcttgctttcctgcctccattttgctcatggcattcccttgaattaggttctatgagtggaatacagctttgaaggcaattccagagatccaacaaaaacccaggagattggaaggaattcatatttgtcaaaaaatgtgtagctcaaaaatataaaaaaaaaaaataatgcaaataaaacccaatagagtataacaactatttacatagcatttatattgtattaggtattataactgatctacagatgatttaaagtatagaggagggtggcataggttatatgaaaatactacaccactttatattaatataagagacttgagcatctgcagattttggtatcctctgggggggtactggaggcaatcttcctgggatactgaggggtgactgtaacttattttcagtactttggtaatagtgtatttaacggtctattgtttctcagggtttgtggatgatagtccattaggatctgaaaataagatattagaagttctatttacttttttttgtttttctgaaattttaagtgtatatgaagttaagggaatacatgtaattttgaaataattaaatattcatgtttggaaatctgttcaaatttttgggtggctgggaacacaaccaaaaagatatgaaaaccaataacaattatgtatcagtaggcattttataaatagtctttgatattattttggatataagtgatttgattggcacttctcatttaattgcttattaggtgggtttctgttttgtagagaacatttaaaaaaaatttagacaagcaaaagttaataaaatcacctgtggtatgaccactcagaggtaagtataatgaatgttttattgtatcttctttgcagctagttttctatacacatagacatgattttcttctaaaaaaggaaagatcatgatgtatttataatttgtaaaacttttataccttgctctttgaactttaaagaatgtcatgaacatttccttagatactaaactctttccccatatattttaatggccttattatatgaacatataaaaataatttattttgataccttaattcatgtgctgttggatttttaggctcttgcaccattttccccacttctctgcttgctgttataaacagttctgaaaaccagatgctgttagccacaccatacatatctgtgatgtttcctgacaagattcctaaaagtagcaccttcctttcataggtgaggttttacctctacctttgttgtctgtctctaaggcaaaggcaattttgtgtaatggtgaagaactcaggacagaatttgaattgtgcctcaaccagttactactgtgtgactctgggctagttgtgaacctctctattcctcatttcccctcatctgtaaactgggggaaacactaataccaacattgctgggtggttgtgagcaaacaataaacaaataatagtgtaagcaaacaataaattttagcaattgtttataaggtatttctcttgtcaagtaagccaagttaatcatctaatggctcctataaaataaagcatagggccaggtgcagtggctcatgcttgtaatcccagcactttgggaggctgacgtgggcggatcacctgaggtcaggagtttgagaccagcctgaccaacatggtgaaaccccatctctactaaaaatacaaaaattagctgggtgtggtggtacgtgcctgtaatgccaactactcgggaggttgaggcaggagaatctcttgaacctgggaggtgggggttgcagtgagccaagatcacgccactgcactccagcctaggtgacagaacaagactccgtctccaaaaaaaaaaaaaaaaaaaaaaacaacaacaaccataaaataaagcatagttatagtattcagtaaggtgaatgacacattaatgactccattttccatttgatcagttcttacatccaggaaccatgaacacagctatctcaacatatggtagtttatagggatagtctgtaatcttgcaaatttaaaaggtaaataggagtccttcagtaggcagattcatatattgacaaatgaaggaagaattagtcttgttagaagaaacttgccatttcgtttgtgaacaatgtagttaatttatcacaggctcagtgagggcaaggatggagctatttcactttactatttgtgtacagatccagctcttgggccgtggtaggcactcagtgaatatttgtgaaatacataaatattcatgagcaaatatatctatactttgttgaatgtattgcaatgtatgttgtaaacataatgaaggctttgtgtgatgaaccgacaattgacaatgaaattattgtctgcaaagtgggctggggccttcaggcttttctcctgattatagattcagaaataatgcaagaggctgttgctcaaagtgaatcccttactccgtgctggtcgtgttctttaattcatgtgctgttcccttgtgtgtgctcagtccttattgcagctgctgggtctgagctcactgtgaaaatcgtgtttcctttctgccgacccatagggctcagtgtttgattaataagtttcccattttctgagaaaaatacctaggtaaatcccccttggacagcacaaggatctgcagtaatttacaaccaccgtgtgagccttgtgttgaatgacatgctctttgtaaggatatggcataatttataatgctggccccaacgtccactcctagggcgttctcagtgcagtgccttgactctgatattggataatgttgacagttaagagaggaatgactttagttgctgctgctgaattaaaaaagtcagacacacagtctaaatggattttgctgtcttcaaagtagtgaccttgggatagatagaactctttgatgcttccattgatgttgctattgccccaaacatttccggaatcctttaaaaattacctttaaagcatgtggcacattcttgtgaatatttttgagtctaacaaatactcattctttgtatgaggctttgatttttggaaagagtgaagagtcactggcatcaagtgcaacaactgaggtgggtgatgagggcagagagtgctggttttgtttagggcaacatatggttttagaggccttttaataatgtcatgagacttgagcatttgttctaaacatgatttccttttaaaataatgtttgaaatgatgaaatagtccaagcctacagaacacaacattacatgccagataggcacgttcccagcatggatgttaaacagatgttaacgtgctgtgtttgtttgcgtgtgttctttcatcttgctctccttccctgttttttctttgaaagacagtgttttagatattcctaaacaccccccgcttccctccatacccgtctgccttctcccctttttccatcaatattcatacttctgccaatgttgccatgcttcattcccaggtgtgcttgtaccttttgaggaaatgtttagaaatttaaaggaattatcttgtgtgtgtccttctaacattgtctttgaggtttatccatgttgatttgttttaactgctgttttagtccatttgtgttgctataaaggaatacccgagactgggtaattaataaagaaaagaagttcatttggttcctggttcttcaggctgtacaggaagcatggtgccagcatctgcttctgctgagggctcccagctgcttccactcatggaggaaggtgaggggaaaccagtgtgagcagatcacatttcaggaggggaggagagaaagagagagaaagggaggtgccaggctcctttcaacaaccagctcttgagggaactagtggagtgaattaactcattactgcaagggcagcaccaagccattcatgaggaatccgccattatggcccaaacacctcccatcagttccaacctccaacattggggatcaaatttcaacatgagatttggagaggacaagcaaaccaaactatagcaactgctccataggattccagtatatacgaataaatcaagagtcttcatctgttcacctgagagaaagttcagatgctttcaccttttttgttattacaaatagtgatacagtagtaactgtgtgcatatctatctagaaatatgtactagaggttgtctagagccagtactcagaggaaaaatggctaggttctagaacgtgcacattttaacttagtggacattaccaaattgctctccaaagcagttgtaattatgcttccattggtggtttcccatatcctcttagttatcagatttttaatttttgctaatccgattggcacagaattgtatctcattgttttatattgcatttctctgcgttctagtgtgattgagtgtctcttctgtactcagtggccgtctgagtttcgtcttttgtgaattgcccatttatattccttgctagtccttctattgccattggcctttttattaatgatttataagaatcatttataatctagtattctttgtcagtttaatgggccccaaatatctttactactctgtggcttatgttttgactttttatgatgtctctaattaaacagccgtgctaaattttaatgtaatcatatttatccatttctcctttgtggcttgtacttttttatgtgtttttaaaaagaaatactgctctatcccaatgtcataagaataatttcctatacattcttttaaagttttcaaatgtagtgtttcacagacacttagaattgatttttgtgtatatgtaacattggaatccacttttatctttttccatatggatgtccagttgtctcagttacatgtatcaaatcttttcccactgtcatacaccacattcccaaacacgtgtgactgtgtgtggcttctgttctttattttatttttatgtttatttttattttttgaaacggagtctcgcactgttccccaggctggagtgcagtggcttgatctcagctcactgcaagtgctgcctcgcgggttcacgccattctcctgcctcagcctccagagtagctgggactacaggtgcctgccaccacgcccggctaattttttgtatttttagtagagatggggtttcaccgtgttagccaggattgtctcaatctcctgacctcgtgatccgccctcctcggcctcccaaaatgctggaattacaggcgtgagccaccgcgcccgactgttctttgttaatggtgtgtttgcttactctggctctaccctattttaattaccttggtcttataggtttgggtagtttaagtttcacttcagttttcttttttggaattttttttggctattctaagctcattatactttaaactgtattttaggaatgtggaagccctattgggcttttgttggaattactcagatggtttacagataaatcgtaagaatttgctctcttatcctgggtcttctcatctacaactatggtatagctatgtttatttagttctctttttaggtctttcagtagaattttgtaatttttgccatacttttcttacatatctttgttaaatgtctttgtaagtatctcatttctttctttcatttgttcctttttttgagataagatctcccaggctggagtgcagtggtacaatcatagctaactgcagcctcaaccctcctgggctcaagtgacccttgtgccacagcttctttctaagtagctgtgactacaggtgctcaccaccacatccagctgatttaaatttttttatcccacattttttgttgctgtcaatgatatctttttattgtatcttttcctattattgctggtgtataggaatgttatttttgtatatcttgctgaactcattaattttcatggtttagatactcatacattatgcagacagataaaatcttttaataataatgacaggtcttttccttttcatgttatgtggcattcacttctttttcttgtcttgatgtactgacttggactttcatgatatcacctgtttttgttaataaagttttattgaaacacagccacatccatgttgtctgtggtaccattgtattataacatcagagttgaatagttgcaacagagactacctagtttgcaaagcctaaatacctgccttcaggctctttacagaaagtttgcctatcttcacaaaacagggttgaacagaggcagtgatagtaacctttcttgtctcatccctggctttaaaaggagagcttgtgccaccaagaataagtgctgcttctgggttggttgatgtgtgccttttattgggttaagaaaatgtcttttttttttcttcaacttttattttaagttccagggtacatgtgcaggatgtgcaggtttgttatataggtaaatgtgtgccatggtggtttgctgcacacatcatcctatcgcctaggtattatgcccagcatccattagctattcttcctgatgctaccccacacctcacaggccccagtatgtgttgcttcctcccatgtgtccatgtattctcattgttcagctcccacttataagtgagaaaatacagtgtttggttttcttttcttgtgttagtctgctgaggatgacggcttccagctccatccatgtccctgcaaaggacatgatctcattcctttttatggctgcatagtattccatggtgtatatgtaccacacaagaaaatgtctttcttagatttgtaggaagtcttttcttgtttgttttgttattaaaaaaaatcatgattgaatgttgaattttatcaaatgtagttttggcatctgattattttttctctcattttaaacatacgcaattatattcttttgaatttttctattatttctagtccttggggctagaatccgcccctttgatgtgcttttataacttgtgatctcagtgggtctcattttttctgtaggaattgtctgcagcatggattgtgggaattttgctctggcattttccctgcccattcattagtccaggaccaatttttatgtgaatttctcagattgggcatttccggaccatataggaagcctaaatttgtaccgccaaaatgttccagaggcggtggtctggagtttaaactttgcaagggaaggcttttattctcctcccttggagacagacagaaacatacgagtctctttgtggttgcagctctttgaggagcctcactcagggcagcagccttctacctcgggcagagcccacagactttgcctgtttctcctctgtgctagttgaaatctaaatgcctactccccctggaccaatacttgtttctctccttctccctcaccatgatcctgtcactctctaaggggagtgaatttatgcttgcttctggttttagttgttgctttgtttctggcacctggtaatttcttctttcttattgcaggttcagctatgaatttaaaaatatatataatatttccaggtgcttgtaggaggtgagtgtgaatgtgtgtcttctcaccctcttgctgaaatgagaggctgccctctaaatgaaatttcaatattgaaaagataaaacccaaataaaacaaaaagcaaccccccaaatcagctccctaaccatgagccaggcagcacgtgaagtcctttgatattagctcatgccattcttatagaaactctgtaactctttttaagtggagaagttaagaaactggcccaatcccatgtcagggcagagccaggccaaaaacccctctgttttattggctgttacctcattttacatgtctgaacagtaataacagtgggtgtcaagtgtacctttcctaaaggtaactactacaaaggtcaacactattttccatctaacactcctaatatatttttacacattagtctcacctggtaattctaagatagaataatgatcatgcttgtctgtgagaattagcaatttttttcatggatttaagttcaagaaaaatcagaaattagcagttcaggagttttcaacatttgtaaaaaggcagatgggtgcaccattagcacttccttctgagtgaggtagatctccagggaattaataggaacccgttgttttccatgttggcaagatattagagaaatatgtcttactctcaggtttactaagacatgttttaaagataatactgtcatgcatgtggcttatggaaggctatagggatgtggatttttatattctctctagatttatttgcccatactctgaaatcaaggcagacggtaaaggtggagtcagtggtcattctgtttttttgattaggggtttatagatggctgacattttaatctcagttaatgactggggatggactccagggtccttcaccacagctcacccttgtttgtgatctaatttagcagcatcttgatttgaattgaaagacagccttgggaatattagctcggcccttgtgagagcattctggaatgctgcatattacctgatgctacctgagatgtaggtggttgggcagtgacagcctctctgagccctgacctgtcggggagaggttgagaagtggcaaaactttgattctaccagctgcaaagaccgatgtcaccatgaagttatattaatgactttgacaagaattttctcagtgtacagtaggcatatttgctgaatgagctgatcttgtaatcccagtatatctggagtagtcaattatgaattttctaattagcttgatgtttggtctcccagctaagtgagctcttgtgaactctgccagaatctggatttccaaattatctgacaggaggaaaggaaaggattgggccaaagtggccattgcaagtcagtttcttataagtcaaaaatttaatcagaccaagtgcctttcttttctgtgttcagaaaatacccattctttgtttctcacaactgttaacctgtcctaggatgaactggttctgcctccctttgctgtttcctgcattagtacttggaaaagcctgtggctgcatggtctgaggtgtgaccttcatggtgggcacaccttgtctctcttctctgcccgaaaggaggccactgttttcttgtctctgtaactgctctgtgaattcttcttcttcctgatgactaagtgtgactattctccaaggtctttatctttttgcaagttttctgagatcttcaccaataagcacgaatacttactgaatatgttttgtgtgccaggcactttttaaagcactttaataacaataactaatgtttattaagcatctactgtgtgccaggcactgcttttggtacaaaagatgtgaaataaaccacacaaagaccatccctcttggaacctatgttttattgagatccagccaggtggtagaacacatcagtaaacaaacatagacttcagcaggtggtgacatgtgctctgaaggagaaatggagtccgagtagagagtgactatgcatgatgaactggtcaaggaaagtctgtctgataagggggtatttgagaagagcacttctccaaggaagtggaggagcaagcccagtttgcttccaatttcttcctccttgtgtcttgccaactgggaccaagcatgcctggcgtggaacaaactctttctgttctctgctgatggagccattttctcccagagcccaggctctaggtctgaaccctgatccttctcttcacttttcttttctaatggccagacgtctttgtccttcctttgaaatagaagtgacagcaaaatcttctttcccacagccgttgtggataggaagcctctgcctggctgagcactttgctactttatttctgaattcctgtgccagcctcctcaatgatcttagctgctagtcttgctcttctcacccatctgtggccaccaaagcactggaacacgtaagccatcatttgagtgcttactccataccacacactggatcctcacaacttgctgatgctattacaatatgttttttttcttttttcctttttctaactttttttttttttttttttttgagatggcgtttcgctcttgtcacctgggctggagtgcaatggcacgatctcagctcactgcaagctctgcctcctaggttcaagcaattctcctgcctcagcctcccgagtagctggaattacaggcgcctgccaccacacctggcttatttttttttgtatttttatagagacggggtttcaccatgttggccaggctggtctcgaactcctgacctcaggtgagccaccctcctcggcctcccatagtgctgggattacaggtgtgggccactgcgcctggccttttttttttaaagttttatttaggttcaggggtacatgtgaaggtttgctatgtaggtaagctcatgtcatggggagttgttgtacagattatttcatcagccaggtgtattaagcctagtacccaataattattttttctgctcctctccttctgccacccccaccctcaagtagaccccagtgtctgctgtttctttttgttcataagttcttatcatttagctcccacttataagagagaacatgcggtatttggttttctgttcctgtgttagtttgctaaggaaaatagcctccagctccatccatgttcccacaagagacatgatcttgttattttttatggctgcatagtatttcatgatatatacgtaccacattttctttacccggtctgtcattaatgggcatttagattgactccaccatgtctttgctattgtgaagagtgctgcagtgaacattcatgtgcatgtgtgtttgtggtagaatgatttctattcctctggctgtatacccagcagtgggattgctgggtcgaatgatagttctgcttttagctctctgaggaattgccatactgctttccacaatggttgaactaatttgtttttcttttacaaagttttttttcaagactagtcaagtacactagtgagaagggagaaaaaagtagagcaaggagtttgatctgtaactgactgaacaatcaatggagatacctcttacctttggaccagttgctattacaattatgattcccattttgcagagaaggaaacagactttcctatggtcacttgctaatacaggaggtggctaagccaggatttgaactcaggtccaatggaatccacaggctccttccagccaccagaccaagcttcacataccctgctgtggagcaccatggagaccctggttcgctctttcactctttggctggctcaggattctttcatgcttcctattatcagtgggataaaagtccaaatgttctggaataatatttgagatctttcatgcctggaccgtacttcacctgtcttctggttttgtatctgagctccctcctgtaacaacctttgctgaacatactcaaatgtatcatggaggtaaacacagcgatgcctacgtttatacagtgagtgctttttctttccctttacctgaactcactctttcttcatgccccagctcagactccacctcctctcttaccttcgtctgtgttcatctatacttccaaactctcctgtcagttagaaggcgtgtcctgcctgtttcatgtcattcctaacatcagaggacatagctcttaaagatcttattaccaacttgccatttccatgaatttccttagcccttgatcctaaactattgagaaagcttacatatccaaaatgagtctaacttttctaagcaatggtcttgggagatgtacatatttcactagggcttcctggagctggaaatatatttggtggagctcctttttctaaattgccttccggctacccaagaaagtcaatttccttctttaatagctgtgactcatttttggactgatgatggcactattccagttcagtcacctatctgagtcatcagtagggactccatttaaaatttgactctttccctaaattgaatcaattctcaagggattaaaactagatattcactagaacattccccaggaaaatttagaaatcagagttctgaaaatgtttgctcaaaatgtcaaggggtgaaactgagagaaggcaactggaacgtttctcttaatccactgtccctcacttacctgcttggcagaaagaaggcgggggaaggaaagcattagaataaaaagagaaatgttcagaggcagtttgagtcatgaggaaacagctaaaacttccaaaacagaaactgaatgacatcctcttcctaattcaagccttcctcaggggaaaattgaacagaacatttcacttgataaatggaatgagacctggtcctggagtatttggaaagatgaatgacaggcaggaggaatacagtggaagggaatgccatttatttacaaatgcatctcctcaggtaagggaggggatttcacagagagagggaggtggaaccgcagagggcttggtccaagttagaacatgaacttactccttgctctcgtttctgggggagaaagccatgtatacctccagcactcagaagtgctcgcgacaatgagctcattgggatttgctactcaattagattctgctttgtacatgtagcacttagcactgtgtctagcacataacgaggactcggtaaatatttgttgaatgaatgaaaaataattgctgcctgggagaagttgagaggctttgtaattctgccctgtcatttctggtagtgaccaccaggtggtgccttcttaagaacaggaggaaataaaatcactccagtgaacacagaaggcttggggttgactcagaaccttgcccctgtgcacaccgtctaacagtacatcacaatttcttgttcctaacgttgaatgtgcacacaggattcagatacgtggctggcactgactttctttacttgagtcaaggtcaagtaaggttttcatcgttggctgagctctgggatttaaaaccagttctatcccaggccaagtgggtttctgttgttcctgcttatcccctgtcctccaggagaacacatgctgcccttgcttccatattttctcagaaattcgtccccagcatcactaatggattcatatccagctcttgcactcacgggttgaaaaacttggtacccctgtgtattttaagcagctacctgatgagtacctatgttgaaataggtttctgtggtcgaaattctcagaaaagtcccacaagatgggcataaatgaacaaactagctcagcaggcttaggtggctctcccaaagtaacacagataagtgagttggcagagaggattccagcccaggacagtctgcccttaggttgtgctgtgatctctattctgttttatgtggagtgagtttaatgtatctgcattaacgagatccagggacaaaaatataacaaaattcaaggaatgtgaagcaatgtcctatagaaggaggacagttcactatcagtgtgagccaacacactcagctcttggcagttttcagacagttgcaaagaaatacttagcctgaggcttcttcgtgcccataaacctaattaagggtactagagattctgattggcaagagctagggacagagaggctgagtgagactatacgtgtccctatgtttctgtatataaagacagaaagagggagtttgagagagcgaatgagttaaatcctaagtagacctggaaaactatcattttgctaggactggacttaagcaaaacagcagagcaaagttcagagttaagccagaactttgccttgaacctcaggcccattgagccctctgctccaacagggccaaatcagcatccaatagtccccttcaagttgtatctgtcccgtgtctcggtgtttctggtttctgttatttggtaggtcacaattaattatacagggttaacaaaaatagattaacataatgtacttgccgaatagtgtttctttgggagaaaatgacttaactcacctaaaatatctccaggcataaaagatattaatgttgggaatatcaggagtgattaacctctgagagaggttgaagggaagcaaaattggacaggaaggataggaggaatggagataggggatttcgggtggggagagcctcttagagtcttttatttcagaccttactctgtgcctttccatagggccaagtctgatcatcctctttttatggtctgaatatctttgagcccttcagaaactttcaaattagtaatatacatgattaatatttttgacacttacatgttaggaactagacattatttcagtaatcctcagaggagccttgagtggtagatgctatcattcttccccctttcttttaaataatgaaatagaggtttaggaagacccaaagctagttgatgtcagagccaagatccaaagcccatgtgtggttataaagccgtgttcttaccactatattatgctgtaagaataaagggacaaacctcaaaataaaagctttcactatcagtaacacagcaaaaaacaattattcattcaataatgagcaggatgaataaaaacagacaaacctcatcacatgaagttgaacttcagagaatagtcgaataaaaagttccctcaaacttaggagaaacctaaggctatgaaactgattgtttcatagccttggtaataagtagccatcaggggccgggcatggtggctcacacctgtaatcccagcactttgggaggccaaggcaggtgaatcacctgaggtcaggagttcgagactagcctggctaacatggtgaaaccctgtctctgttaaaaatatgaaaattagccgggcatggtggcacatgtctgtaatcccagctactgaggaggctgaggcagaagaatcgcttgaacccaggaggcagaggttgcagtgagctgagattgtgccactgcactctagcctgggtgacagacagagactccatctcaaaaagaaaaaaaaaagtagccatcagaacccatttaaaatctgttcatttggtcaacaacaacttgtcttagtgaaagttggttttaaaactggcagaactgaccagtgtcaaatccttacttcagcccatcagggatgcagtttccagtaaacatctctctgagtgccagccaatcaaagaatcaattacagcctcagctgagcacccacgtgctgtcaacccacgtgtgcctctgaacatctcacaaccacagagctccatgctttcaaagccctctaagccatcagccatctgtcctgctcacagacactgtttggccagcatagctctcttctgtgatgagcaatgtattcagccttggagttctgtgtcagatactaagtggtgatctcattgttatttgaaaaaacaagcacacatcagtatgtatgtagtgtatggctacagagacaatagcacaggtaagaggttgggtagggcaggtgctagggggggctactttggatgggaagctcaggagagcctctttgtgggtgcaaggtttatgaagagacctatatgatttgagaagagtccagacattcacagatctaggcctggggcttccaaaaagaaggaaaggtcttaaggtaggagaggatgcctgcgtgtctggggaaggagtagaagaggaggctggagaggaaatgggtggaggctgatccttcagggccttgtgggtcatggcatggtcaggatttgggattttgcttcaagtccaacggggaggcaggaaaccacccagggaaggactatgtcctctgctttaagagagagagagagagagtgtgtgtgtgtgcatgtgtgtataatatacacttgcacatatgtgcatattgaaagaaaggggatggaggcttagggtcaggagtgcctcttagagtctcttactttataccttactgtatatctataaatgcacatacatgcatatatacacacaagttttgcagttaggttcaaagatcctgtagatctagaagaatgtctatgacattgacaatgtgagtcagtacaccctccactgtgtgctaccaaatctgcccaccctcttccactgggagtcccataaatgaagtggttttactaccctgttgtagcccagtgacagatgatcagtgatgtcaaaagcgtgattctggagaggttggtcactttgttgcaaagctgctgtatcatttcaggtacatagtctgggaggtacagagtctagggtcagagtagagtctcaagccattgtgcatgcctgcccaagacagagtggagttggtctactcctgaatatattaaccattttttcccttagtcattacatgtaaagcttcatgtctgcatttgtcagttatgatttatccggatcacctttcttacagaaagcggtagatgccaaccagaagactggaataggcttccttttatctcttttgcacagttgtgtcttcggtgagatgacttgactctctgatgttgagagtgtttttgttaatttttgaagcatgatctcagttggtttaggatatgaatgccatacacactcattgttttcgtttggggactgccgctgtgctgggtgactgcgtgtttgtgctgctggcccttgctgacactgatattggatttacaaagccaaccttgcagttttgtgtgggcaggtaggctgcctttaatttgtggttgctttgcccttctgaaaacacgaacttctatctggttggaagtcattttctttttcatcaatctcaactactgaacctatttcttcaggcacatctccagactgccttggatatttcgaggatatgttctgcgtgttcacatttgaactgcagcttggtttgcagacaccctctccttagattggcagctgtttgtggaattcctgagtaccaattacatccagtagcaggaaataaaagacaaacaaggaactagtagagctcaaggtattctttcatccttcctccttcttagctaatacatcttacagttagctctgaaaggagaatttatttaaacatactaaacactgtgcatagtgactcttacatcttttctggtaatagcatgctaatgctatacttcaaagtgcagtgaataagccctgtagagaaatatcctcatggtatggtttcaaaggacaggcatccttctggaacatattgttatcttaggtttttgttttaaatgtcagcacatggagaccttattctaaggctgcgtctgtgctccgctagtgagtatggaaggcttaggtgattcatggtgggaagttgaagtaactagagaagacttggtgctgtttggctttagtgaaatttttagaagctgtagttgaaaaaccaacacagattggccctctgtttgttgcttttggctgtctagggactgcaaagtaaaaaatgacattttcttgatgtctttctgacagtttctcacctgtaggtcaagtcctaattgaaatatgacataaatatttggcgtcataaaagcagaatctccataacacattaggtgatttctagagtaatgctcacttttattgtttgggttccattgatgagttaggcagggttatattttaagaattttcttacatcaggaagagtcaacagaggatggataacatattttgaacgtggacattgcttgtaagttgcaggacacttgtaaacactattgagtgtcacctatagcaggaaccagtttttctttatccctcgttctgtgacagctacctgggttctatgttggagccccgtagtatagtttcaaatgcaatagccactgcataatccttgtcacccaaagactgcagatcttgacagaacttgtacaacagtggccttgctgaggagtgatgtacatttcttttgtcatttggccacataagaaaactgcagccatcactgtattttgatgcatcagactctgtgtcctctgagtgtgattcagctgttggatttcttgattatgaaagtatctagagtacctcatgttcagtgatgtgaactgctatgaaagttccctccgtgtattctgctggatttcttaagttatatcttcacagagagggcttgcctcttatacagtctgcatccagcacccataagtactttcctttgctgcaggagcaggaactgaacccaactgtggatggagtgggaatgtgtgttctgattcctgcttattagcggtaggatgtgataaatatgttccaaagcaatgcctggtagaagtgttcccctacctgcatgtgacaagaagcattttcctcccttcatttggatagaggaagggctttggataaggaaaaaaaataaagaagatcttggaccttaagctggagacaggaaggtcaagtgctttattttttctgtgatgagaaccagctcatttgagaactgaaggtgaatactgactgtcatatttaataagtagtgatggaatttgcatttcttccttgaggtcagtagtctgctttcatagatagaacaggagtttaaattctgagcaaaatatgcaatcttttctctttctttgattcttatcctgtcaattatctcgtcattctacagaggactaaaaggtaaagagttctaagatcttcgcattgtctgggaagaagtggaaatgttaatattagtctttaataagttattaatgacacatattataattgttaggataactcctaaaaggatagtgaagagcatataacttccatattaatggttaaagatgtgccaaacaatagcaacaaaggaggaggaaaatttgaacattgggataaaagcactgcacacagtggtagatgtaaacacaaatatttcagcaattacattacatataaatggactaaatgatgcaattaaaagataaagacatggatgaaaaaacttttcaggaggcatatttaaaagataaggaaataaaagtttgaaaaaataaaaggatagaaaaatattatgcaaatactaaaggaaagcagctgtaggttggctggtatcagtgttgatcatatcatggacatggttgattatggtatgagtttgtgccttatgttgtaagtattcacaatcagagtttcttatagttagaaaaaattagatgatcaaattataaattactagaaagatttcataattgttaaggtgtaggctttttactgcacctggagaggcctttcagccatgatgtgaattatgtaccattatgtaagataagtggagcgtaaatgctttgttcaaacaattataatgtaattggaaacttcttgtgttaacaatatcattatcttaaaggtgaaaggggtgggaagaatgtggtagaaatcaagttccctggggaataggctttacagccaaaagtaaagtcattttttcctgaccagtgacttagcttaaaacaggtcaatgatattctttaaataaagcaatatttaattggattcatttgcagctgatatggattctggggcttgatagcacttacatattaagctggaaatctagaaataagaactttagcaacaatttttttttttttttttaggatttgagattagttattaataacacaggatgcaagactcttaggttgtagttgtgggtaagcataaatatatactgaatagattcagacattggccaagtagactcagtttttttcaggagatcatgttcattcaaagggataatttcttctttctgaaaaacttctattttgaaaatattaaatgatagaattccccctgaaattttttattgtgctgtttaaggaatggtattttacccattagtgataatccatgaatgcatgctatgaatggatacttaggaaacatttcctgcatgtccatggaaagataattatttttaatatttgtatggactgttaggcttttttctgtgagtaagatgtttttaatgtagaggtgtacttatagagtatacgatttttattgtattcttttaaatggactatttaatataattgacatatttcccatggagtaaaaacactatttagatgcttgtggtaacataactcctcaaatcttagtgacttaagacaacaaaggtttattacatggataatgtagatcaacaggaaactgctcattggaattgaagactccatgctgacactgatgggaggctccatccatgcacaggcactcacagtcaccaaagcagcataggaaaatatggtaatccttgcactggctgttaaagcctttctagaagagaaataacacttgcttatatttcattgaccaaagcaagtcatgtggccatgctaacttcaaagaaggtgggcaagcgcaatcctgtatgtccaggactggactattagggaacagcctaattgactactccagattgctactgacaacacttttttaaatgattgggataatactccaataaatgcctatgccatagtttacagagttagcccattttaatgtttgcagtgccaatagtttattaataatgctgaaatggacattttggtatagtcaccattcctccacactgctccttttctggggtacttaaactaatcctagattaagtctcctgttgtatagtttaatggactgctgtatgtctactttgtagcacttattttctaccaacacgctataaatttcatatagagaccacacctttttttcagtgctgtgtctgctaaccgttacataatagatattaaataaacattaatgaaggaatgaattaattggggaagtgggaagggtaaattggtaaaactactattaaggctttttctatatgtttccaaattgctttccaaaagaattatagcaaattcacatgtgagtcagcagtggtttatcagtttaccacccattgccaccactggttattttcctttgctaaatggaaagtcaaaataaataatatctcaatatttttagcactgtaattggcatatctttgattatcaataagactgggtatttttcatacatttggtttttgttattgtgataaaaacataacaaaagttaccatagtaaccattttttaagtgtacagtaaaatataactatgtgtacattgttgtgccacagatctctggaaacctcattttgcaaacctgaaactctttaaccattgaacagtaacttgtcttcaccctcctccaacacttggcacccaccattctactttttatttctaaaatttcgactacttaagtatacctcatataactagacttatgcagtatttgtttttttgtgactggttaatgttacttagcataatgttctcaaggttcatctatattgtagcttattgccagatttccttctttttaaggctgaataatattttattgcatatatatatgtatatcaaattttaaaatctgttaatccgttgacatttaggttacttctacgaacttggctattgtgaataatgctgtaatatacatggtgtgcacttatctcttcatgattctatttttgattcttttgaatatacagatgcttgacttacagttacgtcctgataaaacccatcatcagttgaaactatcataaggtgaaaatgcgttcaatacaactaaccaattaagcacaatagcttagcctagcctaccttaaacatgctaagaacacttacattagtctatggttgggcaaaatcttccaatacaaagtcaattttatagcaaagtgttaaaattgtcatataatttattaaatactgtaccaatagtaaaaaacaaaatggttgcattggtgggtttttgatgttggttatcatgacaaggtctctcactctgccacccaggctggaatgcagtggtgtgatcacagcttgctgcagcctcaatcccctgggctcaggtaatcctcctacctcaacctcccgagtagctgggactacaggcatgagccaccatgtctggctatttttttttattatttgtagagatggggtctcactatgttgccccagctggtctggaactcctgggctcaagtggtcctcttgccttagcctctcaaagtgctgggattacaggcatgagtcagtgtgctcggctgatgctttggttatttaccctcatgatcatgtggctgactggaaatggtggctctttgccactgccccgaatcataagcgagtatgttactgtatattgctagcctgggaaaagatcaaaatttaaagcatggtttctgctgaatacatatcacattcacaccatcgtaaagttgaaaatagtaagtcaaactgttgtatgttgaggactgtctgtatatctaagggcaggattgctggataatatggcaattctacttttactttttttcagaactgctgtcctgttttccacagcagctgcatggttttatattctccccagcagtgtacaagggttccagtttcttcacctcttcaccaacacttggtattttctgttttgttttttgtttttgtttggttttgatagtggccatcctaacaggcatgaagtgattatggtttttgattagcgttttcttgatgtttagtcatgttgaatatattttcatgatgctcgttagccatttatagtatatcttctttacatagatgtctctattcttcaagtcctttgcccaattttaagattggtttatttgttttgctgtgtgaagagagataattttactccaatttggatgccatttatttattgcctaattgcttgggttaggacttctagtactatgttgacgagaagtggcaggagtgggcctctgtcttgtttctgaacttaaaggaaaagctttcagtttttcaccattaagtttgatgttagctgtgggattttcatatatggtctctgttatcttgaggtaatttctttctattaatgaaattttttgtgtgtttttgtcatgaaagggtattgaattcttttcagtgcttttttttttttggcaccaattcagtcatgtggtttttagccccttattaatgtggtatatcacattgattgatttttgtatgttaagccatcctatcattccaggaatatatcccacttggtcatgatgtataattactttaatgtgctattgaatttggtttgctagtattttgttacgaatgtttgcatcagtatttatcagggatccttgtggttttcttgtagtatctttgtctgctttaggtatcagagtaatgctggcctcaaaaaaatgagtttgaaaattttccatctttttcaatttttttgtaagagtttgagaagaagtggtgccaattcttctttaaatgtttgatataattctccagtgaaaccatctggtccggggcttttctatattgggaggtttttgattacttacttagtttcctttccagttaccatattcccctattatctgagagttcactttctgcagtttcaggtactggcagtcaactgcaatctgaaaatattaaatggaaaattgcggaaataaacaataagctttaaattgcatgtcattctgagtagcatgataaaatctcccactgtcccatttcatcccacccagaacttaaatcatccctttgtccagcatttctacgtatacactactcccccattactgtataggaaaatacatggcatatagagggctcagtactattcagggtttcaggcattcactggcggccttggaatgtattccccatgtataagggggaactgctatattgctatgttcagattgtttattactttatgattcagtcttggtagatggtatgtttgtaggaatttattccttttagattatccaatttactggcatatgcttattcatagcaatatattataatcctttttatttggacatcaggtataatatctcctctttcattttgatttttgttatttgaatcctctatatttagtctgaggatttatcaattctattggtctttaaaaaaactcaatttttgttgtttttttctattatttttctattctctaatttgtttatttttactctagtctttattatttccctctttctcgcaactttgggtttagtttgtttttctagttccttgaggtgtaaagttaggttgttaatttctttcttccttgttaacgtaggtatttactgctataaaattccttcctagtattgcttttgctgcatcctatatgttttgcaatgtgaatctcaattgatagaggtttatttagccaaagtttgaggacatgcccaagaaaaacatgggtcacagtagcatttgtgccctgtgcttttccaaagagcattttgggaacttcagtatttaaaggggaaatagcaaaaatgaggctctgattagtgctcagcacatctacattttatttatttgttttaacttcttaaaattttactttttaaataaacatatggtaaaattgacgttgtatgtgagtacagttctatgaattttgacacatgtatacatttatgtaaccactgccataatgagaatacaaaacagttccgtcaccccagagaactccctcatgtcatccttttgtagtcaatatccctagtcccacccgtaacactaacctttagcaagcactaccctgttacccatcaccaaagttttgtcttttccacaaggtcacataaatgaaatcctaccgtatataatcttttgagactggcgtctttcactctgcataatgcctcgaagactcatccaagttgttgcatgtaaacatattattattattattattattattattatggctgagcagaattccactgtgtgaacataacccgttttgttttgttttgttttgttttgtttttcacccattgtagagcatttggctgtttccagtttttgataattaagaattaagcttctataatcattcttatacaggttttggggtacagatatgttttcatattgtaatgcttaggtaattcctagaagtaaggttgctgagtcaaccggtagatgtgcctgtaactttatgagaaactgccacactgtttgccagagtattttcaaatttcagccattctaatatgtgtatagggtattttatcatgattttaatctacatttttcaaatggccaatgatgctgaacatcttttcatgtgcttatttgccgaccctacgtcccctttggtgaagtgtctgttcaggtcttttgctcattttaaaaattggactgcttgttctctcaatattgagttttgagagtccttaatatattctgagtgcaagtattttgctggatatgtgatctgtaaatattttctcccagtctgtagtttgcctttttattcttttaacagtgtctttctaaaaacaaggttttaattatgatggtgtgatttattttttctgttatagatcatgatttacccctttagttataaaaattttataattttatattttacatttaaatgtgtaacttagtttgagttaattttggtataaggtattgagaggtgtagccagctgggcttctgggtcaggtggggacttggagaactttcctgtgtctagctgaaggattgtaaatacaccaatcagcactctgtaaaaacacaccaatcagcgctttgtgtctagctaaaagattgtaaatgcactaatcagcactctgtaaaaacgtaccaatcagtgctttatgtctagctaaaggattgtaaatgcaccaatcagcactctgtaaaatggaccaatcagcaggacatagatggggccaaataagggaataaaagctggccacccaagccagcagcagcaacctgctcgggtcccttccatccacactgtggaagctttgttctttcactcttcacaataaatcttgctgctgctcactctttgggtccgcaccacctttaagagctgtaacactcactgcgaaggtctgcggcttcattcttgaaatcagcgaggccgtgaactcaccagaaggaagaaactctggatacatctgaaggaacaaactccagacacaccatctttaagagctgtaacactcaccacgaaggtcccaattcttgaagtcagtgagaccaagaacctaccagaaggaaccaactccagacacagtatgagatttaggtcaaggttcattttcttgcatttagatgtttgaatgcttcaaacaccgtttattcagaagactgtcctttctctgatgaattgcctctgcaaatttatcaaaaactcagttggtaaaactgtagttgcccatgggtatatgcagcagagcagaactttctgaagtaatggaaatgggaatacacgttacagggtgtgttatgtgggcatatgcatttgtcaaaacatcaatttacacactttaagtcagtgaattttactgtatgtgagttatacttcaattaaaatatcagttggccatatttctgtaggtttatttctggaagtctattctatgctgttgatctacatgtttatctttttgccaataccatgctgtctttattttttattattttattttatttttgagattgaggctcgctctgttgcccaggctggagtgcaatggtgcaatctcagtcactgcaacctctgcctcccaggttcaagctattctcctgcttcagcctcccaagtagctgggactccaggcacatgccaccatgcctggctaatttttgtatttttaatagagacgaggtttcaccatgttggccagtcttgtcttgaactcctggcctcaatcaatccgcctgcctcagcctcccaaagtgctgggattacaggtctgagccactcccggccaaccatgctatcttgatctcaattactttagctttatagaaaccttgatgaagtggaaaagtgtgattcctccaactctgttctttttcaaaattgttttggctattcttgtttctttgcctttccatatacctttagaatcaccttagttctacctacaaaaatcttgttgggattttgattaggtttgtgctaaatttatagattaattaggggaagattcacatcttcacaatactatcttccaattttgaacatagtatgtttttttcatttatttaggtcctctttatttcattagcattttatagttttcagcataccctctaattgtttacataaatatttattagatttatatgtaagtatttcaattttttggaattgttttaaatatcatttttggagttattttaaacagcatttaaaaaatatttggtttccagctccttattgctaacacataaaaatatgatccatttttttacatgtactctacaactttgctaaatacattcattagttgtaggaggtttgtatgtatgctatttcttgggatttttcatgtaaacaataatttcatttgtgaacagggacagttttatttcttcttttccagtcaggatatctttatttcttttccttgcctgattgctctggcttggaattccagtatggtgtgaaataggaatggagatagaagtttgccttgttttcattcacaggaggaaagcattcagtcttcatcattagatgtgatccttgttggttttccaatgatatgtcctttattaggttgacaaaagtctctttttgtagcaaatctacattttacatgtcaaaagagggagtagatgaaaaaagtaaattacatattcatctcatactcagtgaatctacattttactaaataagttgaagtaaacataaaaagaggaagcagaggaaaagtcaattatgcattaatctcagggtaggtgaagagataatttctggtcttgtccttgtcctgtacccgcaaagataagctggtagttgacattgtgagggtgagagtcaacagagctcagttttagggctagtttataggagggatatagatcctgaacgatttagggcctcacgtttatacttattgtatcttccctatgaattggcccttttattgttgtataatgtccttttttgtttcttctgacagttttgacttaaaatctatttgtctaatattggtatagctacctctgttctcttttggttactatgtgcatggaatatctttttccattctttcatttcagcttatgtgtgccattatatctaaagggaatctcttgtatacatcagatagtgaggtcttgttttttaattccttcagccattctgtcttttgattgaggcatttaatccatttacattgaagcaattactgattgggagagactttctgttgtcattttgttaactgtattctgtatatgttgtatctatctattcctcttttcctttttcctttttatttgctgccttcttttgtgtttcattgatttttttttttttttttttggtgacatgctttaattcctttctcattttcttttgtatgtcttctataggtattttctttgcggttgctatggagattacaaaaaacatcttatagttgtaacaatctattttaaactgttaactacctaactttgatcacataaaattcctttacatcccccgtcctactttgttaccaatctttcaaattatacctttttatattgcatatccaatcaagctttcaaactatatccttttatattgcatatccatttatagagttttataattgtagttattttttaagcttttatcttttaaattctataccagaatttaaaatgacatacaacctaccagtacagtattacagaattctgtatttgtctatatattgacctttaccagggagcttacattttcatatgctttcatattgatatctaggatcctttcatttgaaggacttccattagcatttcctgtaaggcaggtctagtggggatgaactctcccagcctttgtttatttctccttcatttttgagtgacagcttttttggccatggtattttgtgttggcttttttttttcttttagcatgttgagtatattatctcacttccttctggcgtataaactttctgctgagaaatctgctgataatcctatggaagatttcatgtacatgatgacttacttttctcttgctgtttttcaagattctctctttgtttttgattttgacagtttgattataatgtgcctcagtttaggctcttcaggttcatcctagttggagtttattgactttcttgaatttagatgttctttttccccctagatttgggaagttttcagtcattattttctcctttctctcactgttctttctcagggactctcataatgtgtatattgatctgctcaatggtgtttctttctttgtttcttttttggctttgactagaaaatttcaaatgacctatcttcaaattcattgattctgttttgctcttgatcaagtgtgctgttaaactcctctggtaaatcttccaattcagttgttgtattcttcagctcaagaatttgttaggttcttttttaaaatagtttctatttatattctcattttattcattcttcattttttggatggtttattttttattgctggttgtctgtacacccagttaactctttaaacttctttaagatggttattttgaatcctttgtcaggtaatttatagatatctgtttttctgatctgcttttggagatttattttattcctttgattgggccatgttcccctgattcttcatatgcattgatttttgctgggatttgggcatttgaaaaacaactacaacaaccagctcttccagtcttaatggactggctttgtgtaggggaagacctttaccagtcagcctggctagagattctgagggtctctgcgaccttctctggagatgtgtcttgtctgggcttgcatgtaatttcccaattagagaagtttgctaatttctttttcaacagtttgtgttctcttgctttctctgtgacactccacagtactgtaggttctccggtacagcaagaaaacatcaagttcttttgttctctgcagccctagatgtccaaagtataccagtttcccgttagagtctgtgttaagcaaaacagaaactagtctcttaggcagccccctgaaaaactggaacactggatgtgcattcactcctcttttcctcccaaaggagaagctctgagtaggttgttttctcccaattcattgagctgtgccagcctggggaaaggctaagaatagcaaaataaaatgacttttcctacctgttttaattctgctgttcttcactttgtatttgcctaggggcactgtggtttcataactggtttctggaggtcttataaaggcattttgtacaatatattgttggtaagtctgtggggggtgggcagggaatgagatctggggcatcctattttgtaatcttacttatatcacctcccaggaagatcaaattttatacttatcagtgtatgagagtagaaatgtcattgtattggggggtcagtagataagattccatatctgtttctatcactaatgatagaactactgctaaattataaaaatgtaaaatggtgctagaatagagattagagtaacatatttttgaaactttaaaatctgaaggaatttactgcttaacttctgcctactttcagggtattaatactagagaaatttcctctaatactttcctttttctttttctttttcttttttttttttttttgagatagagtcttattctgttgcccaggatagagggcagtggtgcagtctcagtttaccgcaacctctgcctcccaggttcaagcaattctcctgcctcagcctcccgagtagttgggattagaggtgcatgccaccatgcctggctaattttttgtatttttagtagagatggggtttcaccatgttggccaggctggtctcaaactcctgatctcagatgatcctcctgcttcggcctcacaaagtgctgggattatgggcatgagccaccgcacccagcctctaatacttttctaattatgaacctgatgaatgcttagtaggatatatatgtaaatcatctgcaattcattcaacatgagtaattactgttaacattttatagtattttctttacattttgtatgtatctgtataatgtattcaaaattatgtatatttaaatgttctctatacacagatctgtttgctctctgatcaccaggctttatataataaactttttttttcatgttaaacattcactggtttttcaatatctgcatattttcctaataatatattgctgtaatatacctcatttgaccatgtaaccatatctcatatttctattttgggaggttattataaatatggggccatgaaaatgtttgtagaaatattctatatgcttttaaaatatcctgttttcttcaagtagattgctggagatggaatttctaggtcaaagaataatgtggacataaatgattttagaactttttctacctttgccagttacctttgaaaaagtgtgagagtgttacattgcttttgtttctcatgaatactatcttttaaaaattttagctaacttgataggtaattttatttgtatttctttgaacattaattctgcttctgtggcttgtttattcttatcccctttgcccttttctttattgtgatattggaaatgtccctttcaattagtttttactctttatttattaagggtgttaatactttttttagatttgtggtaaatattttcccctgattcgtagtctgcatagcttttaattgtcttatgttattgtgggttgaaacttttatttagtcaaatttgtacaactttctttagtaacttttttcctttgctgttgtgcctgcagtcacacaccatccagatattaatcacctagattttaaattttctatatatatacaaatttctgactatactatattccttctctatgaataacctcttttaacatttttttgatgggcaaatttgctggcaatgaattccctcagtttttgtttgtatgaaaaagtctttattttttcttcacttttgaaggataactttgctgaatatagaaatctatgttggtggactccccccatttaacacattaaatatttttctccattctcttcttgcatggtttctaacaaaatgtctgctgcaactttcatcctctatagatgtttccctccttttggcttctttcaaaatttcttatttgactttggctttcagcagtataaatatgatagcccaggtgtaggtatttttgacatttattgtgcttagtggtggtctctaagcttcctagattggtattttggtgtctgtcatttattttggaaagttcttggtcattattccttcaacatttcttttgcttcattctttcttccccttctgttcagttacacacatgtcgcacctttgcaattattccacagttcttggaaggtcgctgctgctgtcactgctgctgctccttcctactcctcctcttccttgttccgcttctcctcctcctcctctctttttcttctctgcccacctcccactctgttttcttctctctttgcatttttatctgggaggtgtctattgagctatcttcaagttctctgattctttcttcagccatgactagtctcctcatgagcccatcaaaaacattcttcacttctgtttgtctgatttctagcaattcctttagattctctcttacagtttccatttccctgttgacattacctgtctgttcttgcatattgtctgcttttcccatcagtgttcttaacatactgtgatagttaattttaggtgtcaacttgactttagaagggatacccagatagctagaaaagcattatttttgggtatgtctatgagggtgtttctggaagaaattggcatttgaatcagcgtactgaataagaaagatctgccctgccccaatattgacaggcaccattcagtcagctgaggtcccagatacaacaaaaagggagaggagaaatgaattcatattctctttctctccccttctctctcttccttcctccctctccctctccttttccctctctccctcccttctagagctgagacattcatctgcttctgatcttgaacatcagaactccaggttcttggctgggtgcggtggctcatgcctgtaatcccagcactttgggaggccgaggcaggcggatcacttgaggtcaggagtttgaaaccagcctggccaacatggtgagactctgtctctactaaaaatacaaaaaaataagctgagtgtggtggtgggtgcctgtaatcccagctacttgggaggctgaggcaggagaatcacttgaacttgggaggtggaggttgcagtgagccgagatgatgccactgcactccagcctgggcaacatagtaagactccgtctcaaaaaacaaaaaaaaccaaactaacaaaaaaacccaaaaaactccaggttctccaccctagggattctgggtcttgtatctgcagtcccgcagtttcttaggccttcagccttggactgagagttacattgttggctcttctgattctcaggcttttgagcttggactgagccatgctaccagcttccctggttctccagcttgcagatggcgtactatgggacttcccagcctccataatcagatttaattcccctgatgaatcccctcttgtctatctatttatcctattggttctgtttctcaggagaaccctaatacacatattaatcatagttattttaaatttcctatccgataagtccagtatttatctggtttgattattactttgcctcttcaaattgttttttcttgccttttagcatgccttgtaattttcattgaaagctgaaaataatggattgggtaatagacctttagtataaggttttatgttaatctagactagattaatcacagactacagttggcctgtgtttagtatttgctgtagctgtaggtgccagaggcttcaaattcctctggcgtcattgtttcagtctcccctgttgtctttgggattccctaagaactcctcagatagagtttgcatcttgcagctcttttagacgtaatctaatgtaatctgttattttactggtgaggtatggtgctaaggtgtagggaaggggaaacattctgtaatcttaggactacataccagtttcttagtgggcttgcattcatggcctatgaccttcacaagtgtttcttagcttttattttcttaaagaaaaaaaaaaaagctcccataatgagataggaaggctagagggggccagagtaggaggaatgtccttccctcaggtggataaggctctggtaaagtctttttggattccactctggagagtaggcctttatttttgaaactcctctgggcatatttcacaatagttaccattagggatggaatatttgtgtccccccacgcccccgcaccccgccaagtttatatgtggaagtcctgacacccaatatgagtgtgtgtggtaggctgcgtgtggaggtattgggaaattcaggttcccaaaagtttggtcgtagtgaagtcctcagaggtcttcttgagtctttccttttcttcaccaaaggctcactgacgtcatccatcctcctgatggaggtcaaagcattaaagtcatttttctccctaggagcgtctcccccattgccaaattgccaggctagtattagggagaaatgtcctccctgaatttcattgttgggtttttttttttttttttttaaaccttattatggctttaatgttgaaatttctgttttggactttttagcatgacacatacacacacctctcattttattttcattgctttttaaactcccatgtccaatgtctattttaatcttatgtttggcagcctgaaacattttatttctaaaattaattctctaattatacaacatctacatggcttgtaatgacatcagtagagcagaatctagaatccaactcaaggttttcgttttgttttttaagagtaagtaacttattttgatcaatgtagtaagaggagattgaaaggtaccagtgtgtgtgaaagtgaatagttgcttcctctccccatctcctcttcttcctcccctgctcctctcctcttcttcctccccctcctttcctcttcctcctcccccaacccttcttccttctactcttcctcctcctctgcttattccttcatcttaactcatccttcactaaaaagagttatattagcattagaagtattccttaatggctatacttttcagatattataacttcagaattttctagccaataacaggattctagggcaaatgtcatgtaggatatggctcttcgagtaccaacatggcaagaaattgatttcctctattgaagacacattgattttcagctgtactgaaaaactcacagccttccagtatcgacaaatagtaaaaattgacttcacataataacacctttatttacctagccttgtgaccctctgattttgttagatgatcctatggtgaaagaatgcaccaggaccaatgcttggacaaatagtaagtctccattttctttatagtagatgcttctacataaaattccgctttgggcagtaacttgcgtagacagctgttcttgtgacacgacataatgcacactgagcacggtgacagctccagacgatggtctactctggagtttccaactggactggtaatctactggatactctcatctggaattgtctcctagctgagtggttaagctatagaagcccatgattaaacaatgttgtttctggaaagaataatagaaatggttattattagtgagtacttactgtctgccaggccctgcactaagggctttttatgtgttagttttgtttaatccccacaatatatctaagaggtattatcccccttttcccgtgaggacactgaaggtccaacagctaataagtgaagctggcgatatgtcctgttttagctactaacatttatcagcttcatcatacagacatactttgtcagattggttagccaggcaagtgaccgctgagagaatggggcacaggagaagtaagtgatgactgcgaacacaggctggacaaagatcactttcttatacgagtctgcagttcttgaaataatacctatcagatatggcattaacagtgattggtagccttatccaaatgcgatatttgacttttgccttcatatcatggtttgaatttacaaacttcatttctttttctttttttttgagatggaatctcgctcttgtcacccaggctggactgcaatggcgcgctcagttcactgcaacctctgcctcccgagttcaagtgattctcatgcctcagcctccagagtagctgggattacaggcatgtgccactatgcccagctaatttttgtttttttttttttttttttttttagtagagacagagtttcaccatgttggccaggctggtcttgaactcctgacaaacttcagatgggggcattgccttaagtgtatgatgcccaccattgaggtagactaccacatggtacctggatgagcatcttatgtttcaccaaaccagaaatttcccaggcaaagtgaacggaacaagagagactgcggattcagacgtttcctatgcagttatacttctgaatgggtagtcacagtgtgttcaagggtaaatgatagctaaattatcacccatctttaaatgttttcactttaacggggttaccaaatcgctctttaaacttgaatttctatcaagcttcagaaccataaatgttttcttagaatttttccaagattatctgaatcagtgagtcctttaactcacttctccaggtatcaaaagtcttttaagtcttttttctgccaaaggtgaatctatgctaacgccttctagtactgattctcctttccattttcccatgcaccctactgctttctgtctccctttgcaattcaacagaaagagaaatcatgaggcagtatgaaatgaaggacttttctgggctgattttccttttgaatcagaatggaaatttatggtcatagtgctttccatgaggtatttagaagtttccagtcaatcattgctcttatcaggggttcttaaaggctttgggagatactaggttagctttcttacaatataggctgccctttgttacagcgacactttctttttgcagattttttttttcttaacagagaaaattgagatatgaaattatttccttaatctctacaataatcaaatcataattatttctattctattttttaaacttttaaatttcactaacagtacatagccattgcagtaatttttttaaaaaatagagaggagcttaaaaataacaaaaacctctataatcccatcacccagagatgagttttggccccattcatctcacaagttctgtgcaactattgcatttcatgttgcctattcatattaagagaatagcattacttttattatgatgatgatttgtaaacaatttcccagagttaattcccagacatttaaaaattttggccataattgaaagtcaggattttatcttctcagttggaaagtagaagagaaaagtataacagtgaaaaaaatttttcttaggtgtgtatttgtgttggattgttctaatttcaaaacagagaaagttttgaactcctgctttcatggttcattcttagaaataaatagaattgttttcccaagaaaaccttggaaaactttctagtaatagcaggaggaatatgggagtaggaaatggcaagttgaaggattttaatttggaaactgccaccttttggaatacagaagagctggttatgggattggcccctggctttacttgtccttaacatgggctttgataaggggaaaacaaagtgagggcttcgagccacaagtcaaggtcttgggaaagcttagcaaaatggtgcaagtctctcgtgatatctacctttatgcttactgctttctattggcaaaaatctctcatcttttgcagatgcactgagatcccatcagtagacagagaaagaacgtgggtgagtcagaagcaatcagccagaagcacacaaatgggtgtggacatgtcactgccaacaacccacacagagtggctggctactgcattcacccttaggatctcctaatgagcacagttaacagtagttggagctttgtctctgacatcctcttgcagtcatctgccttatttgctgattgatttctgttcttgaaactctgaacaggaagccttctgttgactcatccctgcttttcagactggaaagcacttgtaattttatctgccatgtatagtctctaaaaatttattttgaagatatgctgtatcaaaagcaatttaagaaagtaggaaggtaggaaatataacaaccaaaaccaaacagtgacactaaatatatacatatatatagctgtacactagacttaacctaaactgaccagctagatgattttgatgcagtaaagacaagttaagaaaatttgtctttactgtcaacaagacagtaaacttgtctctatgtcaacaagaaaaaaggcaattagaaattcttggaaaaacagaaatttgcaaatgaagtcccaatttaatatgaggtaaactgaaatgtgacagaattctgcataattgatggtatataagaaaaaagaaaaaagaatacattggaacttgacgcttacagctagtatggtgacaacggactatatctcctttaactgatttagtttcaccatctggaactgcactgaataaaaatatttacctaattgtaatactgaatatattttattagttttcatttttcataattaacctgtatgcaaagcatggaagataaattatatttgctgaacaaaatggaaatattctaaaacttgatgttgtaaattaatgcttattataggtgataaaatgtaagggggggattgaggtggaatggagtacaagagcatatgttttcttctgtttcatagtggatggttgaaatggtactctttagtcttgatacatagagaagtagagatttaggaatatgattacatgattaaggtaacaaatgaaagattatatatctgaagaggacagaggggaaaggagatgctgtgtctcaaaattgtgttctcctctagcagggaatcaatataccgttgacccttgaacaacacgggtttgaattcaggagtcctcttatatcccagtcttttttaaaccaaacatgaattgaaaatacagtattcccaggatgcaaagcctgtgtatagggagggctgactttgcgcatatgcagattctgcaggtggactgcaggacttgagtatgcctggattttggtatatgcaacaggtcctggaaccaatcccccaagtgagtatactgaggggcgactggattgtttcacttttgtagaggcatatgggagttaggcagccttgtgcttttcatactatgttcttgtttaatttctggggttttttgtttgtatttttgttatccatgtacatcttttgaaactgaaaaaatggtgatcagatgatttacaagaaactttgattaacaattatactagcacaactttgttaaatttccctaggagaagacaacagcctcaaatgcagtgggaaaaaaaagcaaaatctgcctgcttccacattgttttcaaggagagcacttgaacaaaatggtactatttggacaataaatagatgggtaccaattctagacaagcacaagcaaaaagaaaacagggctggcagtattcgcatgggggcaatttcaagacagaaagcattaagtggacaaaaggtgatattttgtaatggtaggggttagaatccaccaagaatttatacagccatggttctttacgtatggaaaattagcgccgaaattggtaaaggaaaaactgttaggagataaaagaattaaagaataaggcaaaaaatattagtacttagaaaattataatagccaatggtataatttaaggtatgaaaataaaacaaacaaaagtctgcacctgcaaaggaaacttgaaaggcagggctgttggggatggggtgtgtgtggcggtgaaaggggtacagatagtttatcctaatcataggttttaatcactttcttgtagaaggaaggaaaagttttatttctgtgacaccatctcattgtaaaatccagtaaaattgaaaactttgagataaatgtattatcaggagttacagccataacttttagtatgtgagctataaattctgttcttatcactaagtcactgagaactaaggctgctgattttcccaacatagtaaaacagagcgacctgaccaaaaaatgaaaaacatttttatggacttttattctccttcctgcaaccctaatctccttccttcctctatagattctagtctatctaagaaattctaggtggatggtttgctttctctgagggaagctaagattgaggccaaaaggagatctgctaggtacctgtgcaaacgtcaggtgggacagtgaatagaaagtaggcatgcaggggaccgagaaagataggctctgggcatcacaaacagcttttccaactctagagacttgaaaaatgtatttggagttacatctaagtcagaagagtacatcttgtttatccccccaaaaagcctcctggtatataccttttagtcaaatagcattgtgatcttgtcacaatatatggacaacagatattttcagttcatttgatacttaacatagaacatattaatgtgccattttatcagaaacctgtaaaggagtttaataatggataactagaatgaacataagtggtagcaggtccttactctcatcccccctcccacttttcataatgtactgatttgaaatgttcgtgaaatcaatacagacaaattaactcagtgagcagcttctccccagtctcttgctgcagtgatgagaagcctctttctggatctacttgtttccagatggtagacaaggcttattctgacacatggactgaaaacagggcagaccagcagtcggaatcttccctgcttagtgtcttaatctatagtaagacctcaaagaattagattccctagcatgaggaatttttcttactgaattttttaatgccactatatggcagtgattaaatagcaagttcaagtgattaaatctggtccatctctatacttttcctttacaattgctatcaggttttgtaagtaaggaagtggaggcatttttgtaagtgtgttaactctcaaagcccacaaaagtatgtttttaaacttagggatcaagttgtgtggatccgatttcagacccccagaggttcttccaatgtgtctaatgtccaggacagtgcacatgttcagagtttcattgtatttttctttctttctttctttctttctttctttctttctttctttctttctttctttctttctctctctctctctctctctctttctttccttctttctttctttccccctccctccctccctccctccctccctccctccctccctccctccctcccttccttccttccttccttccttccttccttccttccttccttccttcctttctttttttgatggagtctcgctctgtcaccaggctggagtgcagtggcatgatcttggctcactgcaacctccacctcccaggttcgagcgattctcctgcctcaacctcccgagtagctggggctacagctgcccaccaccacgcctggctaattttcgtatttttagtagagacggagtttcaccatattggccaggctggtctcgatctcttgaccttgtgatctgcccgcctctgcctcccgaagtgctgggattacaggcatgagccaccgcacccagccagcagcatgttttctttgaagtgttgttcaggggtctcttgcatcagaatgtcctgaactgcttgttgggaatgcagtatcctgatcctaccctccagattctgattcagtaagcctggactgagccttggaaatctgcattttatttagcataatgtcctgggggcttgggggctccccaaagtttgaaaaccaccgctaagggctattatgtttctgtaggcaaacctatttttctgttttcattttatgtcatacaaagtaggagtttaagaatttatttttggtgaaactagaacactgtcttcaaattaataagagccttgttgtgtaggagaaatattctcttcaaaatctctccacgaaattgatctcaaaaagactggctgagtcaaatgctaaacagatctgtcctgtatctggctgccacctgtcaaaattgctgaccttacacttatgtattcaaatgcttcctggaagtcaaaacatattttcaaaagtttctagtggaaaagaactaagcctgtcgcttggttttaaaaggtggaaattgagataagaccgaatggttgagattaatttcacatcacaagaataggggtgagaagagaatagcaatttccataacttctatcatttatcttttaggttgaggatactgtgaaataatccttccctttccaaccaacatgaagatgactgatacacccatcatactgaaggattcctactgtgtcagagattacattatattaagtccttacagaaatataaagagtataaccttcaaaaaactgggaattgttaaattatacattggattttgggggctattgtttgggaggttttgttttgttttgttttgtttttccttctttcataacagttcgctcaattaactataccagaggcatctttggctgcaaaggtggaggaatcactgtgctcgaagatgacagttctacaccttggcctgacagttttgagattcttgcttctaaaataagatggaacctgaaagatgggatgattctagcatactaagtatttgactttaattggaatcattgaacgtcccttgaattttttttctcattggtattggattctgttgtctttactgatggaaatttcttttccttccattcttggttcatgacaaaccaccaactgtccacgcatgatctcctttcattttacttgtatttgaaatgaaaacctgtgagtgcaatgcctaatctaagaatcagaacattattcttttatacccctatctctgtaattctcctttatcttactccttcacctccccatccctctgccaccagaggtaaccaccattctgaacattgtttatcattctcttgcttcacccctacatatctacatgtagccttaagcaatacattgtttcattttgcctggctttgaactttatgaagaggtatcatccctggcttatatgatctcttgagacttgctgtttcactcagccttatattcctaagattcatccatgctgtcattgctgtgtagtatttttatttgtgcttatactgcagtttttctataaatgttagtataggttatactatgatttatcaatactcatgtcattgggcattcagggtgtttcctgtttttgtatctatgagcagagctgttagtaagcatttgcgtctcctggcatgcatgtgccgaggtttcccttgtgtctatgcttagaggaagtacagcaaccactgctgtgttgtggtgtatgaaatcattcaactttacaaaagaatgggaaagcgctttcagggtcgctatatccatttacacttccaccagaggtgcagaaaagatcctatcagttcacctcttcaccaactctttgtattttcagacatcaattttttttttgccaattttgtgtttataaatctactgatatacttcttaagtattttatctatcccttaggaaaaaaggtaggaaatagaatgtggttgccttcacatagagaggctagaaaacaaagtatcatgcctgcttagtttgatggcacccaaatttttctcccagttatctcactactagtagttgacattcttttctcaccctcgctagaaatatgaaaaccttgcctctgcacagtggaatcccttggaacatttaaaaaatgctaatgtctggaccccacctccagagactctgatttctttggagcccagcattgaacatagggatttttttttttaaataaaagcttcccaggtgattctaacgtgcagtcaaggttgagaatcactgctttaaaatacagaaatcttgacaagcaagcataagctcagggtagcctgatattgttaattgttctttttctcatttctaaagtacaaagtttgcataattttggagaatcctcttgcctctaatttctagctcagcagcctttgagagttttttggtttttgttttggtgtttgttgttggtagaagtaaatagtagaaattcaataaaagttagtatgggctagaaattgtgcttgacatttatttttttcttataactgtggatctcaaagtttagtgtgcataagaaacacctgggaagcattttgttttgttttacaatgcggattttgattcagtaagtcttggcgtgagcccccgggaatctgtgttctaacaaagtgattatgatgtaggtggttctagaatcacctttggataaaaactgcctcataataatcctacagtataagcagtattctcatttacagatggggggatgtgaagcccagagaagttaagaagcctgcgccgtgtcacagagctccctaggggactagcctttgctctgtaagctctcagccctgctcatagtatgcctccaacaaggctctcagaatttaggaaagtctgctttggaacatgtgttatcttctctatacttacattctttcttaatctgccatgactttctctcctcatcaaaaaacagcctttaatctcctacccaaatccacctcgtacctgtgagtcttcaggtgtgttacactctgaacatggtcccgtgagagaatttcttattaaaaattgagcttgcaaaaaatcaaatgtgttatatttttgttcttatttcaccctaaaacaatgactttagttgacaatcacttttatgcaaccttagtaattatttctaaactcatgtacaagtggatggaagtatttctgtgcacatttagaaaatttatattcattgcttgtttccctcccctgccaccccacagagtgaggactttaccatgaaatctgggcctttggcctatgtatttttaatcatgttcatattgtactgtatctgcaaccatctgtaatacagctgtatatgtttacatgaaacacaataaacttttaagtttaattccatttgtgagcagatggtagcttgtcaaggaaacatttgatcatgtttatgtctgtatttggccacaaaaacctcataattactctcattaattacatatccttttcatgttacctgtaataaatgctaaggtatcatatgtgttggccttgtgggatatatttttgtatgtagagacagtcctcttaagaatgtttgcggcctggagcagtggctccgacttgtaatccaagcactttggaaggccgaggcaggcggatcacttgaggtcaggagttcgagaccagcctaggcaacatggtgaaaccccatctctactaaaaatacaaaaattagctgggtgtggtggcaggtgcctgtaatcccagcttcttgggaggctgagggaggtgaattgcttgaacctgggaggcagaggtttcagtgagctaagatcgtgccattgcactctagcctgagtgacagagtgagactctatctgaaaaaaaaaaaaaaaaaaaaaaaaaaagaatgtttgcttctgtaggcacatttatgtctacctattatgatgtcaagggtgtattccagtttgtatctgtagctgctacaagaagggtgtcatgggatctgtggttacactcttactcttcccatctgggtatttctgagtgtatttgctccaggagagccactggttctgctggcctacatgcaaagtgtatctatctctctgttaatgcgtttcccatgatgatactcgctgctgagatacttcctaggaagttttgctttcctatcacctcctttaagtgctttcctttaagtgttctcattttaactcattattaaactagcagacttgattgcagtgaatttttcttaaataacttaattgtagggccttttgcgcgtcattttgtgctcctacttactgctcagaggtggtacaaagtcagcagctcaagagacagacctgccacccatgatctctcctccaagttctcaggatgttcagaaagttaaaatttcactctgtcgagtttccatctggcttggcaatcaatgccggattagctccaaatactctttccaagtctcttgaaggatgtgctagcctctgttttgaattctacttcaggatcacaccatctctgcatgcaagaatgacatatctgagtgactgccactaaacccacatggtggaagtgtttgcttatcctgctatgtgatgctggctatcatattgtcagtttatgaggtgtttttttttttttttgcttgtcttcttccatgtaagtatttccagagcagaggcattggcttgcagaaggtgtgcctgcaatcagtccagcttccccagatgtgctgaggcttcaacaggggtttttaaaacttgtgctagaatactcatcttccaaaaaatctttaagttgatgcaatataatagctgccaattgagcatacattttgaggtagttttctttaatgggagtatatgctcatccacactctctttccagtgttaaatattttaagacagctggttagagttgagggtgccttttttttggtcataaaacgatgacagaactctaaaatcacatggttatttatcaacattaaaaacattcttttatatccattaattaatttattctttataacagcttctgtggaataggtatataaagggtttttttttttgtctactgttatttaagagtatcataaaacctgagaaagaaaaacataattagttgtcatctagtctaatgctctcattttgcagataaataaattgaagttcagagagatgaagtcactcacttatggacctatagctagtgaatggccctgaaattgtttcccagtcatggctggaggcacaactttgtctgagacctgactgatacttttgactatgtgatgttgtgtcaattatctaacacttctggacctcagtttctttacccatattatggattattgtgaatattatattagactacatccaagaatgctattaacccagggcctaccatcaaataagtagttaatttatatcagccacttcacagctgcacttatttttatttttattttttctgagacagagtctcgctctgttgcccatgatggagtacagtggtgtgatcttggctcactgcaacctctacctcctgggctcaactgattcttgtgcctcagcctcccaagtagccgggactacaggtgccaccatgcctggctaatttttgtatttttagtagagacggggttttgccatgttagctaggctggtcttgaactcctgatctcaagtgatccgcctgcctcagcctcccacagtgctgggattacaggcgtgagccaccgcgccttcctgctgtgcttattttcaatactcttttctcagggatcttggtaaccagagcagaatggcagtttttcagctcttacaatgcctttgtttagaagtcttgtatgtgtatatctgctccatcacttaaaagttctcctaatgcaatttggaagggtttaatatggaacaagagcagggactttgggatggagtctaatgataacttgtcacatgttcttttagaagctgaattaggtagtttttgccttactggtgcgctctcatttaactgtgaggtatcctggcacttcaaacaggtaccatatggtaactgttttgtgttttaagcctggtactgtttagaacacatgcttcagagagtggtcattgtttcgctgccacccagttaaggcatgtgttacctcttgttatggatggaatgcctgtgagccctaggttcctatgttgaagccctaacccccagtgtgatggtatttggagatgaggcatttgggaggtgggtaaggttagattagctcatgatggtgggaccctcttgatgggattcatggccttataataagaggccatgtgaacacagagaaaaggtcatgtaaggactcggcagaaaggtggccatctgcaagccaggaagggaggcctccctagaagccagacactgcctgatcttgatcttggactttccaggcttgagaactgtgttgtttaagcccctcagtctgtgatattttgttatggtagctgggcttgaacagactgagagacctctgctggagtgtgcgttgttcaatgatttacttccttgtttgcctacattatacactttcactatgtctccacgatggaagaggcatgactgttcagatgcatcggggttcgtctctacctaccaaggtcctgtgccatgaggagatgtcgggccagggactcaaacaggagcagtcatccaactcctttctattaggtctttggtgatttaaaatctcatatgaatcaagagctggtagagtgctaatgttcacaggtttttatagaacattaaagctctgtaatagttattttgtatgttatataaataatttccctgcaagtatttattcatttactcttcatttacataattgcttataatcttttttaatatattcttgtcccctgcgccacccctcccaccttttttttttttttgctgtggttcatatgcttttatgtaacctgagctataaaagactagaatactgcagatattctatctgccatgtctgtcattttcttatgatgggtacttagtctaccgtatacaaatttctgtatagttaccaatgtctttttagctatttattaatcttatcttgtttctttggcttctgaatcactttgctgaagttgaaatcatctgaggtcagagccagtttttatttaaatagactgaatgcagctaaacctggattatagccaagaaagatcttacaccaagtgcctacaaaattagaagcattgccaaggacgcatcagcagagtgttttgcttactgaagtcttattctgaaataaatttgaggccctggcgatgggagcttttggttgttattggtagacctcctaaaaaatgtaatgtagtttaattttacttttaatttttttagcatgaactttctccttcatttcttctttccagagatttttgggtctatccattggttgccatctatgtgttcaaacatgtgactaggtagaagagaggtaaacaggagtgtattcacctgttatcatggagaagttattattcaagacctgtaaggggaatgtggcagtcctaaaggctgcaaatattctggcagcattgtaggattgcactttccctcctcctctgaaggtagatgggagccatgtgtcttgctgtggctaatgaaatgtgagcaaagtgttgcaagctttaagagccagtgcatgattcatcatgttcccatcccattgccacagtgtttgtgaaagcgagtgttgagatggaccctttgttttctgggtccttaattgactgtggtaagataaattattgacaacctgtactagacatatatcttcagcagtatcctttggttgggattttgttgagataagggtccgtgatttggcatactcagtgtaacctaacctattctgattcttatagggaatcagagaagtgtccttacactcagggagcttgtgatttaatatagttgagaagatgtgtttgcataatgaagaaggaaccagctgcttaactgtactctttatttagccacattactgaacaagagacaagctgattatagcataatattgagattttgagtatattcctgagaccctggtttcaactggaaaagtaactttttttttttccttgacactttcagatcacaattgatcaaaacacctatgcaaggaattaaacttgctacaaataagccactagatgcatgatacctttaaaaaagaccaattatgagttatcttttattgttctttttatattaaaaatctgcatgggaaatggaatgagaatatttataacagtacagatttgctatgatggtgtctattaatcaaagttctttattttttagtatgtggggacgacacatactcatggctaatattggtgaaattgctaattcattcattctttatttggtgattcactccacaaacatttattgggcatttggtataaaccaggcatagctctcaatgctgctggtacagcaagaaacaagacagagcctctgactttgtgtcttacattttagtgagagaattgggtaataagcaaacaaagaaaggtacagtgtggtatcaatgatgagagttataaagacaaagcagagaaatgagacagacagtgcaaggtgtgtgatctcacatagagtggtcaggaaaggctgctttcagaaggtgacatttgaacaagaaattgaagaaagcagggagaaaagccatgtgactgccctgaggaagaatccttcaagtggcataaatagccatttcaaagaccctgaggcagggatgtagtaggatgtttgaagaacagcaaagagaccagtgtggctggaagaagggtgagcaagtgaggagaggtgggtaggagatgaagccagagacgtggtcaagagccacagaaccagggcctgccctgcctctgatgaaaaggcactgggattttgaatgtgagagaaccatgacctgctttatgttggaaactgatgtagtctgtggagggcaagaaaacaaacagaccagcaaggagacttttgcatgagtccaaattggagatgatggagtttggacacagttggcaagtgtggtggttgtgagatgtgttgggttcaagatatcttttgaaaatattgctattaggactttgtgatttgttgtggactttggcctgagcatctgattgactgatgatgctattttctcagatgaggagaatgttcaagatgttgttacctatttaagagaaggtggccattgcatattgcatatgtgagcctggacttcaggggaaagtttaggactggagataggcggttggtcattcaatggataggtggatttgaatccatgagattggatgagattcttttttgtttgtttgtttctgagacatagtcttgctctgtcatccgggctagagtacagtagcacgatctcaactcactgcaccctctgccacccaggttcaagcattcgtgcctcagcctctgagtagctgagatttacagatgtgcaccaccacgcccaggtaatttctgtatttttagcagagacagggttttggcatgttggccaggctgatcccgaacttctggcctcaagtgatctgcccgcctcggcctccaaagtgctgagattacaatcatgcgccaccacgcctggcctggatgaaattcttgaggaaaggagggtaccgagaggagaaaagatgttgaagaactgaatctggggtgctcccaacagttagaggttgaagagctgaagaggaaccagtaaaggggaccgaaaaggagcagccattgaggagagaggacagccagacaagtgaagtgatccacagctacatgaagacagtgccaaggaggaaggagaaatgagaaatgaaaatactactgagaggttgagggcctgggctgagactggaacacaggatatagcagcatggagatcatggtgacattgacaatatcatgtcattgattgggtgggggcacaagcttgattgaagctggttcaagtgagaataagagatgaggaaataaagataggatatacgtttcttgagagatttttgctgtggggtgagaggtaagggaggatagctatttaggatgtgaagtcagaaaaatttaattttttaaagatgggggttatattacacttgaaagctgatcattatttagtagagataaagaaattgacagaagcatctccttaagtaggcaagaggggatgggacctagtgtaagtggtgggttggctgctgcattagctggagttaaggcattgcatgttctagatttgtacggagacatataggtgaatgcacacacttatgggaagatactgttattatcttctgcttgcctttgttttctaagaaatagaatcaagatcatcagatgggtgtgagtaaggggtcatttctaggagtaggagtgtaagttggccaagaaagtgtaataagattgctgagcagaactgaaagcacattgagattactatcatatctttaaagcaaaatcagccagtgtagttctttgtttttctctagattgtgtcatttgctgtggtgtagggagagagtctaaggattctctcgtaggtaatcatggtcatagttttgcaatctgaataatgtggaagtggagatgggcagccgtgcagtagggcacttgcaagggagcaatttttgggagtgccaaaggccaggctggaagaggtgaaggaggagggagtgatttttgggtggtgccctagaccaggctgaaggaggtgaaggaggagggtgaagacataaagtggggaacggaccatggagaggaggtcaagtcaatggatccagagggcactgatgccaaattgttgacaggcatgagagggaatgagctggaaattcctttgaaataaaaagttggcagctttcctcaagcttaatctcaaaagagacatttaaaaattacttacttttgctgcatggttggggaaaaatgtatttttcaagcatgagttcaactcattttgtaccagggtattcacactgatattcttgggtaagtcattaaaattagtcaactatttctgtgtcttcacccacaaaaggagacgtgtgagaagtgaatacttagtgattgttagattccactgaatctcactgctttgttgcagtttaacgagcaggctaggattgcagcgctgtcatttcagttgggccaccaagccttgaatgaggagataaaactggaagataaagtcttagtaggtacaacaaaagaagcttttgagagatcgttggatagatgtcatctatttggttgctaaataataacacacaaagaaatctctctactgtttatcatgtgtacttatcttgagaagcatcagtgattaaaaaaacaactttgaaaacataaaaatggtgaagtgtggcaatggtatcatgtggcaacggtaaaatgtgtttacccatgtaaatataatgtcacaaatgaatcttgtcattatattttgtagtatcttggaggttactggccagaactattataatagtcagattcatttcatatttatttaaaatccgcggtgttttcacatacattgtgtttttaggggaaattttaccaatgattaacatatattgtctagaagcagagccatctgaattgaaactcaaatataattgccacttttattaaatatacaactggcagactttgaaaatgttatctcagcatctagcattggcttcattttggtttctcattttcctattttattttgttcagtttagcaggggacagtggggaacagggttacaaattgcattttttcctgcattattggtttttgtcaagtggtttacaggccaaagtttgtggatctgccagaggctttatcccaaaactataggcaacagctatttcttgaaataattttagatagatttctacattgatttatgttttggggtatatgatgcacaatcccttaagtcttaatatgactattggtttaatatggcagaattaggatcaggttcactcattgtttattataatttacccatgcttgactacccaataaaatgtcttccctttacaatgatctttttctattgccatattcttcttgtccttaaaacaacaataacagatcctcaaacgtcattggggttaataaaagatgtttctttattttcagatctttaacaaagcttctccttaacccagagggttttcagaggagtaaagagtggaagtcatttgtacatgaattggcttttgaaagtggccctcattattttattttattttattttatttttttattatactttaagttttagggtacatgtgcacaatgtgcaggttagttacatatgtatacatgtgccatgctggtgtgctgcacccactaactcatcatctagcattaggtatatctcccgatgctatccctccccccctccccccagcccacaacagtccccagagtgtgatgttccccttcatgtgcatcattttttatgaagtggccctcattattaagccatgtctctgcctgttgattgatgttaactatctgcttatggtctgagatcagtgtgtactgcaaatgtttgggaagatatcttctttctgtggaggtgaaacttaaatatcttctataaaatatgcctcgatttcagaagtagcaattgtagcaatgcctgatgtgaccactttattactgccttagaagtacttttgtggtttgactgtggggagggaacgggtcactggagattttgctatctctccaggtttcatgctttgggaatcaaaggtaggtaacagtttggaaaaactctgtaggggctaaagctttttctaaaggtttttacgtctatatatacctctgtatgttactgcttcaagcccagcaactagcaattttagtttcactgaaattgtgttttctttaaatacacaagataatagaattgtaactggaatttacatgttatatataaagatatattttatttaatcttgtcagaagggttttttttttttttttttggtgcttttaagctaatgtggcatctttctcttttcaaagagtggcatctccaaggaatagctctgcctggaaggtgtttgtggctgtccacttaaaagctgaaattaggtcagtgttattttgtcttgagataacaaaaataagaccccaagggagtagtgacttgggatttcatttaagtacttaatttacaggaaaaaaaatacagtttccgatactgaataattattacactactgaataattatatattttttcttctcccggtgttcttatactttagaggcaattttttttttttttttgtaaagatcacaaaaggtctgattagtcaaagaatgaaagaaatgcactgtggctccaaagtcccttatccaaaacctctgggacagatgtattttggaatttaagatttttgtgctgagaatgatggtttccagcttcatccatgtccctgcaaaggacatgaactcattcttttttatggctgcatagttttccatggtgtatatgtgccacattttctttatccagtctatcattcatgggcatttgggttggttccaagtctttgctattgtaaatagtgctgcaataaacatacgtgtgcatgtgtctttatagcagcatgatttataatccttggggtacatagccagtaatgcgtcattcccagcaaactaacacaggaacagaaaaccaaacactgcatgttctcattcataagtgggagtcgaacaatgagaacacgtggatgcagggaggggaacatcacacaccaaggcctgtcggggaggtggaggacaaggggagagagagcattaggaaatatacctaatgcatgcggggcttaaaacctagataataggttgatgggtgcagcaaaacgccctggcacatgtatacctatgtaacaaacctgcacgttctgcacatgtatcccagaacttaaagtaaaatttaaaaaaagattttttggagtttagaaaaataatacatttggatttagcagggtttagtgcggcactttttaatcacacacactaatatttctgtagtgaaactgaatattcacactgagataaagactatgaataacttcacatcagttcaggtaaggttttgcctcctattaagtcttgataacaaactttaaaaacttaaaaaaataaaataaaataaagtttattttcaaaacttttgaagtttgcgcgtacagctagcttgtaggtctggccttgcttttctttagattatatttcccttattagtcttctaaacacattaaatctgtgtttaccaacgctgtaatattttgccaccgtgaggatggtctagaggccagcaccatccacatcccttgggagctggctagacatgcagaatcacaggtgctaccacgaagctgctgaatcacaatctgcattttaatagaatccccaggtgattcatgtgtgcgttaaagatcaagaagcattgctgtagtattatattggctttaatttagattccaagtcttaaagggaaatgctgatggggggatactttagttgtttaaatcctgggaaagtgagcccagattacactaatatcatttatttaattatgtatgtatgtattttttttttttttgagacaagatctgacggtatcacccaggctggagtgcagtggtacaatcttgactcactgcaacctctgccttgtggggttcaagccatcctcccacctcagcctccagagtagctgggactacaggcatgcaccaccacacctagctaatttttgtattttttgcagagagggggttttgccatgttggccaggctggtcttgaacttgtgagctcaggccatctgtccacctcagccccccaaagtgctgagattacaggcgtgagccactgcatctggccgaatatcagttctttttaattttttattcaatatttcctccgtctctccctcccactcttcctatttttttttttttttttgagacagagtctcgctttgtcgcccaggctggagtgcagtggcgcaatcttggctagctgtaacctctgcgtcccaggttcaagcaattctctgcctcagcctcctgagtagctgggattacaggcgcctgccaccacacccggctaatttttgcatttttaccagagatgggatttcaccatcttggctaggctggtcttgaactccccacctgttgatatatgtgccttggcctcccaaagtgctgggattacaggtgtgagccactgcgcccggcccactcttcctttctctcctccttccttttctttttctttctttttaaaaataagtctcataatacttgactttaaatggatcatttagtctatttatttacatttattatattcttgatatatttggatttcttctcttttatactttctgtttattctacttttgtttctttctcttgttttatttatttttttgagatggagtcttggtctgtcactcaggctggagtgcagtggcgcaatcttggctcactgcaacctctggcctcctggcttcaagtgattctcccacctaagcctccgagtagctgggattacaggtgcatgccaccacgcctggctaatattttgtatttttagtagagatggggtttcaccacgttggccaggctggtcttgaactcctaatatcaaatgatccacctgcctcagcctcccaaagtgctaggattacaggcgtgagccactgcacctggctctttttcttttaggttgatattttttttctcatcctattccttcctctgctagtttgttatataccctatttctctcttttagcagtaatcctagaaattgtagcatgcatactttatttataaaagtctaaattcagtcagtatcttttcttcctcctaaacaatagctcagaatgttttaactcccgttttcctctcttgtgctgtatactattcttgttgtgtgtttattctatttttaaaaattattaatcatagatgattttttaaaacttatttttttcaagacagggtcacattccataagccaggctggagtgcagtggtgcagtcacaatgattgcagcctcgacctccctgggctcagatgatcctcctacctcagcctccagagtaactgggactacaggcacacaccaccatgcccagctaatttttgtatttttagtagagacggggtttcaccatgttggccaggctggtcttgaactcctgggctccagcaatctgcccgccttggcctcccaaagtgctgggattacaggtgtgggccactgcgcccagccaatcacatatgatttggttgtttaatagtggtgtttatctacatttattcacatatttgccacattagttgcttactacgtatttttgcattttagaccttctacttggaatcaccttcttcaacttggattctttagaccttccttaactgagagtctcttcatggcaaactgtcttggattttgtctaaaaatgtctttattttgcccttattctaaactgttactaaactatacattttgttttttgttagtgtatctgatttgctggctgtcattcattgtgctttatttctctctctctctctctgtctctctctgtgtgtgtgtgtaagggagagaatttgctaattagttgattaattttccactgtgagctgttcatttttcttacagctttgttatgaggattcttccaggtctgagttacagaaggattctcctagaaagtatttaaggttgcttctgctatgtgcctgggttattaccaactgtgactcttcacattaaatttttggcttcagggttttgggactctaagagctgtatgaactcgcactgcaaactcatatgagttttcacttattatagtaaattctcaggtttgatttttttcttcttccatccatggccaagatttgagacaggcaagtttccttgcactccaggaatgtagcttgacttactgttcctggtgttggtggtggtgctgctggagatgagatccttttagccatcctatctttggcaggccctgggctttgtttcaccctgaactctgaaccctgaatcctgtgggcagggcttctgctagcccatgtggctccactctaaattgatgcaggcactcagcttgttaaagggagcactggatggatttcagcaagcttcctgttccttatggttctgtctggtaggccttaaacctaggctcaagtactctggagttaaacaagtggcccaaggcaaaagccagcttcagtgcttaacttacttcgcagggattgtatgtatgtatgcatgtgtatgaatatatgttatgtatacatatgtatgttttgtgcgtgtgtatttcaccgttgagtgttaattactcccttgttacaactcattgatgcatttaaataaaacatttaaaatattttattcatctcctctcatggttttcagcaaaaatgtaggtcagggtaaattaccagatatattggaccagctggatgtagtcgcctttgatttttttttagttctaccacctatgtatgtatcaataaacaatgtattctttagtgcttccttatttttaaacattatgtgaattgaataacttatgtaatcttttgcaatttggtttcccgcaacatttctatatggagtatggttcgttcatatttactttataccaatatatgaatttctttagctattcaacacaatttaactattcagattccactgttgatggacttttggattctttccaatttttgctattggagttttccagttttgctgctaagaacactctcgtacatgtcttctggtgcattgtccaggattttctctagaatatattcctgggggtagaattgatgattcattgagtaagcatgtgttgtaccttactaggtaattacaaatggctttccaaagtagttgtaacaaattatgcttccattagcggtacacaagagtttctgtggctccatgtccttaccaattcttagtattgtcaggtttcttaattcttgcctattaggtgggtggacttaatacttcttagtttagttgttataacttgttttttaaaattaacatatctatgtgcatattcgtagtcatacatgtttgtctggtcatttaggtacttatgcaatactctagtagactcagaatagaaattagccatggcaacatatatattacattcttcatattgctacatttgaaaataatcataattatttgcagaaatatgaacagaacatatagaattaaatgttttcacgatgtcttgtattatctttcatgtttcatagcaatctctgtgttataggccacatcaactgcttttgcattgttctgacttacaggaattgcagatttattgttctcagtgccatatttaagttccttctctgtaacaatcaggtgtaatacttgtaaatttttttaaccttagtacaaatttaaaaagcagaaatttctcttgcagcttcctgtgtttcaggcccagtgctaagcacatggcaagcattgtcccatttagttctctccaccatgcttcgggcaggtgctgttgttaagcccctttcatggaggagtgaactaaagcatggagaggttaagggtcttgatcaaggtcccacaatcttattctcaatggaccttctccttctctaatctaaaaccctcattttattttgggaagtggatgtaggtctaggaagcttgtttgtgtgtgtgtagtttgtttgttttttttttttttgagatggagtctcgctctgtcgccaggctggagtgcggtggcgcaatctcggctcactgcaacctctgcctcttgggttcaagcaattctcctgcctcagccttctgagtgctgggactacaggtgtgtgccaccatgcccggctaattttttgtatttttagtacagacggggtatcaccgtgttagccaggatggtgtcgatctcctgacctcaggtgatccacctgccccggcctcccaaagtgctgggattacaggtgtgagccactgttcttggctgtttgtgttttatattaggaggcagagagcacttaggggaagcagaagctctggtctgaggaggcagtggtttacttattagttcacaggccttttaggtaatcactggtccttcacttaattaagcaacttaatatatgtcttacggattaagttaattttaaatcaatgctaatttttatgtcaaaatatattaagcagcatcacattaaagtcaaaggtagtcttgtaattattagagcaataggtatcgtgctgtcgttctccaatgtggctgcacattggacaacctgaggagctttaaaaaatactgctgcctggggatcactcccataagctctgatttatctcgtctggggcaccaggagttttaaaatttctccaggtgatctaatgtgtagccaagcttgaagattactcgatagtcattgattatgtgcgtgccacattcagattggtggggttcaaatcctccttctgccactcactagatgtgtggccttagttaagttttgttaacgtttctttatgtcttcatctgtaaaatggggatgaatgataaaaatactgtctgcatctcagagcattgttatgaggattaaaggggtacagtaagtccttatttaacgttgtctataggttattggaaactgcaacttttaagtgaaacgatgtataacaaaaccggtattaccatagattaattgacataaatgagagttaagttcctgcagcatatttttggtcctaaaagtattatcagacttctacataaagaccaaaacatttctaatattaaacactgagagaaatctaggttatacatacatttaagaaagattaattcaatcatttactcaattattcgactccagaatagtgggtggtccgagcctgtcctggcagctcagggtgcaaggtgggaccagccaaggacaggacaccatcccatcacagggcacactcacgctcatccacactcacactgggaccacttagacatgccagttcacctaatgggcacagctttgggaagtggagaatgtgaagaaaatccatgcagatgtggtgagaacatgcaacctccacacagacaatggccttggctggaataaatttttttttctcacaaattttataatgaaacaatgttactgtaggacctgctgtataatatatacatattaataaaatgcttggaatagtgactggcacaaaatagtcctttactgtgagctattttaagtagactaagaaaaaattattactattattggatattctctcaaaagtatcttgggggctaagattttaaattaaatcaaattttgcctagtactaagcccactttggtgttttcttggctttgtttaatttttttctccatggttttatttaaaagttatttctaatcaccctgtcaacttagcagatatctgttggaatcatttaaggtgtttgtttccaaaagactgcagaaattaaatcaagatatttgcagaggaatgactgacagcttgcaggtagactggagaaagtgcttcctaccataacagacagaaaaaatggtagtacaagagtcagcatttcttatttatttttctatgaggcagggtctcgctctgccgctcagactggaatgcagtggtgtgatcatagcgcactgcagcctcaaacttctagactcaagggatctcctgcctcagcttcctgagtagctgggactataggtgcttgccaccatacctagctgattttttgtaggggtgggtagagacagggtctagctctgttgctcaggctggtcttgaactcctggcctcaagcaattctcttgccttgacctcccaaaatgttgggattacagacatgagccaccatgcctggccaattgagcatttctttaaactggaaactagcacctttataataatttcacacataccattattgttgaaaatagtcagattttcagaggaaatctctattaacctaagttgtataaccttttgaggttgtaccagtgtagagcctgtttttccgagcatctacatgctcaatgctattttttcagttatccagcatccccccacttgtttctatcctatctcatatgcaagagggtgtaaatgtttttgtgcattgcttttacatttttatttatctctcaagtgggcaagtaagacagtcatcaacagaggttgcatttggagatcatattctgttttttctttaaactatttgatcatttcagagaaactttattctcagttctgttttgtcttcagctgtcaatatccctgactccaggccctttatttagcttccattcttactgatgtggaaacatacttttaaatgaactgcctttaaaaagaaatattttagtaaagtgaaggatctttttgtaatgcaaataatgttttgttcaggattttcttgagaaatctgccatgttctctaagcctttgcctccatactggatgtggctttgccttttttgttgtgttgaagggcatgcacagatatagtttctgattatttttctcagtctgatttctccaattaggcatattatcattagaaaactcgcccattttcccatggtgtttaaaagtaaaccaggacttgtgacactatgctactcggcatttatgaaatgtaatttaattactttgtttccattgtgaagactcggtttccttatttcctatattcatttatttattcattattggtatacccaacaagataagtaaatacgatacagccttgcatttgacaattttatggtgtgtatgtatttatcatgcctgaactgtgactagacttaagatgaagatggtacctaaatcaagctcttttatattttgtctttcccataatctagtctgtcttttctttcccacaaaatagaatgggatactttttattataaatatatgacatgttcactataaaagagaggcagtaaaggaccagagaaaatgacctgtgatgccaccacctagaagtaatcactcttgttaacatcttgttatttacttgtacagtttttttctgtgttcataggctgacatttttccttgcagatgttctctctctatattcatacaaagctgcagttgttcaagtcccaccccagcctctggaggtccaggatgaatgcctccctctttctgtcctggtaccttacgtgacctccggacggcagtgtcagtgttggaaatggcaggctgctgcaaatatgctaaaacctcatcagttgtctctattcgtctgaccaaagtccgtgggaagagcaagatgctggtgatatcctggagctcttctgacacaaggctctggctagccttgatacattcctcaaattcttccttccaattctgaaaccttttgttttccagacaataaaaccctcccaaactcctacctagacattctctctaagcagtcctgggagaccacatgtgacttgacttttaactatctttacagcgtttacattttgctccttctttttgtcatgccattactagagggaggatgggccatccagagcagcgtgcgccctccacaggcaccttagcctgttcttcactccgccatgattgaaagaggagaaaatattctatagctgttccttttctgttcttggctttttcactcttactgaccttacaagttttatttttccatttctgaatctcaattattttcatttctcctattcagtatagtttttaatagatagcattgcattacatggatgtcccttatttaatcaactgtttggtatttcttttctgtttttcaaaatctaatgaacactccagtgaatatccttttgttcgggatttatctctagaaggaagattactggctaaaaatatatgtacatttaacattcatatacatatctatacacacttttttttgagacagcgtttcactctgtcacccagactgaaatgcagtggcatgatcattgttcactgcagcctctacctcctgggctcaagcaatcctcccacctaaacctcctgagtagctgggactatagacacgtgccatcatgccagctgagtttaaaatctcgttttgtagagacatggtcttactatgttgcccaggctggtttcagactccttgggctcaagtaatcctcccacctcagcctcccaaagtattgggattataggtgtgaaccactgggcctggcctatgtatacataattaggctatactgtctataaaatttggctatctatagtcaaattattttatatgcatatatccaaatatacctataaatagccaaattatacatatacagccaaattttatatatatatatatataaatgttatatatatatagccaaattatataaagctgtatatatagtcacattatcctacaggaaatgatgtaaatgtaccaatttacattcctgtaacagggcattagaattccctttttccagagccttgccaacactggttatttataaccctttcaaactttgtatgaaagttgtatgtattttaagataaatgaaaacttatattgatttgtaattatttattggtataattgaacacctttccatatctttattgtactaatgtgtatgaattccatcttaatagttttgctaacttgtccattgaggggtttcctactgatttgtaatggctctctatataaaaaggatgttaatttttgcctattttacagtaatagtacaaatattctctcatgttttctattagtcttttaacctttgtttagttttttttcgttccttcataaatgctaaattttatgtcatcatatctttcagtccttttctatattatttctggctttgatggcatgcattgaaagcccttttccaccccagagttatcaactcgttggaaaatgatgttgaaatgtcacttttaatatttactaaacactcttgcctaatttgttctattttgaagccctttaattctgtttctttaatctgcctgtcttttttttgtgcctgttccttactgtcttgactactgcaggcaacatacttacatctaaagaacaagcacacctattctgcccttttgctaaacaaattttcagcctctttttcaatgattattttttcaaatcaatgttaaacatcacgtaaagtttcaagaaaacccctaggggtattagtatttagagtgcattaaatttttagctaattcatgggagaatttgaagtattatatcttctaatttaagttagagtacaggaattgtctgtctttatccctctaagtacattcagattctcaagaatagtaccaaaattctcagatccccctctaccagtatttttctcccactgatggctcttcaaccctaaaatgtcttagtggtatggtttggatctctgtccccaccaaatctcatgtccgatcgtggtccccactgctggcagtagggcctggtgggaggtgattagatcatggggaggcttcttatgaatggcttagcaccctccactttgtgctgttcttatgatagtgagttctcatgggatctggttgttaaaaagtgtgtggcacctccccaaaccccttgctcttgcaccggccatgtaaggtgaggatgcttcccctttgtcttttgccataattctaagtttcctgaggcctctccagaagcagaagccaccatacttcctgtacagcctgcagaaccatgagtcaattaaatcttcctttataaattacccagtctcaggtatttcttttcttttattcttttctttctttcttttttttttaagagatggagtcttgctctgtcgtccaggctagagtgcagtggcgccatctcagctcactgcaacctccgcctcccaggttcaagtgattctcccgcctcagcttcccaagtagctgggattacaggcgcccgtcaccacgcctagctaatttttgtatttttttagtagagacggggtttcactatacgttagccaggctggtctcgaattcctgacctcaggtgatccacctgccttggcctcccaaagtgctgggattacaggcgtgagccactgcgcccggccaggtatttctttatagcagtgtgagaatagcctaatacacctagcctgatgttacacttaggatcctcttcattattcttctgaatccaagcctccaactttatctacccatcacggttttagcttatattttgattttatttcttacatcttcccttatatttattattttaatattttgtttctcttttctccttctatacttgtactagatttatcagaatctgtaaatctcttttaaccctattaatttgttaactcagttaaatatatctattttgccaatgctcatcttcctatttttaacagtcatatatcaaactgtatttctcaactgatgtaccaaaattaaaggacacctagatgccctccctcagctaaagtgtttactactgcatccaaacccatgaattctccctaactgagagaggatatttagagggcctttgtgccttttttttttccccctatttcttccttgaaaattctggagctttttgaaataatttagaattttacttttaagatattattaaatttttttctacagcatgcctctgtttaaagaatcaaagctttttaaacatatcactagtcacatatattatctgtgtagacttagctatattatcatatatttatttttataaagatattgctcagcactattcttttacagttttatttatcttaactgacaaatgaaaattgtatatatttatgtatacaacatgatgctttgatatatgtaggcattgtgcactggctaaggtaagctaattaacacatgcctcacctcacagacttatcatttttttgtgagaacacctagtgagaacacctagaagtcacccacccagcaactttcaaatacattgttattaactgtagtcaccatggtgtataacggatcttttaactcattcttcatacctcactgaaattttttgtcctttacccaacatctcctcagtccccttacctcctctagactctggtaaccactgtttgaactctgttcctatgagttcaactttttttattctacatgagtgagatcatgtgatatttatctttctatgcctggttcctttttcacttaacattaatgtcctccaggttgaccatgttgtcataaatgacagatatccttcttttttaaggctgagtagtattctgttgtatacacataccacatttcctttacccatttgtttgtttttgaacacttaggtggatcccatactttgattattgtgactaatgctacaatgaacacgggagtgcaggcaactcttcagcacactgatttcaattcctttgggtatatactcagggattggattgctgtatcatatggtggttctgtttctcattttttgaaggaccttcagaccatttccataatagctgtactaatgtgcatttacatgagcagtgtacaaagattcccttttctctatatcctagccacacattatctttcgtctttttgataacagccattcgaacaggtgtgaagtgatatctcattgtggtcttaatttgcattttcctgattagtgttgttatttttttttcatatacctgttggccattcatatgtcttcttttgagaaatgtctattgaggtcctttgcccattttaaaaattgttatttactttcttgctattaagttgttcgcattccttatacattttgggtattaatccctatcagattatgatttgcaaatatattctcccattctatagattgtctactttgttgtttcctttgctgtgcagaagctttttagtttgatgtaatcccacttatctattttttgcttttgttgcctgtgcttttagaacctgatcaaaaaattattgcccagactagtgtcttggagcttttcccctgtgttttcttctagtaattttacagtttcgaatcttaggtttaagtctttaatccactttgagttagttcttgtatatggtatgagatgagggtccaattcatttttctgtatgtggatatccagttttcccaacaccatttatttaagagacagtcttttccccatgtgtgttcttggtacctttgtaaaaaaatctattgaccattgactatgtggatttatttctgggctttctaccttgttccattggcctaagtgtctgtttttatggcagtaccatgcattttgattactgtagctttgtagtagtttttgaaatcaggtagtgtgatgtctccacctttgttctttttgctcaagattgcttggctctttggggtcttttgtggttccatatgaattttaggattgctttttctatttctgtgaaaatatcattggaattttgataaagactttgaatctgtagattgctttaggtagtatggacattttaccaatgttaattattccagtccatgagtacaggatatctttccatacatgtgtgtcttcaagttcattcatcactgtcatatagttttcagtgtacagatttttcaattcctggttaaatttacccctaagtactttatttatttatttttttgctattgcgaatgggattgttttattaatttctttttcagatagtttgttgtatgtggaaatgctgcatcagcactaattcttacatattttatcttcttgagatcttttctgtttactttttatttgattgagatgctttcttagataccagtattggtatactttcttgagtttgtttctaaattatcttttcctcctcaaatatgtatttctgctgttctggtcttggattgcagttctctttattcagatgtgtgtgaacactgttctattgttatctgtggtcaagcattgcagacgagaagtctgatggtagactaattattttccctttttaacttacttctcttgtctgaatggaaggctgtagaatttttctctttgtctttgaagaaatttctctagaatatgtccagatgtcttttttatttagcctgactagaatgtctgagcctttttatgctaaaaatgcaagtctatcttcaactcagcaaaaacttcaaactgaaaaccgaagttttaaaaccagtgaagctttcttccacttttaaatattattaccacacctacttcttctcgtaattttttactttttttttcctaaaaaatgtagaaagtacagaaaataatgcggaaagttctcatttagcccaagcagagagttaaaaagataatcttttgtcatatttgttttagatctttttttaacagtatggttatattttaaaatgcctagaagactggagttaaagtcattcagttatttcttaatagtacttagagagttgctcatgaattggaggataatgaaatatgagacatgccagagcaggagaaggaaattctaggggctatttggggtcttttgtggttccatatgaattttaggatttaaaaaaaaatttctgtgaagcatgtcattggtattgtgataaagattaattgcatctttagatccctttgggtagtatggacattttgacaatattcttctaatttgtgaatatgggatatcttttcatttcttgtatcttcaattaatttcatccatgttttatagttttcattgtagagttcttttacctctttggttatattcattcttaggtattttttatttgtagctattgaaaaaagattgctttcttgatttctttttcaggtaattcattactggtgtatagaaacacctctgagttttgtatgttgattttgtatcctgcaactttactgaatttgtttattaaactattagatgatagtttaatgataaatgtttaaggtggcagatatactaattaccctaatttgataattacacaatttataaaagtattgaatcatcatgttgtaccccatacatatatatagttagttattatatgtcaattataaataaaaaattatatactacgttggttttcaaaattaaagtaataattaaaattcgcaaatgatgggaaaaaaaccggaagttcttgggggaaataagcatatttcacagtgtcatggaaattgagtcctgaatgtcaatattgtttcataaatacttgtaacatacaatgcaatagggatactacatcaggatgcttttggctccaagttacaaaaaaccccaactcaaattggcttaaagagggaagacatttgctcatctcacacaaaaggctactcagctttgcctcaatccaagccatcatgtaatcacatggtgggtatagaaatttgaggtgtacttacacctgtgtacatacctctagatgtaccagtgtcctcaagaataagaaatgccatttgccttttgtgtttcttatttagaagtgagaaagtcttttccagaatctccctagaaaacttgcctataaggtctcagccacaattcactcatacgctcattcttgtaccaactggtggaaagaaagaatagaattcacgggaattctattgaatctgacacagattgatctgacatagatcaacggttcccaaccaggtggagttttacctccagaagacatttagccaagtctggaaacatctttgtgctcgctggggtcccctactactggtatctagtgggtagaggccacagacactgctaagccttctacagtgcatgggatgcttcccacaatacagaatgatctgattcaaatgttaatagtgtcaaggttgagaagccttaacatagaccagttaggatctcacccttcagggccaaggaaagggctgtttttcactgaagcacagggctaaggaggggctatgtggatgttgtgtagcccactgggaatgcccactgccatgacgtccctcggatggagctggtcttctgagctgctcagaaagggaagctcggatttgtgggttttaggctactaaaaattaaccaaccacattgaatttcatgtttttctaattcattcctagtcttcttgcctgttaaactttctgctaaagataattctaatgaatttgagaaggtatttataaaagaatatctgtgaggctgtgtgttgcttgactggcagccaaaagaaatgttgcttggggaaaatggcacgaattaaacattgattgcccatcagtcttgtacttggggtctggggtagtctggaatacaggtagggagatcattcaagcttcacagagaggttcactagtacttataaatccaagcattgggagttgagaattgccagaaatagtcatgtaatgatattccatgttgtataggtgtttgcatttcttcctttctaaaaacacagtggttttggaaataataatatcctagaacagtggtcctcagctttttttggcactaaggacaagttttgtggaagacaatttttccctggatcttgaggggaggggaggatggtttcaggatgaaactgttcccctcggatcatcaggcattagattctcataaggagtgggcaacctagatcccttgcatgtgcagttcacaatatggtttgcgtttctatgagaatccaatgcccccactgatctgacaggaggtgaggctcaggtggtaatgctcactcacccaccgcccacctcctgctatgcagcccagttcctaacaggccacagactggtagcagtacatgacctggaggtttgggacacctgtcctagaacatcctggattaagcaattaaggatctctgcaaatcctagctccattgctcaactttgaaaagttgttggactgttttcagctttgggtacctcatttgtaaaataaagaaattgaattacaggcacttacaggtcctgcaattccccgtaactcagataaaaaatagatccctttctcccttcaggagaactcatgactttggtagcagctagagttagcatttgctcatgcttttattgtgtttagcaatcaatgggaagtgcatcaggtgaaatctctcaggcctgcatatgtctggtcaaagctcattcattgattttttttttttcctgctgaaacttgcacatatataaaaaacgaagacactaaatttaattttcaccagctcagtgtatagtattgtggctgctcatgttcctgaagagcgagttgttctcaaataataaactaagctgtataatctttaaaatatttgaccaggtgggaagcctttctgtgaggacaatgtgtttgtgcgtttggtgcttaagcttcaatcccctggccacagcttggatttatttgcaggggaaatctgctacgtaagaagacaaccactttgggcaacattatcttcatcatcagcatgcacgtgtggtaatgacctgttatgagcctgacttggaataactttcttcctcacagaatggtggatactccatatgtgtagaattactgagagtaattatctttgcaacagtaaggcgtgagggtaagaaatcaataaagcagaagggaaagatattaacatttatcgaccactttctgcatgacagcagaaggcggtcaataaatggcatactttattttaatcgtattaggtgattattgcagtattatcttaatttatgtgtgaagaaattgtggtccagcgaggttaagtcacttgctcagtgtccctcagtattaagtgataaagcagaggtatcaacctaggataccctacaaggtttggcttccatctggaagcactgagtacctgggcccagatatgagacagggtcccagcccagagatttgttggtttatcattccttcagcaaacacagcttacttccaagagtgtagaaattggggctgtgcttcatagcaagataataagcatcagaagggctgggtgtggtggcttatgcctgtaatcccagcactttgggaggccaaggcggttggatcatttgaggtcaggagttcaagaccagcctggccaacatggcgaaacctcatctctactaaaaatacaaaaattagctgggtgtggtggtgcacacttgtaatcccagctacttaggaggctgaggcaggagaatcgcttgaacccaggaggcggaggctgcagtgagcccagattgccccactgtactccagccagggagacagagtgagacaccatctcaaaaaaaaaaaaaaaaaaaaaaagccatcagaggagctacagtgatgctggtgaggcagacatttcctgactcatagcaggttacctttgtttcctcgttataatgagaaaaagttgccttccctggacttcctcctattcatcttttttttcctgtcctcttcttgcttaggatgccaaggctgtgacatttatttctgctctcttccctttgagatatgctgaagtcatttaaaaaaatgtcaggaataaaatgcactaaatgatgactgtcttagaaaagactccagttaagctgtgtgcatccagaaatgcaactgtgctgaccagtttctgcctcccttgccctactgataacatgatgggagatgaagtcgtttttcaaaagtgttctgggtccagagacgtttgctcgacacctgtgccctccattggtctaaaggcattagagtttttctcccacaatatttgtctttgttattttgaatttatgacaccctggttgttggtgtttttctttgcattcatacctgactcttgacctccaaaagaaccagtacatacattttactttaagctgggcatttttgtaatactatgcaaccttgaaaataatcgcagtgatattttgcttttttataaggccttctatccttctttgctcttgcatctctctttcccctttatgacagtatagcagaacatatttcattcttccctgagccctctgcagagcaattttgtaactgatttgagccatgtttttgatggagtatctgctctctggacctttccatctcctggttgcaactgtgaaccaccctgcctccaataatctacatccaaaatgctgagcaggagatttatggaatttgtttgaagatattccctgaactctctgaagctaactagttcctttgcaagtaagtggctggaaacctaaagatcttgtgaactgggttctagaagcatgggataacaaatgtaagatttcagactggaagttaaaagcgagttttcctcttgattcagtttctaaccagtcagctaaatggtctctgaatagttgtagctaatgagcaccatcccccaaacagtcaattgtcttgactattaaatacttaaatccatgtattttcgctggagtgtttattactatgtgttcttaggaccataattataaaatgttaagttaggacgacacagaatatttttctctgagtatttttgcctctttcatcagataagatgaaattcatttttattttattttacattattatgattattattttgagatggagtctcactctgttgctcaagctggagtgcagtgccacgatcttagctcactgcaacttctgcctcctgggttcaagtgattctcttgcctcagcctcccaagtagctaggattacaggtgcatgctaccatgcccggctaatttttgtatttttagtagagacagggttttgccatattggccaggctggttttgaactccttacctcaagtgatctgcccgccttggcctcccaaagtgctggaattacaggtatgagccaccgcacctggccgaaatgcatatatatatatacttttttaatggaatgcaatggaatattgtgaagtagtaaaacatgaataaactatagatacatacaacatgggtcagtcttactaatgactgtgagtgaaaaaggaagctccagagaaatacgcgtattatagcttggttataaaatttggaaacttgcaaacttcaacaatatactttttttttttttaaggaagaaaacagacaaaattcagaatagtggttatagttggggtgaggtgagcccatgagtaaatactggtaatgttgtaatttttggactaaatcatggattcgcaattcttcattatattattaaaactaagttttaaaagacccacaaatgggccagtgatgatagtttttccagaattgatagccatcaattctgatcatccaggatccttggaaataaattgcatggatgagctcattcatcacaaatctggggtctttaaagtttctgctgttcccagttctttggattcatagctatgatccttagagggcaacagatctctcccttctcatggcagaaataaaggtcagatgagaatgggagagccatcagatagagaccactgtggaggagtttgcgctttgggctgagcaaagagaagaccagaatcttttggtaccatctccttctgcatttgagatgaaacttagtcttttaaaatacatgcagccccagtcctctgtgttgccagtcacctgagctacctttgggggtagggttttgattaaatggcacgctttgctcatgagtaaccttcggggcacattttgttggtaagaaataaatgcatcactcatttgaatcagagctgcaagtgccatctgtgatgcactcctccttcccattatcacacaaatgtgtttctgtgtgactggttcctggattttgcaggctctcttgccttgcgccgattgctggctgagaggtctcagctcagcgttcaccacgtatcactatatttctattaatacttctgctcttcttggcaaaacagaagtggggcttcatttgaaatgatgggctggggagaggggaagggaaccatctcactcatagttattgacatcaagctaccatcatctcttgttcggataactatgagatttttctgctccctttatgcccccgccccaccccttcccagccactttctgtcctctgccagagtgatcttgtgaaggcttcaatcagaccagatcattctcctgcttaaaaatccccccgtcgtttcccgttgctcttagaacaacatccacactttttatcctgcagtagggggctctccatgctctagcccctgcctatgttcccctcctcatcatgcctttctgccctttgttcactatattctagtcaccctggccttctttctgctcctcagtcactccaagctcattccctctgcaagaccttggcatatgccatttcccctgtcaagaacgttcctgctctaggtcttcgcaaagcttacatgttctcattgttcaccgaacagtcttccctggccacccaatctaaagtagtccagccccacctcgaaggacactgtctcattgcaccttttattatcatcactgcatttaccattctctgaaattattctattcacttgtgtgtttatggctgtcctgattagaattaattttcataaagagaacaagaatcttgactggttcacccttcaattccttgtgcccacaacagtgactggcacatggaaagcattcagggaataaaagcacaatggaaaattaaaacatactcactgcatgcctgccacctatagaaccaaattaaatcactgccaatatgcatggggaaaaccttcccatttttctggaataatgttacaaaggatggaaaataagtgcacatcacctggatggcatttaataaacgctgtgacccagtagtgtacatttcagtgaatattgccaaaggaagtaggccaacatcaggtaatctgagttaactttcctgtacattgtgtattcgtttcctgatgatcaaaactggattaattagtctacaatgtatctttcctgttagatacgaagattatctgctctatccaatttgtgttttcttagctgagaaatcactgttgaattttaaaagcagcttgcctggtcctcatttcctggtcttctgatggaaatggtttatggaaaaaaaaatatttactagagtcagataattagaacattttatgtattttgcatatgctaatgcgtttgagttcctttgagggagagccgcatggcataaagcagaatgaaaaggatgattcaaatttcttcacccagcctcctcccctggccagatttagcacttcctatataccaccacctcacagcttagcttggctgggagctcctcaggtttccaaaggacggtccttccttctccctcccccaattgccatccctacaccagggtgccaactcccaagtgggctgacaggaagggagattggaaacagctttatagtagatttgatgctgttataagacacgttgtaagacatcaggtaaatatagcacatcagattttattaatcataagaattctttaaaagccttcagcagagccgagatcatgccactgcactccagcccgggtgacagagcaagactccatctcaaaaaaaaaaaaaaaaataaagccttcaacagtggctaaacacaaaaccagaatccctttagatttcttaaaatgcctttgtagttcttttgtaatatgggtccttgttggacaaagttagtaatttgttttttatatcctttacattaggggtttctaacccccaggccatggaccagtaccggtccctggcctgttagaagccgagtggcacagccggaggtgagcagcagttgagcgagcgttactgcctgagctccgtccacctcctgtcagatcagcagcagcattggagtctcacaggagcgtgaaccctattgtgaactgcacatgcgagggatctaggttacctgctccttatgagaatctaatgcctggtggtctgtccctgtctcccatcacccccagaaataaagtttctatgattacaataaatgtaacacacttgaattattcatcccaaaatggtctctcccgactccccactatccatggacaaatcgtattccataaaaccagtccctggtgccaaaaaggttggagactgcttcttttaatgatcatgttcacatacggacagtgaaaaggtgggtcttcttagaggttaaagggaaagtaggacagttgccacaaagctccctttttggagagtgcccagccagggagtgttactagggcccaccttggccttgctgatgtcttcagtggtgtccttgaagtcagcatgggattggcgcaggctcctgttggggcactcggtgaaggtcctccctcctccccagtagctctcatttccagggcccttattttcttttggccatctgggactgaagtcttgctcctggtgggctatctctgttgccctatcacctttagtgatttccactaaataaccctcttttaagcatttaggggaagagggagtagcatgaacgtttattgtgcagtggggtgagaaagtcagtaccagtttcaacacgccctccagctgccttcctccagggaggggacttcacactggctgtctccacagatctgcagtgcccttgccatagctccaactcctggccttctcccactccccgctgcctgctggcacatagagcccttgggccattctctgtgtggtattggcccctgcctttgcttatgctctctgctgtaagcagctaggcttagacttccctaagaggagtcccggacaccactgaggatgcattttcccttcctcacgtgaagagagcattaggtgcccttagctttggagggagtggagctttggagcctggagacaggggaccaggaccagattacccagcctccctagattctgctgaactcatctttcagtaaagaggccagatgagctgagctccacttctctctggctccatgttcctgtgacttttgactcatctgaggttgactttgagaaggcaatcccttttaaatatattggaatccatgtagtatgaccctatccactgtggaatcttactccattttactttaaagagaatgtaaatggtttggctgcacatcactatgaaaatggcctaagtaagcagaacggagaagctgccaggagagcagaggtggagagtggaaggggccaagccggttctaaatcgttttctgcaggctcctgtcctcagatgtactcacttcatgggaaccaaatcacatttaactgctctccagctcttaaaacaggataacttgagccatctgatatttgagaagaatacagcaacccagaagatgtattaatactctattctctaattttccagaataagtcagatcattgacaaatgacatacttgggctgtattaccttcctacagaaagactttcactaggtttagtaattagctatagcttcagccttttgttttgttttgttttgttttgttttgttttgtttttgagacagtctctctctctctgctgcccaggctggagtgtgaaggtgccatctcggctcactgtaacctccgcctcctgaattcaatcaattctcctgcctcagcctcccaggtagctgggattacaggtgcacgccaccacacccagctaagttttgtatttttagtaggtatggggtttcaccatgttggccagtctggtctcaactcctgacctcaagtgatccacccacttcggcctcccaaagtgagcttatgtctttttgaaggatggctatgggaaaagtccacttgaaggatgttttgtcatttatttacttactgattaattaagatgggaaagtcttgctatgttgcccaggctggtctctcgctctgtcatccaggctggagtgcaatggcacaatctcagctcactgcaacctccgcctcccgggttcaagtgatgctcatgcctcagcctcccaagtagctggaattacaggcacctgccaccacgcccagctaatttttgtatttttagtagaaatggggtttcaccaggttggccaggctggtctcgaactcctgacctcaggtgatccacctgcctcagccccccaaattgctgggattacaggcgtgaaccattgcgcctggcctcagctccctttagtttttaaagatagacttcctatcttataacagttttagatttacagagcagttgcaaagatagttcaaggagttcctgtattctctgcatccagtttcccctattattagcaccttaaaatagaatagtacattggttacaatgaacaaaccaatgttgataaagtatgtcaactgaagtccatacgtttttcatttttcctagtttttacctagtttcctttttctattccaagatcccataccatattacttatagttgttgggtctctggatcctccacagcaatttcttagacttgccttgtttccattatgaaacacttcagacataccaaaagtgtgtgtgtgtgtgtgtgtgtgtgtgtataaagaataccaatataaccagcattcagccctggaagcagaacatgaccaacatgattgaagcctcatgtatatccctcttgatctctttctccttccctcttcaaggacgaccaatatcttaaatttggtgcttttgtcccaggcatgttttgaaacgactatatgtagtgttgctttgcatattttattttatcgagacaggatctcactctgtcacccaggctggaatgcagtggtgtgatcatggctcactgcagcctctacctccccgggctcaagtgatcctcctacctcagcctcttgagtagctgggactaaaggtgcatgccaccacgcccacctaattttgaaaaaaattttctacatatgaggtttcacatgtcgaccagggtggtcttgaactcctgggttcaagtggtcctccctccttggcctcctaaagtgctggcactacagcagtgagccactgcccccagcctgctttgcacattttaaaacaatataagtattataagcattgctctacagtttgcttttttccccccacataacatgttttaatctgcattgctctaatgtatctagtttctaagtcagactctgttgtatgaatcccctctcttgttgatggatatctaggtgttttcctttctgttgctgtcatggtcattgcaaacagtgctgaacagacacctttacaagtcaccttatgcacgtgagcaagcattctacttggggagaggaattttggggtttcaaattttatccttaacaaagcagtttattcattcattcagtaaatattgattgactatgtaaaaactgagccaggttctagaggtaaacagaacagaaataatccttcatttatcatgagtttacaatctaattgggaaaatgaacattaaagaagtaattaaagatatgtatgtactatacagctgtatcataaaaataaagaacaatgtattgtgtgccatgaaaaaaatataaggcttattaagggatgtttcttaatgtttcttgtatcataaattacctaaagaatttctggacaggaaaatgctactctcctactgaatttatgtgctttctttatcgaacaatggaagcaatgtaaagcaaagtgtttcttttttgccttagctactaggagtagctctcatgtagatgctgtgcccagctgcagtgcctggaacagcccagctacatttagtatgtttatattttggctttttaaataaatggttttcatattgttctatgtcttgttttgcatgctgaatcattttgaatgtaaatgaggtatagctcttggagagaggacaagatatcattgataagtggttggtgacccccacttttcttttcagagacaaatgaccttgcttttacttggtcttgctgtatttatatagggatcttactgtatttgcatgcttgcttaatttcaatataaatttatgaaatttattatccatcaagagtcaatttgtcctctaaatatttcacttagatgatgattttttttaatcaccaccaacacatacacaaacagaactccttagcaattccatttggctgtactgctatctttaggaacatttatcttgctttaactcctctcttttttacagacatttagttttctgtgacattgtttactttcgttataccttaattatgggattctgataaccatggaggagtaggagagacaataaatggggttttgtgggtgattaaatgctaaagcaaagctgagatctttgataagcacaacagttgtttctgccagtatattccaaaggcaagactattcttgcaattacacaacaagcaaggggggagaaacacctcccacaaatcactctgatatgtttcttaaccactgtgcttttgaaagcctaatgctctttcttctgatgtttttttgactgtcagcctgagtagttggctcttccttggtacgaggctatttaaatgacaggtcctttctcagtgtgaatgtgtcagctatctaaatgagtggttgaaaatgtacctccgcatcagccatgtggaccacggcatggtctgaagaaaattatgtttgagcagctatgattgagctcaattttgcaaaagcttactgagttttaacaaataatttagccctatcaagcagaagtgcatttggctgcaggtaatagaaaactgaatcattggtggttttagcaagtaggttttctttttctcacatgacacagattggcaatactgtcagagacccagtttcttttgtgctttctgctctattttttgtagtctttcagcctttatcgttgggcttattgtctcagggttgcaaaatgactggtctgactgcagattttctaggagggaagtgcaaagtggtggtgctggccacagctttccttctttgtcaggacagcaaaagtttcatcggaactccccagtggacttgctctcttaattcaaaatggctgtaacagtgtcacgttggctgcacctgtttcaaagaaagttcagaaaattgggtatttcacagacacattaagatttcaaacaaagacgagagcattcacaaggaacagagagggaacgtatgtggatggggcaagtaactgccagtcatcagcctgttatgtactgtacacatagagttttgctgtgcagcagcaaatataaaaatgaatgtcatcaccatgaaagtggaaaaccgtatttcaatgtcatgcaaatgccataattgaaatgaaaagataggaaatgctggtgcattgtctacattaatgtatttggttgttgactttattgcataaaaagtatcagtggggacgagatagttttgctttgtttcagaagattttgcttttgtttttcccagctaagaagggaaccttaaaaataatgaggagggccgggtgcagtggctcacgcctgtaatcccagcacttttggaggccgaggcaggtggatcacttgagattaggagttcaagaccagcctggccaacatggtgaaaccccatctctactaaaaaatacaaaaaaaattagctgagtgcggtggcacgcacctgtaatcctagctacttgggaggctgagggagggagaattgcttgaacctgggaggtggaggttgcagtgagctgagattgcaccactgcactctgcactccagcctgggttacagagtgagactctgtcttaaaaaaaaaaaaagaaaagaaaaacacacagatgtatgaaatagagcttattaattctgtatatattcacagaaaacgcatacttttatgccttgattatctttaggtgatcatggggaacaggagcccaaagataattaacaactgtgctaaaacaacaaaacctcaattgggctacaaatgtcaatatcatgtacacaggtggaaaagactcttctttgatttcatatttttcttttatttccttggcatccctgttctggttatgtcttgctgtgtactctagacataggttttgtgggttgactgagctcagccgggtggttctcactggggtctcttatgccctggctcttaaatggcagctggggctcctacacatggcatctccatatggcttaggcttgtcacagtctggtggctgggttctgaggctgaagtttccaagagaccaggggggctgctgcaaagcttttaacctgagcttgcaagtcatgaagcatccactttccgttggttgtgctggacagcccagatgaaggggcaagttcccaaggacgtggatacctagaggcatggttcattagggaccaactttggagacaaacaaccacagtctccttccttctcttcccttggggattgaaagggttatcaaaagctggccagaaagagaagcaaagggtgaggataccgctgctgcagcacgtctgtagtagggaatgaacccagaatgtgaagagttgccattctagtaccctcgagtgtccttttcatgccattggaaacttgacaatagtaattgggagtgagttgaaatcttcagctttctacctttgtattgtcctttcagagcaaaaagaagtaaacattaacttaaaaaatgcttttgatattaatagttacaaacaaaaaacaaaacatgcaacaattccaagctcaaatcaaaaccaacactgagctttgaggtgcaatttctattctatgtgtgtggccatctcctcttgtgttagtggctgagcagagaatgctccattccaaaataaatagaattaattttcttaacagcatctttctttgtgccaagaacacagggttacaggaagcacatctgaatgtaccattggcaggttaaatcattctctttactttggtctttggtgggtttttatgtttgttgcttttcatctgaatgaatggcaatagagcaagttttaaaaatccttagggatctccagagattcctgtcttgctaagaaacaggaaggccgcaattagcagagaccaagaatgaagaggaggagaagggggcgggtgtctttgttgctgtaaactactagttttcaccattctgcaccttgggctgtgttgctgctgctacctggaacacccttcctccccctcctctgccgggaagactcccacttagcccagatgcagcccagctgctggcttctgcatgcagcccacctcttcttgctggacagggtggcgtcttgtcccccacacccacaattcctgtgcctatcactttgtctctgtattccttcctcagattgtagctccttagtggcagggaccagctcttagcctgatatcatcagccaagcaacgtgtaggatgcagaggtttggcaaaactttgaaagcgggaatgtatagtcaactatgtcgatgtctgggtcatttttccaatgtctggtagcaattgtgttaggtggcttatacctctcctggacccacacatagcaaattctaaaaataacaaactggaccatataagcttttccaaaagcctggggtgggggagatgttataatatcctgacatagctgtgctgttgttcatttcacctctgtcacctagagcaaccccctccatgttttccaaaaccgcccccatcctcggggtctggtttgggacccctgtcctcctggaggtcctctttgaaccctctggacccttctctcagagccctctggtaccttgatgtcacagcatttcctgtaatttcatttccctggcctcttggctaagataataggctcctgtccttgctttttctctgtcccctgaaaggggtgaagtcgtgtggacatgtggcaggtgccactattgtttatctgctgaacactagcactccccgtgccttcatgccatcaggcagggggcatttgttcttttgacggtgtggacaggggcagagtttagtggcattgttcttttttagcttaatgagcacgaactgtcagagcttggaccaaatttttcttgcagatatattttgattgacaggcacaggatttttggagataattgaaagagttgccaacatttatcaggagactgtacataaaaatacagagttccagtttccctcaaaaatttggaagttttggcaaaattgagtcccaattaccaaaaattgcttctaaccaagcagtaactattcccttcacacagaatgagcctcccttccctcatttcctgtaaaatggtactgcatgttctcctctttcatttgtgtcacctgcctcattggtgggtaagttgttctagaaaatgtctatcatatgtgctgctgtactgctaagtgcgtagagccctagtacccacagggcacacacaaacaaacctggtatacaaagaacttctgtgcggatttctttcttattgtgcacattttaaggggcatcagtctctgtccatgcatccttagaattgtatggctttttcatgatttgatttattcaacaaggatcgaacagtctgtttgtattgagtatttactatatattagttactgttctaagtataaactcattgatctcacaactctgagatgggtgcttttactatctccatcttacagatgagcagcagtttttttgttgttttttgaaatggagtctctctgtcacccaggctggagtgcagtggtgcgatctcggctccctgcaagctctgcctcctgggttcatgccattctcctgcctcagcctcccgagtagctgggactacaggtaccagcctccatgcccggctaattttttatatttttagtagagacggggtttcaccgtgttagccaggatggtctcgacctcctgacctggtgatctgcctgcctcggcctcccaaagtactgagatgacaggcatgagccaccgcaccctgcctagaagcagctttaataccaggtcacacagccaggaagtagactagctaatgtttcaccttaggcacaggtggagggagtcacacatctgtaagatttgttcccaggacaatatcattttctttaaatgtctgttttgggaggacttcaatgagctctcagatagaaacacccatttccagggagcattcttaccctagaaaaagcttgggacagttgtattcagacagctctgctgttgaccatgtaaggaactctctgccactcttcctcatagctttggcggggattatttgtctttagacttgttcctttttgtgaaagtgacagtagtgatagtcattagtagttagtagtcatggttacttttgttgagcacttacagtgccaaatgtagtaagcactttcaaactgtattactctccccgtttctacttgggaaactgagtattactgtgtgagtgatggggacttcttgaaagatcctaaacatgggaatgtcgtaatcaggttgctgtttcatggatttggttccgaaagccaagcagagagcgggtcaccagcacagtagtaagagtcaggaaaattggttgagactgttgtgtacaggggagagttgcttggggcttgaactaaagggacggtgaagagaggggtaggtttgagagagacttagaagatagtaatggcaaggcctggtaaaagacgggagtgatttccagttttacagtttggacggcagcatggataagaaagaatataaggggctgggtgtggtggctcaggcctgtaatcccagcacattgggaggcttaggtggccagatcacttgaggttaggagttcaagaccagcctggccaacatggtgaaacctcctctctcctaaattagctaggcgtggtggtgcacacctgtaatcccagctactcgggaggctgaggcaggagaatcgcttgaacctgggaggcagaggttacagtgagccaagattgcacgactgcactccagcctgggcaatagagcaagactctcaaaaacaaaaccaaaaaaaggtagaaagaaagactgtaagaaggctaagaaggcatcgtgcggacaggggagtgaagtgtcacaaactgtcagtttgatgtactctgtgactttcagttgaagatgtcacaagattacgacaaggagctcccagtgtcttcacgtagttttcccagcttactcagtaaatatttgttccctaaatgaattcatgatttccatagttactcagtaaatatttgttttctaaatgaatctatctgtaagcaactcaagtaatatcccctcctaccatttatcttaatgtttgaatttcatctccaaccacttaaatcatagtctctgggagatgggagctaggcattgacatttaaaaatgtatgttcggccaggcacagtgactcatgcctgtaatcccaatactttgggatgccaaggcaggtggattgtttgagttcaggagttcaagaccagcctgggcaacatgacaaaaccctgtctctaccaaaaatacaaacattagctgggcttagtggcatgcatctgtaatcccagctacttgggaggctgaggtgggaggatcacctgagcctgggaggatcatctgagcccaggaggttgaggctgcagtgagccgtgattatgctactgcactctaacttgggcagcagagtgagaccctgtctcaaaaacaaacaaacaaaaacctttgtgtccacagatattctaatttgtggccaggtctgacagccactgcttcagttttaatgaaacaacagatgaaacaggtctactgagatgttcttttactcatccatcaatttcatttttgagtgtctaccactgttttgagctccatgaaactcaaaagtaagcattgatgtgttcacctctgtgttcctagtaccagaactgtgcctggcacagaataggtgctcaatagatagttgtagaataaatgaatgttttatgattctgagcacttagagaatactgcgctctagtaacatacaaccatcagtgtctgtagctgtggcaggaggctttctgcttctgaggtctctctgtctggactgttgtgctattatcctctcatgtttcttcaaggcagaggggttgctgcctgggaaaggtgtacactttggagagtgaagtcagactttgctaagtgaacgcttggatacgtgttgtgcatctctgttcccaagtaccttctctgctatggactgaattgtgtatctccaaaacttgcatgttgaatctctacccccagtgtgatgttatttggaaatggggcctttggaagataatcaggcttagatgggtccacaaggctaaggccctcataggggaattactgcttttaaaagactaggacattctctgatcctttggaagtatatttcctttccatcctcttctctattacctgccttccacctgcatcattggagttggcttcttggtgttgacaaaccttacaatactcaggttgaagacaagagcagccgagaaggagcttttgtagggagtggttgtcagtgtctggtgctttaatatttccttccgttgggatttggaaaaggcagtcccacatagaaaattgttccagccgaggaacagcaagtctgtctgtcaatctctgggtatattgaagacatctctctgagtatattccaaatgtactcatcagtgacgtactgcttctccagaaggtccccttaggaagttgaaaaagattctaattcctaacacagtagctcctgctattttcctatgtatgtttttttctcgcttttatcttctgctttaccaaaatacatttacataaacaatattagtatgtgtacagaaaatatgaataaagaaataaagattaaaaaccttagaagaaatgaaaataaaaacttaagaattggaaaagaattctaaaatctcaaggttgaccaagctggagggtttttttgtgcatatttattgcagttctaccttgtgccaggttttagatactttcttttaatcacagaactttacaagatacgtattatctctattttatggattagaacatttaggctctgaaactcaagggcatgtagctgctacatggtagagtcaagattttaatttagcatgcctaactgtaaagcacctttccttggtctaaaggccagtgacagttcctaatgaaagttttcacacgtacacaatgaaacaagaaaatgaagacagtgtagaagatttttgataaagcaaaatacaattaactttaagaaacctgttcattattttaaaatacctatattggctaaagtttggcaatctaacgtcagacccctaatcattatatatatatttttttcttaaaagtctactcgttcgtgaaatcacaagttcacactcagggttcgtgatttaatggtggaacaaaacagaatatttaaagttgggaatgttccagaaaagctagatttacaagattgtcttaaggccccaaagaggaaacaaagatttggcttgctgatcagagttaaacattgtgtacaaaataccttaggaggaatttgagacctccgttatttcagacttaggaaatagccctttcttatctctcatataatggtacctgtctctcaggaagctaggcctcccttgcagtggtaatagctggcctgtggagccccttcacattgcattacggcaattccagtgcctccctttcccgttaggaatctaagcttgtactaccttttaaaatatcttcaagagtcaatatgtggatatctgagtgtcaaatctggcatgcactgtatttaagtatcacttaggaagaaaagcaaaaccctcagccccttgaaatgatttttaaattaactttttggtggaaaagtcccattttatctgtgcaacttaataccctttgtgcaattttagccaacttcttgaaaacacaggaggaaaacaacaactttcattatctcttttgctctgaatagcagcaatcatcaaaccaacatccaccaccttcttgttctcctgaacttacgtatttttgtatatgcaacaacttagggaaaaacataatggcaggaaagaaaaccttttcccctaagtaagaaaaatcacagaaaatcattagtgtgctaattaaggaacaaaaatcaaattgtgaaaggtttcttacccagattgaaatgaataggcctgggcttgttcccacagtggagacagggctcccggaagtatgctggaagcatgcaaggccacttgccgcctagactcagaaatgacacatcgtcacttccaccatgttccattgattaaagaaagccattcaggccagcccagattcaaagggtggaggaaacagaggttgcctataaaagaaggattttgaccatttttacaatttaccaaaggagtgacttggtcgaggatattaactaatttaaaggagttaatgtaggtgaagctcttagaatgcctagtgcatgacaattgttgttttgctattttttattattattactgtattctctctaggcgtttcccccaggagcttattgaacgtcctttaatcttttgttttgtttttaaaaatgatgttggaggaacaacggtgacttttcaggccctggaaatgctacatatgggatggtatcgtagaggtgtttctttgcctcccatgggcgcccccggttttgctctctccccctctaggtggcgctgtcggggatccccagctgtcccacgttgtcttgcttttcctttcctctctgtcaaaacgaattctcattcttgattcttaccactgcagtgtttaccaactttgagtgatatatttcccttttaaagaaaagcagtcttgtgaatttagttgttgttttatatttttattatgttacttaaatatgtacaaacataaagctatgtataaactaattatgcttgctcataacttttatgcatttataaaataaaggaaatgaaacttgaacagaacagatttaaaaattaaaacttcagaatttcaaaatagcagcattaacctaacatgacagatgatattatttttactaaaactacatccagacgcaaagccaccgtggcctttgatgcctcagttaccccacaccttctctgtttggactcctgcaagctcttcgaatacagtgtgctgtgaaattattatcaagttgattataaacacaaatatgagaactgaagttacctgacagtgcttggttataagatggctgtttaacttagtgctctcaaattttactgtgcaggtaactcaccagggatcttgttaaattgctcactttggtacagaggggcaggggtagggtacagaattctgtgttttaaataagctctcaggttatgcctgttggctgatctgggaatgacactttgagtacaaggatctgactatggttccatcatttgtttagattattaaacacacaaatatttaagaatcagtcgaaaacatgtttctggataggtccttggtctctagtctagtcactgcactaaaacatacaagcagttaggttgttagagcattatactagccctatgggaatcagatccagacaccaagcatgaagttgcatgtattgagtatcaggcatcagccagtaatatagggagggaatgatgattgtacaaagacctccctggacattccagatgcaactcacagatgatgactccttgaccagtgggacaggcctgatgtggttttgcctctaataaatcaaatctttccatttttacccaagtaaaattttatttgtactttccttatgatcaccactcacattttgcctggtcttacagtttaaaatgtggtacagctttctttttctatgttaatattctgagggcaaggatcatgttctattcctttttgtacttttcatacagcaggcatacagacatttgtggaattgaatgtattagctagataaatcttgagggtgccctctgctatttgcataaccaagtttttttctgaaaattccaggaattttgctctttctgttatatttcagactcgttattttatttactactgctgcttttttttcttcctaggaaagattcctaagatttaaatgactaaagcttagtctctgatatttgaacataaaccacatttttattgctcttggctctcaggtgcgctttgcttttaatttttatctgagaataaatgttgagaagattagaaacgcttatttagttgataatctgtgtgaccagaatttatcctttctaaatagttccatagcagtcttcgagagagaagttctggtagaagaggaggtagagtgagttgttctttaaaaaggaaatgcaagtttgtagagagatacccaggtgtgggctttatgcatgaaatatttttcctatgagaaaaaggaaaacagtgcctgaccttatcaataaaccattgtaagacgtcttcagcgtaggtcccaaggacattccaactgttcttttggactgagaaactctcaggtagtggttgggagaaaaagatccagaggtcgcagtgggatatttaacaaacatatgaatcagctgtatagcacatcagagaacagagagaccagacataaatgcataataaggcaatattctcatgatattgataagaactttttttctaagttctgttgatctgtctttctacccattcaatcattaatttaacattgtattgagaaattaaacacagactcaaactacacaaaataagcatagtttaatgcaaagattcccaaaatatggtctccagatcagcattgccttggaagttgtgaaaaaagcaaatgtttgcactccagtggagatttactaaatcagaaactatggaggtggggtgtttattttaacaggctcttccgaagcttcccatgcatgcttgagtttgagaaccagtggcttagcatgaactagtatgaggtggacactttgaaaccagcacctagctaaagaaatagacctgccagtcacttcagaagcccctccatgtgtcccttcccagccataattcctttctccttccaaattacccactctcttgagttttccagtaattactcccttgcctttttatagttgtgtcactgaattgcatatccctagccgcaatcatttagtcttttccatggatattaacttatctttcagtctatgcattcccccattgtcccctccttttccatacagtgtatctgatgaagaacttggactgttagacctgttggaggttctcagagtggattttgctggttgtgtactcatggtgcagtgtaacatgttcctctgaacttcctgagtatcagcagctggatataggggtttcatcaaatcttagtcctgtccttttgctaagactataggtgggactgcgttttttgtttttttcttttctttttttcatcaggaggcgcaggaagtctagttctcactgtattttgatgttaacagccatagatactcaatacttagatcgattgagagaagcataatggtgacagtctgtcatttcattttcatttattagctggaaagtcttagatggaataaatttagatcactatatggctaccttgtggtagatttcacacttgaaaagccggttgaatgctcagttttccttttatttacctaattttcaagatactgaattgcttccctgtcatgttcagaaggggaccaattaaagaaaaaaacaaaaaaaaaacatgaactactaggtttaaacgtagtggaagagtaatcaaaccgtagcaaatcatccctattgaagctcaaattgtcccatttttggccagtgggagcctcttcaacttggctcttgattccttttggtataactctagcactatttgattccttccttttttattacaggctcatcttgtgtatttcctgccccagaccaagagtcagccatttctctgagaatgcaccctgctcccccagttctttttgataggaaaaaaatgtcaaaaccacaaaccagattctcataactactgacttgattcttttttactgagtcttttcaatgggcaaaactgggaaatatccacttctatatctatatagctttttctatacctatacatagatgttatatgtatttaaatatatttaaagttaaaatacctcatgagtttatactgatatttccaattcaggactacagggttttaacgtcttctgtatggcatctatatcttctttttcctgcccaaacaatcttgattctcaaggacatagagtatgctagattagaatatgtcataattactcatttgcatgcttccacattacacacacaatattaatactaccaccaccaattatgattactaaaaagaattaaaacatttttgtgcatatgctattctcattttcctctattattttatagttatacctaatctgtttttatcaggtaatagttattaatgctatactctcttccatttaacccccatttaatgttcttagtttcatatatttgatggtcatcaccattttcacgtcaatgacatgacacttggttgtccaaagctcattctgtagtagtcgccttaggaagaagttatgggaacagaataccttgtgttcttacatgttgaaagaatgttttctctacttaatgttcatttttgcttggatataaaatccttggcttatattttctttcattgagtaccctagatacattagatcatatccttctggcataaaaccctgtcaaattctagtgataatccagtttttattttttcttacaagtcacattctctttttgcaagaagcccatagagattttttttctttaaagtcttgtcattttactagcatatgtcttgatgctgatagttatgggttgttattctcacataagtagtttctttttttgtatcttaggacagtttttcttgatttatagtttttaaaatttgttatgttttcttgttttactgtttctgccttctttagagactcctgttgtccttatgttgcatcttacttgtctgtcttcaaaatttatcaattcttgaaggcttcttatctttcttaagttcttttgatttttttaaaaaaatttaatttcccccttctacttttgaagttatttggttttattattcactcttaagtttcttctagttaagcctttttaagaacatttctaattcttttctaagctctgtcaccttatttctgaactttttctagttccaatttatattgttccttcatgtctagcgtgttttcttagtgtcttttggcaaatctggaaattgtatgttagaattgtgatctgattttggagccagttttcttggtgtgctttcattatctgtggaaatgttgttttattcgttttcctcttttatccttaagcaataatgtgtggaattttctctccatgcttttctgttgctcattttcctcacgttttagaaagagactttgttcagatggatttttctaacttcatagagctctgtcttctattgtttttatgtaattttttttaaaaaacttgctttgtaaatttttatgttgttttttccttttccactgttacctgaatcttctctttttttttctttctgttttgctcaattttatttttttcccagcagcttctctccagtgtggtaccttgttttgagagcaggtgctggctaattgtgtaacaatttgtgatttatccttacctatttgtatcttgatgtttgtgaggataccttgtctcccagttttgttgtaaatgtccattaatttttgaacattctgtttgatttcattgctctgtctttcgacatgtagggattctaggagttccaaaaactgtgtcactgctaccactgccatctcctcaggaattcctcagtttttcaaatgatgatttttgaaattttagagtctataacttgagagatatagcatttttggagctgggacaaaaaagtttttaacttaattatgggaagtaatgaaaagaattggcttctaaaatgcaatgcagagatgcataaatgtattctctttatcttgcccaattacagagcaaaatagatgacaatacagaaataaacatggtctggagtagaagtaggttaatccgcatgctttagattgacttacagtatatacactttatttcttcattcagtgaataaatttatatagtgccttacaatggacagatactgtacaacataaaaaatatgttgacccttgcctgtctggcctaccttgaaatgctgtgtataacaaaattacacacagaagacctcagatgtggcaaagtgaagtgagagggaagtgactttcccaataccacacagtactttgagaattagaccacaagcctggatatctgtaactcccaatccaagacttcttccaccccaatattcaatctcattactaagtgtcaagaaagtggatttgttaccaccaaaaaaagaaaactttctgacattgagtgtgtgctgttttttgaagaatgttgtgaattctctgttcttaaaaagtcagtagtgcagctttcaatgtagagttcttttgttcaggcttacacaactatcaccattcaccagataacttgctgtattccagacatcattggctgctttgtatacatattcttatttaaccctcaccacctggcaaagcattgtcctcatctctagtttacagaggaagagacttattttaactcagagtatgttgtccaaaattaccctgctaatagactggtgattctgtggaaacagacactttcttcttttatatgtaaagtgttctgggtaacaaataatacactctcttctcatcactgtgggcaccatggtctgggtgcctcattggcctctctatcccctcccaacacatacacagaagagaggagaggagagaagcatcctaaatgcttgactctctcggcagaaagtctactgtgtctaatggtcttgtaggagggaggcagcgacatctctctccctgccttcttcctttccattcccctctctactaaattagctccctgagcatcagagtgtaaatccagtttctcttacttgtgcaaacatggacattcttatgccactttgtgtgtaaaatttttacatgaagtctataacctgttgctttggtatgtaaggctgtagaatgagcaataacgaaaaccagaaatgtttgggggaaagaagtttttgtctgatcttctatattcattgacccagacaagtgtcacaaggaccatgagagtctggggagcctgggacattgcccacactctgctaatgaagaaactgaaccacacctacatctttgtctagtcacacctagcagcctctgaccttgctctccttgcctcactctgatccctctagaatccattgcacataccaaccaactcaggccctaaaactcttcttttgtgaggttactttccagtctttaacctattggctttttctcattgttcctcaaatcaaatctgaactccactgtctgcaagactctcccgttcttttcctgaccaccttggctgacagctcttggagaagagggcttagattgataataatctgtgatcctttccttccaccttgcctagctctgccagttcatggagtaacattttcttttccacagttactgtaaaaagaaatcgattctttttagctaaagtaaatgacatccaactctccttacatggaaaaaaggcactaaagtgctgacagataccatctcaggaatggatggatattcttgctgtttctcttccaggacaatcagaaacaaatttaactggtgaatggccattccatgtggaagggaagtggtaacatagggcactagattaacctagtgcacttctcagtaggattcatggtatttctatgtaatttccacttacaaattacacatctaatagaatcttaaatgggaagacaaggatgagtcatatgcccaatccacatttatgtcttcaaaatacgctttgaacaacaaagccacatatacatgttaaaaggcctagtaaacttctagaacactagaaaatcctgattgccaggatctgttagtcactccactccagacagggttttgacaaaatgccttttcccaacagaggttaccatcttcacaagaagaccacatttgtatatatgtggccagcagcattcgccagggtacgtacctcaaggaagcttcaaatggccattcagtgcgcactcaaaagggatcctcagaggagcattcagaccatttgcttaaatgattgtgtgctcattaaggtgggcagatctgcagtctcaactagagatctggtagttaatctgggtccaggatgtttcttaactaaacatgttaaaggagccggataggttgctctctactgccaatttatcggttttacttttctccttggctacagtgcaatttggctctttggtttaatccccttgagaagccagaatccattggcatgcggagctctgggtcttagagcaatatggctctaaaatgtacgaggtttattctgatggtccctgtcacattagcagatggtggcatttaccatgttgatgggagaggagtccttgtgctctcagccacagatggcccgggaggctgtcccagcagcagcacctcaccctctccaacacatgccatgtagttagttgttccctctctttgttcctataccacttacgtttgcatttctttcatgcagttcgttggtggtggttatagtcatctgttttgatgcgtgctccccatattaggctgctaaggttttaggggcaggtacctggcttctcctccagggattaagagatgcaacgctatgctcaaggtcacaaaggtgctgagtggcagcagggtaggattctaagcctcattcatcagtctccaaagttcaggcttttaattagaaggcctgtcatatcatagaaatcacaatggtcctcttagggcaaaataatgggtgtgaaatcgtggatggtccaacgataattacaataagaatcgtttatttgtttcttagaaactgaactaatcattttacaggcatcatttcagttagtcctcctaatagtcctatgcatgaggaatgtcatcaccattttcagatgagaaaattgagtgtcatagaggctaaatgacttgccaaccaggtcacacagctagtaagtagctccaagtctaacccagattgatgtgattccaaaaccctggtcttgggcatctgactgagaccccccaatgtatgggtgccttgctttatctaggctcagatcctggaggtcatttgttgttaccttgaatataagaaacacacagggggacaggcagactctgaaaatataaagttcattcccctgaatcaaatgcagaaaacagttctcttatgggttgtcccacttttcatttgaacttagtggggaccacgggaggggctgttgaaaatgaccagctctttcctctgccaggcttcctacacttacacacacacacacgcatgcacgcatgcatgcacacacatgcacacacacaccccacttcatgcttagacagtgataaagtgagtagctggggcaagccccccgacatgtggatgactatggtggtggtgatggtaggaatggtgccttatattagtgtaccttgtacgtttacacatatttatttgatctacctcaaggtaggtgaccaagtattatcagtccctttttcctcatgtaggaagaaactgagtgtcagagtaattgagatggagcagattcagactcaggactcctgtttcctgatggagtgcactttctgctaaagtaatagctttcaaactgtggtgggttgaggagccccagaagccatcataataagtgagggccaggggactcaaagacctacatcctgcttcaactggagcatctctgcttttatttgacgggtatagagggttctgcatgtggttttattttatagaagggtctgatgttctaacagtttgctactgctatgtaacaaaccactaccaaaagttagttaattattattgcccatgcctgtgtggcttggcagggctctgccagactgctctgctgcaggtggtggctgtggggcagctgggatggctctgttcctcaggcctgtcactctccttggacgggggatagatggtgcatgtcctgcacatctttcaggcttagacttggaactggtatactgtcacttccaaagcaagtcgcatggctgtgcccaaagtcaaggggtagggaagaacattgctcataatgaggctatggcaagggaatggacgcagagaggggtgaagaactggggacaataatgcaatctgcaagtccatgaaaaaattgtattatcactgctctgtttaaattaggctattaaagtccttcaagacttatttatccataaaatcaagaggaaatggctgttgtattgtaaaagacaaaggacttctacccagagataatcaggtctgaggactgttgcttctgaatggctgccagtttggattgtggtcagtgttctcatcttttcacagctttactcaggtagggtggatgtataagtgtgtgtgtcagacagagagagaggtgcaaaatagaagcacgcctctgtctatcagccttgtcagcttcgatccttgtttagtctgtgctttatcttctcccgtctgtcaatgatgtcccccaccatttactgcaggcgggtctatagatccagtctctcccctgccagtctctctttgtttgttgccctggtgtcactgcacctctgagctctaagtctttaccttctgaaagccattcctaggacaatcattaaaacctatggtagttgataatttctgaccctaggctggctaatttgccttcataaactgtcagattctgctaaggtcattgaatgctgtcatcttcataatgtggttcaagcaaaatggataagagaccaaacaaggagaaatctccctagaacacagtatgccagcattgctgtatctcaacaattaaaaaatggtgcgggagttacccagtagaatatttagtgaggtgtactctatgtggagttcataaatacaaatgcaaaatatttaatgcacagaatcagagttgcaaaataagatttaattctagaggattagggagacagaactgacttaaggctgtttttcccagtaagcttaattacttggatgacaatcattaaacattgcaagtcacctatcccaagtgatcgaagggcttttcaccaaatgtctgagtgagaaagtgattatcttatagaacaaacaagtatgataaagggaaacaatcagacaagtaattatgataaagaaaaacaagaaaaacggcacatccagcctgttttgtgggaagaatcacagaggcactatgtaagtacggctcctttatctaacagatcatttactaactatctggagtcaaagtcaagtttatctacatgctgaaatctatttccttctaataagattccatccacttggatctcagttatgtggcaatcttgacatggaacgtgtctcggaatatggaagggcatgagaaggcaccaaatcttcaaccctagcgctcgctcagggtttgattagagaagcagaatcacaggattattttacaggatttcttctctggatttgacttacgcagctgtgggctctaattaagcagacaatggaaagttgctgtgtctctctctgatgctgggacctgaggccagcagggtaggcagttgggaagggaaaatggacacgaagctggggaagcaaagacaaattagaacccatggggataagctggaatccatcaagatggactgaaacccacattggtctcttgctgcctttcaaggaacttccatgatggaggcgacttccaggagaagccgactgcccttctccatggaactcagcctgcatctgcccaggagtcagaggaggtgagggaggagatctgggaagggctggacaggcccatctgcttcctgccccctcagcctgctggtgagccagcagataacccacaaaagcctcaacagcccctggccccccatcaactttcaaaggcaccaatgcaaaagactatagctactgcttcagttccttcttccaaatgtcatatgaaatgcctcttaggggtctatactaacccagaactgtgcaggagagagaaatctgggaaacacagttccagcttagctaggttgacttgctataagtcaaccacacctagtctcactaagcccatttgtcatgtgtggcccactcagactgaaagaatctttgttggttcactgttttataagggccagcctttaccagtttgtccagctagggcactaagttcttagatgcagacatcagttctgtattccctgttaaggatctgcttccttaataggaatctttaaactcctgaatttgtaatgacacattcaaaagcattatttgagactaagcagtaatagtgtatggcaagctggacttacagtcctgtgtgatgtagagatacctaaacataaatgggcatggatattgtacacacatatgtgatgcaaataatatacaaatattgacataggatgatctagagttgataccagacagtcctcatcagtgcactgatgaaaccccagaagaaaagaggtttagccagcaagttaacccatgctgatgagcatctaccatgtggcaggtagcttctagaggtgcaggggatacaacagttaatggtacagtgtcagccgtgaggctcttacattgttttccaggttttctcaaccatgacatcattggcattttctgttgggtaattctctgttgtatgcatctgtcctgggcattttaggatgtttaacagtgttcctggcctttgcctactagatgctggtattcctccctctcttcatccccatccccgctgcagttgagatcataaaaaatgtcattaatcattgccaagtgtcacatggggcaaaatcatcctcagttgagaacctgtgtttcagaagagacagaaaaataccactgagatactttcagatgctaataggtgctcttaagaatataaagtaggctgggtgcagtggctcatgcctgtaaccctagcactttgggaggccgaggcaggcagatcacttgaggttaggagttcgaaaccagcctggccatcatggtgaaaccctgtctctactaaaaatacaaaaattaaccaggcttcatggtgggcacctgtcatcccagctacttgggaggctgaggcaggagaatcacttgaacctgggaggcggaggttgcagtgagctgagatcatgccactacactccagcctgggtgataaagcgagactccatctcaaaaaaaaaaaaaaaaaaaaaaaagagagtttaaagtagagtgatatggttacatgactaccaaggtggttgaggaagcccttgccgaggaagggcctttgatttgacatgcaggcagcccctcagagatctggggacaaaatgcatcaagcaaaatgaagagccagtgcccaggtcctggaggggaacaaatgtggcatgttgaaatagcaaaaaggctgggagacttgcagcatgggtgatatggtttgggtgtttgtcccctccaaatctcatattgaaatgtgattcccaacgttggaggtgggggctggtgggaggtgtttggatcatgagaggagatccctcatgaatgtcttggtgtcctccctgaggtcatgagttcacacagcatctggttgtttaaaagacctgggatctcccgttctctctcttgctccagctctccccatgtgatgcattggctcccccccacccttcacctttcaccatgattgtagcttcctgaggcctcaacagaagcagatattggcaccgtgctttgtgtacagcctgcagaactgtgagccaattaaacctcttttctttatagatgacccggtctcaggaattcctttataacaatgcaaaaggactaacacagcaggtgaggaagggaagagaggagggcatggggtagggaaggacagccacaacatgggggaccttgtgcatgggtcatggtgcacgatctacatttaactctggctactcagggcagtcatgggagagatgtgatcggggagtgatgcaatctgatttatgccttaaaaggaccacgctggctactatgtggtggatgcacaaacagctcttccccttctgcctcctttgccttgtgacccacaaggacccatgatacccacctgcagctggctgttgccatctattcggagttgtcaactaataacagacaatctcctctgccctgtgacccacagggacccatgatactcacctgcagctagctctttccatctatccaaagttatcaactaatagtagtctctgtgcctacaaatgattaaaattgggcttgaaaatatggcaccattatcatcagcatttcttgagcgctggccacttgtttctggtgctcgtgtgtgtacatgaacatccttgctgtgagtgctgggccccaccctcactgccatttaaaaaaaaaaacaacaaaaaacaggtgtctgcagcctctggtgaacatcagcttctccgtaaggctataatgggagacaccttcatagattttgagttcggctaaaataccctcctgtccagttactacctataatgctcttttcccttggatcagaaagccttttctctgtggattatttccctccatctataccccacattactaccccatgccttcataaggttttactctttactggcgttatgtccatttatatttgaattacacaagcatgaccattcatgctctttactcatagaagggcaccctgcccttcctggaaaaatgatttactttcatattggataccatttgaatatacccagctgtctgcgtggaaatagagaagtagacagaaagaagcctcctgctacagcctaggagcagaacagtaaacccaggtttccaaaatatctttctgaggtcattacagggtcatagccctggacagcactattcctaagtcatcctgaggcattctttgtgtgacaggcccaatggcatggcaatggatttcataatgaaaataatgaaacattgagataaaaagttaatttcttcctggaagagtctatttaataatgcaggaaaatgttacactttttagttatacttaattataaaatgctagaaaaataggagtggttttggtgttgaaagagttatttatctgagagaactatgaattatccagaatgcttctctaaagtttcctttttcccaaaattttattatttggcataatttcagtggaatcttccaaaagacattagtccattcttttgcttcagtgcatgtttttttggatagatattatctatttttgtgtagtgttgtaaggtttccaggatacgtaaaagttggaggatatatggttggtgcaaaataattccgtagagtaatgagattgaattgggggaggtggtttaaggaatacaaattcagtttgcctaaatagatgtaaaaaggaagggaaggaataacatctgaagctaaggaaggaaacttttgggctggagcatgactagataggagtcgggtagagctttttaacacagttgaagatagctgtggacgtagatcatgggcaaaactggtaatgtgaggatttaggaagcacgtttttaagctactgttgagtttcataggaaaccataccccactggtcataagagacattcaccaatagttttccatgggccttttgtgctagtggtagttttgttgggggcaggatttacaaaaatgaccatgcatttgaaaggtcaatgatgaaggtaagtttgagaatgaattttccatgaatgtcctgcaagttttattctttctgtgaacagcttgaattttcatttggtttgaagattaggaaaataacagtcatatatactcacagatcaaattcaagtactgattttagccatctatgagcaaaggccattcttggtgttagacatgaaacaaacgagagagaaagaaggaaagagagagagaaagatgtgatggactgccttggttctcataatttagaagtgagactataggtatatgcacaaggagctctgatgtgaaacatggatatcatatatgtcctaatggaaatgcacaaatatcctaatgggcttaggaagatttctagaaggatagggattccaatctggtttaaaagaaaagcctgaaaccttggcaaatgaagtcagcaaggatattccggtagcagaatgagcctgggcaaaggtgaggagtggagtgttgcctattttgttttgtgaggatgatagattcctgtaactggagctgcggaggaagtagatgtattggagattgtccttgaaagtatccagactgactcagacagcaattgtgaagttcttgctgatagatttgtactgtattttccatgcaatgcaagatccattagagggatttgagtaggagattgtcatggaatatttagaggatataattcagatttaaaccatggaatattttccttgatactattaaggaatgatagattctttgagctaaaaggagcactagagattatctattgaggtagtttccaaatattgttttagcacagtggaaaccttctttcaaatgacatcttacacaaatgccccagctacaaaacagatagaagagcagttcttgtggaatcatgatgggaagagtcttgatttgctgctttctgtttcttcattcctgtagcaatccctgaggtacctctgtagaaagcacaaaatcatggaacaacctgccgttttaaagatgagtaactcaaaagaaatgaaaacatattatgaaaccacacataccataacatcaccagcagccttattcataataactgaaaagcaggataccacccaaatgtttaacaggagaacggataaactgcgttgtgttcatacagtggaatagttctcagatgtgcaaagaacaacttactgattcatgcaatggcatacatgaatctcagaaatattaagtaaaagaagcatgacccttggatttcatttatatgatacacaagaacatgtaaaacgaatctagggggaaagaaattaggaagtgatggcctgggtggcagggaggagaactgattcaaaaggagcacaagagaactttctgggatgttggaaatcttctctatcttattttgcgggatggttacatttgtgtattccgttgtcaaaactcatcacgtggaacacctaaggtgtgtattttattgtatgttaattgtatcttaatgaataaaagttgagtttgaagattcttggagggagatttgctcagttcccatagctaggcatgagaaagactagcagctagaacttaggtttacaggattcctggtccagctcttttaaccgcatctctctccctcagagtcatcctcctcttcaccaacacagcatcaaggctggcttctccctccctggacatcctcttccctgctcaaaccccaccgtggctgtgaagtattaacttgacgacactgtgctctttgactcagcttttaaactttcctccagtgaaaccagaactggcaaacacagctacacttttcttgtaccatgctttacctgtattgccaacctgctgataaatggctccattccatagccttgagggtcttgaatagcttaaacattttatagttccatgggaatgagacaggggagaagacaccagtggcttccattgtaggcctgtctacactgaaggaatgccaactgcccacacacacttgttgttagatggcctggaggctcatctgcacagacgtgcagtttaactccattagggatcacagagtgatcacacactgtgctgtgctctttggtatatatatgaaaagcatcgctaagagaatgggagaggtggtgagagtttattgctgccttctttctcatggaagcattggacagcagggcagccctagtgaattgttgactgctccataagaatatcttgctcatttaacctcttctgtactaggtcttctgcctggagagtcctgggctacactgcccatccccagtatcccatgtattcatgtcagattcttgcagtctcctgaggatctttcaaggactggaactgcatcttcaccatctttgtgttcccagtgtctgcaacggtgccttattctagaaaagaacatcttaactgggagctgttttgccaggaccatcatcaaaaatgtctgaagatgtttttggttgtcaaaactggggacagggtgctactggcatctggtggataggggccagggatattgcttatcttcctacagtgtacaagacagttccccataacaaaaaattaccccacccaaaatgtcagtagtgccaagatcgagaagcccttctctagattatactttattgtatagaagataatagatcaaccacatcctcaaggctgggaccaatgctttgcattatgatgggtgtcttggtttcttttatttccactcttgattctctaagcatcatattcaagctctgagatgaggtgtatctgactgggtcaggtagccactgagcaaactggaataggcctttctgcagagtttgaacccaagtcaatgttgcctcgactcaagctcagatacctcatctaatcatcagtagccatagtaatagtagcccttagcacagaccactgatatctactgcttagaaggggtttgtgggggtagaaaatgaggttatattaagtttacttgcccaaagtcacacagccagtatgttttggagccagattcaaacccaggttgtctgaaggctccaaaagtcatcatttatcactgtatattttcttcttagctttcttgcatttcctttaatgttcccatctctccctagtgaaactgatttccctcaccaggaggttctctaggaattttggtccagggcttagattcttaaataagagcagggacatcaccatgtttgttatacgctgtcatttcacctcctctgttctgaatcagaatgaggccagcactctgggttctaagttatcgttttttttttttttttccattctatatactccctaagaatcttttttatgcttaaggtacaagtttaaatatggaaaaaaaaatctagattgaaatgaaaagccagacatttcctagttatatcactaattaactgtgttactagtgataagctgcttataaatctttcatcattaagataagattaccttctagatcttaacatttatgatcacagggataagttttttgttttgttttgtttgagacagagtctcactctaccacccaggctggagtgcagtgtcacaatctcagctcacttcaacctctgcctcctgggtttgagcgattctcatgcctcagcctcccaggtagctgggattataggtatgcaccaccacacctggctaattttgtattttttagtagagacacggttttgccatgctggccaggctggtctcgaattcctcctgcatcacctcccaaagtgctgggattacaggtgtgagtcacagtgtccagccaggatagttcctttttattgtaacatatccattttttcttcatttatacctccagtatccaacaagttaggatgcaggaattaagaaagaatcgtcctaaagtaggaaaggcaagatttgatgaagttggtagaaatcaagaagcacagttttgtaagctttgcttgggtgtggattgggaagctatttcttatttctccaagagtgtttagcttctcagacaatttctgcctcagtttccccatattttaatggggggaccaaacacagcatggtcatgcatgacatgtgaccgtaatgaaagtgtgactagcacattggaaacctggtgtggcagaaatcacacttagaatcaggtcaattaggagtcaccttagttttcttattgaaaattatgtgtaatgctgaaaaattaataagagagttccttaaaataacagactgaatttcgaagtttaggtgataattattttccgaagtctgacctgcccaagaccttatataagcacgttatggaaagcaagagtggtatatctttactaataaataagtatttctccaaactttgaaaaacattctgaagcttcaggttaaaaatatgtaaatggaaatgccctccacttgactgtatcacagctgttccctgtccctcatttgctgaaggactgagtacaccccaaactggtcagagcatgatgactttcagtaatgacctaaatgaccttaaaatatcagtaagtgacagagtattcgaagtcacagtctataacattcgcttagaatttccccttaagctgctggctgaagcactaattaagatctgaaatggaaggtaggtgacagatgctttgtgtcctgcagcagaggcacagaatgctgttctttcacttactgtttaataataataataacagccatttaatctgtttgctgatacagtctcctttgctttattatgttgtttattttgtgtgagctttcgatattagttataaaaatgtcactgtgtctgcagctgcatttttcattttagaaactcccagagatctcatcaatttaacctgccttgtacagttcgcaggaaaccactacaggcaaagataggcttaatcaaggttttttcttaataacgaacacaatacacaggaaagcagggcaacgaatgagcctttgattctaggtaaagacttattatgtgaaaatctatatttaaattaggggctttttgctaggattcttaactgcacaagacaaattactgtaggatgtctctaaacagcaagtgtgtcttaggcatttgaaatataatttaatctattaacagtttaccctagattttaagccattcattgttggcgaacacaatctagattctttaaaataaaaatagaaaagcatttgcagtaactggccattattatagctatagaaatcaaaggtatttcttgtataaattttgaattatatattgtttatctctccttaataactttcactatagaaagagctctctttcttgctcaatttacataaaagtatctggaacagttcagtgacaacagtgttggaaattaaggactgacttgagactgaagctccctccataactcccatgcccttctccagtactaagtagtataaaggccaaaagtcagataaacaacataagagaaggtggcagtgctagagatggggatgaggctgtttcatataatggaaggacaccagttgacattttccaaagattttccattataatcttttgcaaaggttctctttcactagttaacaaatataaaagatgccaactcccaccagactccagatgcttgtaatagaattagaaggccctccaacctttctttccaggggtcctgagggggacgtctttgttggcaccccaagcctgagtcactcctagcacctcaggaaagcatgtgttgtgtggcttcaaggataggcatcctaggagattttaccacctatccaggtgccctggctgggtgaaaactgtgcatcttatgcttcctcaatagtgctgtgagaatgctccactgccagtttgaggtatcaggtttgggttttcaggattgcaagactgctgtgctgtgcgtgtactggtgagttggctccctgcctttcccagcacccccatgcctccttcttcacatcccctttcaagtagaatagggaactgataacccaaccaggccccttattcccatcagatagcaagctaatcactgagacaacaagctttgcagtagagaaaagattttattcaccaggcagccaagcaaggagacaggagaatagatctcaaatctgcctcctcaaagatgaggtttaggaatatttatggaataaagaagcagtgtggtctattgtggggggaaaggtgattggaggtgggggaaaggtgattggaggtaagaaaaagggaggtaattggtgatctgcacagacatagtcaaaattcatggctcttcataggatgtatgttcatgaaatggcattgttagcatgatctgagggtggagtttttgtcctctgatgtcaaaagtcaaccaacagacattcatacaggcctagttgatgggttggtggtctcagccagtttgaactgggtaagaactgacctcaagttcctataaaacaatgtaagcaactgttaccatgatgacctatacattagagatgttacctatgaggaagctagtgagagtttagatacttttaggtatataggttttaagatcaactagaagtaagcaactaaaagcaagtgaggcaggttaagtttgtcaggcctaatcaggttagccctcgctttcagagtcatctgcccaagtacagtaaacagatccagctactacttagatactttgagaagtttagggttgggctctttcttcttagctttccccttcatagaggaaagtccacatttacttcacatgctaacttgtttgctgttagtagaaatctgcgggaagtttgccagagaagggtagcctttggggattggccaaccagctagcagggacctctgctgtgagtggcccatgctgtctgggcagctctgttaggtaaaggagaaagccatttggcttgtgtagactgcagctctgcaggaacctctccccaccatctctagccaccacctccagagtacagtaaattgtagacttagatttgctgtttccagcatagatgtcttacactttctagagggttccctctgctcacatagagccgttggttaagtggtggtgctcattttccatgccctgctggctagtccttggacattgtgagcatttttgtctccaatgccactgaattccttaaggccttttgggtgggtgctaaatatttaggcaactcttactaagaaaatagaaaacacttgagttctctgttttgcatgtggctatctttacatcagagccttggaagtggtcaactgtatgtagccaatttcatgaggctgttttaactgggaggacattgtcacctggctgggcttatacagctgagtcaataaggaaaacgcagcttttgttggcttgcttaccttttaaatcagtaagtaatgcacaaaatgggtccctcaccaccactacttcctttaaacctcatccccaactccacatcccatcatcatctctcatctcatctcgcagctttagctgatcccatggtggggaactggggaggcatgaggttgggggtatatgtgtgtatcatatattacttgggagaaaaaaaattgttttaggttttattacaaagcacccaagttaaaagagcagtgttaaaattgtcttatcaaaatatcccgtaccattgcattttcctgtttaaagagactgccataaactctaggggctacccaagtgaggagacgagattatgattaacaatcaaagtgatggggaaagttataaaaataggaaaaaaatatttagatataaagtcactgacctatgaaaccaccttgcaaatggtaggcaaaagaagtagtattactgaaaaagtatgaattgttacctttactctgaaattagtatgtaaaggagcactttgtttactgcactaaatctttgtctccagtttttaaattatgagatttatattgcctaagtatagactgaatacattttaatatttaattgttttttctcaaactatggtttgaaaaacaagataattcttaagctgggtttcattactttgaaaactaacagtgttttctaagagaacacgttactgatttaaaaatgtaaagtaataaaaatagtattcacataaagtttcagtagagttttagcacagaacacaattaaccagggcttaaaaaaaaccatttaattttgaggcaattgtagttatttcttgcagttgcaagaaataacacagagttctagcgttagcatttaccctgttccctcaatggtactatcttgtaaagctatagtacaatatcccaaccagaatattgacattttatagttaagatacaggacagttccattaacacaaagatcctctgttacccctttataactacaacccctcattcccatccctgacccctggcaactcctaatttgttctctgtttctataacttatcacttaaagaatgccacataaatgggatcatataatatgtaacctttgagatttttttttccctcagcataattgcccaagattcatccaagttgttgcacgtatcaagggcttgttcctttttattactgagtagcgttctgtggtatggatagaccacagtttaaacatttgaatgacatctgtgctgtttccaaatttttgcttattataaaaaagcaagcaggacttttaaaaaacacacttatagaaatgcttatggctgtgtcttattacagaatatttataaggagagtaagattaaagagttagagtcacttaggattaaaacaaatgttataaactatgacagtccagctcaaagtagcttgatttcataaatatattctctttatggtatttcataaatgccataaatcaaagtagcttgatttcataaatgtattctcttttgattaaataatcaaacttaagtaaattattggccagtgtccacaatagaatttgtaaatagttacattgtgttcatgtttgcatttctgttctcaacctgaatgactgctcaatatagtacactatattcacttttattaagcactgctctcacatctcattgtgtttgttgaacctggaaatgtgatagcatttgattgtgttgattttttttttttagctgccaagacgaattgttagatgtttttaaaacattatatacccttatgcccttggtgtctctgatgaagcagattcattaaataaacactcacttatgaatagcagagccagcacagtcatagtggatgaagtttataggttattgacggacggtaggaaatcagttgaaagatgcccggaaacatgtggttatgttggtaggaagtagaaaacgcctgcctggagtccttcagatcccacaacgtatgcgtgtgcatcttctcaggctccgtattagccctggtacgcacagagacacacagcgaccagcctattagttgcctggcagatgccgtcagtactggtcattttgtgaatgcttttaatatgattcacagaatgtctgtagtcagtcacgttttagcactgacagtaaaatgtcacctcttcagcagttttcttttaaaaaaggtgtaaagcctcttaaaaatttttgctttaaactcctatcgatcgtttagaaatcttattagcttgctttgggctttcttttagagttggagaaattaaaatttagagaccaggttgggctgagaaaactgcgtggagaaggggaacttgagttgaatcttacttacaccagacagtagggacactaaagaaggcaatactgctggaagataaaagttgacagctttatgaaagaaggaaacaagtgaatgagataattcggctgagagctcccggaaagcaagaattctttttcatctgtgccctcagtccctagttggagtacagcccaaagtaaggttcaataaatatttgtttaatgaataaacaaatggatgaacaaactgaaataagtgttgatatttgttatgaaatatgcctttctcagactgttccacacacctcaccctggctgtgccaagtttctatggctgcacaacaaactactccaacacttagtggcttataacagcagatggaggttcacaggcttccactggacagttctccttgacatctgttctgcagtcagaaggcaactggaactgaggtttccggtggctccgcttgactacagggatgttgggctgtctccttctcagggcctctgctctttgtgtggcttttccagcagagccgctgaacttctaacatagtgtggctcagggcttccaaaaagcacaaagggagaagcttccaggcctcccaaaggctaagacctggaactgtcactgtgttgctccctcttttagttaagcagacaagggggccagaccagattcaaagggagggaaaagaaaccccacctcatgatgaggcaccactgttttcccatcgataactggtatcaacccagcatcctacagctcaattcagttctgacactcaccatcccgacttagtacagaccctacaggttaagggctcagtccccttagactgcccccacttcagatgccagctgaaagtggaatatgcccaagttacccacacttcttcctggctgactacaaatgtgggggttgggagaacccccaggtttggcaattcactagaatgactcacagaactaaggaaagtgctatacttacaattacagtttattataaatgatacaattgaacaaccagctgagaatttatgtagggtgagggccagaagggtcttgagtgcaggaacttctgtccccatgaatgggacatatcactgtcctggtacatcatattttcaccaaccagaaagttcctgaaccccattgttcaagagtgaacaatgcaggcttcattgcacaggcatgattgaggaaataattggccattgatggttaactcaatctccagtccctgtcatttccccagaggtcagggacaaggttgaaagttcctctaattatgtatccatgtggctggcaccttcctggaaactatctaagggcacaccttgagtcaccttgatagcataaagatacagctcaaaggggttcattatgaacaacaaaagatgttcctgtcactcaggaatttcaaatggtttttgaagctctgtgcctcgggaactagggacaaagacaaaatagattttgctgttctatcacagggttgatgacaaagaatgtgtggccatctttaatctgtgacactggtcctctgcagactcaagcaaaatagatgaaattttacaaaggactgttttcctatcatttgcttagaaaattaccctacatgtttatcccactttcccctagagcaggtttctggaaagctaatgctatgtcttacgtatacataaacggatgaatgagacaaagtttgttgcattggtatgtgtgttggggggataggagggtgatgggagagcctcctggaatagtcttagagttggacactgtttccccttgtgactccttttgcagctactgccttgatcccctcttgtgcctgctaggctctgccttggggaaagctcaactcttctgtttccctacacttgaccgactgtctccatcgttgccttgcccatcttgtgttgtgtccacccaaacctgactcagatctactagttttcatctttcgctcacggactattctcttgagccagattcctagtcccctaactcaatcatcttattctggcttctccagtgttctttcaacccaatcttgctaaaaagctattttaatgcccgactgtggatttttggcatcgttatctcagcaggcctagcttggaggttcctctgggatttcctgctggagtcttctttttaggatttcccagtctacttgggatacttaaggaaaattatcaccttgtcttaggaagaatcttattatctcaaatcaaatatttaaaattgcaatgctcccttatctggaattttattttgtaagggacattttctgataagctgccaatgacagcctatgatatgaaattctgtatgtccctttgggttcaacagtaaccttaatgggatagttttgtctccctgtctcacctcaggtaacagaaattgtcaagtgcaaagaaacttttgtatccttcccacatccagagctagcttggagtttgaccttaggcaacaaccaactaactgtgccttgaagataactctctggggagttaattaggatagactgaataattcaaggggcagttttggtgaattaaattgggaaaagattttcgagtgttaaaggttgaagcattcccttcctattatttcagctcttacctctactttctcaatatacattaaagaaaagcaaatctgttcaatagatttgagataatctattaatttagaatgcttactagaagcccaccatggggctaggctccacaaagtttgaattgtggttatactgtcggttgttttttaaaaatgtacagcaaaatcctaggcgatcttcatgaactactccagaggccaccatcctagaaatctaaactcagctctcctttaagattagtcattttcttatccaaacaccacagagctttttacatagctttattacagtgcttcagatattgtcttgtaattatttgtttctcaacctgtcttacctattggacctgattaatttagaggtgggaggctgctggcttcatttccttatccaatcatttaaattaagcatctgacaggtaccaggcactatatttggttctagtgttccaaaggaagtagacaatcctcattttgtatgtattcttcttcttcttcttttttttttttttttaggtggagtctcactctgttgcccaggctggagcgcagtgacatgatctcggctcactgaaacctccacctcctgggttcaggtgattctccttgaactcggcctcccacgtagctgggactacaggcatacgccaccatgcccggctagcttttctatttttagtagagacagggtttcaccatgttggccaggccagtctcaaactcctgacctcaagtgatccacccaccttggcctcccaaagtgctgggattacacacatgagccaccacgcctggccccattttatatacatgctgtatgtttgttgcatgtgtcaatcattttgaagttgcatttccacttcacacactctttttttttaaacggataattaggaaattcagccattttgaagttacttgactctggttatggttgttttctaagctctgttaacacacctggtcaaaagtttggaagtcagacatgttttgtttgtcgtttttttttttttttctctgtcagacatggcctgcaccataagcttctgaaaaactctttgaggccagagacttggcttcattgatcttagtatctttggcaatgttttgttcgtagggaagattcagtaaaaggacatttggcatcagactaaaggaaatgtgttccattagatgtttaaatcacggtggtttattttcaaagccatagttttgtagtgtttctttacaacgtgattgaatttaaatgcactgggatgacttcctccaagaagaaggaaactggggggccgagaagatgtggcaaaagcagaaacatgtccatctctcattgggtagggacatcattcatttatttgttcccgtatcattttgcagattccttttcaacctgtacactggctgtctttctctcatccccaagtttcaagatctctggtggtatttcttttccatatcctttacctaccttgccttgctcctccacattcccaattccttcaatttttttttcctctctaatctgctgttttatggatgtcaagatatactctagttactcagctcttaccttagaattgagacttcagagtttcccactaagttccctttgcgatacacaggaaagggaacattaagaggagcacactgagactttaagcaggaaaatcggtaaacgctgaccatactgaacaattaagtctactattacttactggttttcttcttcagagcataaaccgggcttccctttccccagacttggctactgtcccctggcttgcaataacccctggctcctcaaaactctatgccttatacatatgcctttccaagtactcttgccatttggaggatgggaagatactatgtcagagaatcccaggatctgattggatggatataattgtgactgcctcttcctccactgtcaggtaagtctctgaatgtgcctggctgctctgctttctctgagtgccttctgccatgagccaagcttttctgtcaccataagcaatccactcatctcttcaagcagggacacgcatctacgtgattggtggccagatcaaatttctgccttctagaaggcatctttcatatccagtctttcacccttaccagtaatgttatggtctagacttcattgacatggttcctccatggaagatcataatactgtttcccaacccagacatagcatctttctcaacacagaactctaggcaactgctttcattgattggagttgtcattcaaattcaaaatgaagcctacttggcatccctagcagctagtcttctcttgcctagatcattcctcttcatttatttctagccacttgcctcaaccccctcgagtttaaccattgccagttttgattggaaaacctatttattgaacatctctggtgatttttctgctgtacccagttacctctgaatgtgttgcccatctctggaagaagaggtattcctatatacacaccccacattcactgagggcttctctgtggttagttcataactctctttcatatgtggtagccaatgctccattaattaggaatgatgttgaccattctttcttctaaagtctgcacatattccttctggagttgtctgtcatgatagtgtcacacttcaacaatgttgaggctcctggtaaattctacagaaacatttccattttcctttgttttatgtacagaaatatagttattaattaggtccttgggcacaaaaatggaggcaggcatgtgccatttaacatgtgtgttagggttctccagagaaacagagctaataggagagagaaagagagatagacagataagaggagacttattatgggaattggctcatgtgatgatgaaagctgagaaactccataatctgcagtctgcaagctggagaaccagaagagctggtggtttaactcagtctgaaggcctgagaaccaggggagttgatggtgtaactaactcccaagaaccaggagctccaatatcccaggggaggaggaggtggatgtccttgctcaagaagagagagagtgaattccccctttccccatctttttgtcatattcaccttttcattgtattcaggcaggccctcaacagattgggtggtgtccgcccacattggtgagggcagatgtacttgactcagtctaccaattcaaatgccagtttcttctgaatacaccctgaaagactcatccagaaataaagttttaatagacatttgggtatcccttaacccagttcaactgacacataaaattaaccatcacaatatgcttcacatatgtttttaaaatagcttaattttttgtctataagtcttgtacatgggtagtggttgagttagtatcttatcccttgagtttgccaaccccttggatagggtcagtgtcttgggttctctgaatggcatttaacacatggtcacaaaaaccttggtctgaagaactttataatgataaagttcaaggtactttggtgtcttgaggaactccctggactgtgaggcagagactcgcttggctctagtcctggtgctggatctaactggctgccattgtggggctcccctaaagataaaggaactcagtttcctcatctgtgaaatgtgaggatggaattcatcaccatgtcccctcccagctctaaacttctctgagtcttgtttttccctgctctgtatcctccactttctggcatgttttttatatttactattataaatgtgtccctattttataagttgttacagcacgagagagaggtaaggaatagttaacaaaattgtattctgagtagcctaatattcttttttttttcctgctaaacttctttttcctcaccttctcctaacatttttgtgggggtgggtggactggtgggtgactgtagtgatattgatattcagagaggagtgaaaaatgcaaaattgcaaggttaacaacagatggttatatggtgccattttaggagtgttattaaaagaacaaatctattttcctgaatagtaggatgtcttaagtgtttaggcttaaatctactgttgaaatagaaaaagaggaggaagaggaggaggagaggaggaggggaaggaggaggagggggaggaaaagtcaaggaaacacttagaacatttttgcatgatctcaattttcttcttgttccaaggtttttaatttggacagtggtatgtgcttcagattgaatgcaaggaaatttgttgcaccatttgcctgacagttatcattttccttgacgaaaagtttttctgaatcttgctttgctggagctacctcttcccttgccctgaataacctcacttgcttaagtcatcgatgcagtggactgacaccacctttctcttaaggaattaccctgttctctgggtaggtctaatttacactcccactatcacccaaagaagagacactctctatattgataactagaaagaaggaactgagactgttgtccaaggacatcttatctttagcatagagcgaatatgtggtttatggtaggtgttcaacaaacttaaaaaaaaaaacttgtattagtctgctctcatgctgctgaataaagacatatcgaagactgggtaatttaaaaggaaagaggtttaatggattcacagttccacatggctggggaggcctcacagtcatgacagaaggcaaaagtcacgtcttatatggcagcaggcaagagagaatgagagccaagtaaaaggagaaaccccttataaaaccgtaagatttcacgagacttactcatttccatgagaacagtattggggaaatcactccccatgactcagttacctcccactgggtccctcccacaagacgtgggaattatgagagctacaattcaagatgagatttgggtagggacacagccaaaccatatcaaaacttaatcaaaaataattgaaatgtcaggaaatagagaaacttattgagcttttttagggaagtggtctttgaacctgttttgctctgcccactggagtatgctgtccatcaaattgttagttcagtgaattatggtacaaacactcagttacattaatatgactattttcttgtatgctaatttgagaacctactccctggagatatgttatcccatgtaatttccaagtgaaatggagagaggatgccttagactgttacttctcatgtttttcattccaatcttcctcagtgcccctctctataatcccaatcctatacatttttaaacaaaggaaagccactcagatcacagtagctcatggacattggtgagaaacgtgaggaaatgtagaggatccccaaattctcacacataaactaaggtgcagccactgggtatcaagcaaggtttcctcactggtttaatgactccagttttccacattgacatttgtgctgggagccttacatatatgattttgtaaaaccctttctgcagcccttcatggtaggtagcagaatatttaaccctattgtaagagacaggagaaaccaaactgctttttctattctcacccgccattctacacagttctccagcagaatcccactggatgtcctatagtttggcccggttctaacactgtctacctggagatagcctcagatctcacaggtaaagggctcagccccacaagactgcccttcacttaaaatgccaatcgcaagtcccagattgtggtctgtacttctgagcaactggccataaattgggggttcccccaggccctttgtcatgtttgattaatttgctagagtggctcacagaactcagggaaatgctttacttgctactgcccatttatcacaaaggattttttaaagatacaagtggacagccagatgaagagatagatgcatagaacatggtttggaagcatcctgagtgcaggagcttctgtccccatggaattggggaacactaccctttgggcacatggatgacatgcatgtgtttttgttcacaaactgagaagctctctgaacccagtccttttgggtttttatggaggcttcatcacataggcacaattgtttaaatcatttacataaatatgattgatcaactcttccctctcagatgttgaaggtgggactgagagtcccagccctctaatcatatggttggttcccctggcaaccaacccccatcctgaggctatccaggagcccccagccacaagtcaccctaatactatacaaaaggacgcttattttggagattccaagggttttaggagttgtgtgccagggatgaagaccaaatatatcttattataaatcacaatatcacacctattataaagcactacatataaagtttacactccaagaataaaagatacaaatatggaatcttcaaatgccaagggcctactggatactgtgaatgacaatataagctacatcacctgttattgaaaaccagaatgcaagtgtaaacttgaccagggaacctgcggagatggagaagtttgacacctctccagcagcatcatagaaatgaacatcatgagcgcattgagggggagggttaatgtcttcatcgttcttcctctggtagaattatatttgcatccttcctggtggaaacttgatacttcactgtagtgcacctgtacctgtttttttttttttttttttttttttactttcttggagggagagttcttctatctcagaagatagaagaaatagctggaaactctatattcctgtgccctagcacaggagaccaggggtctccaactggtctgtggccttttaggaactggaccacacagcaggaggtgagcagtgggcgagtaagcaaagcttcatctgtatttacagtgactccccatcactcatatttccacctgagttctgcgtcctatcagatcagcagcagcattagattctcattggagcacaagccctgttgtgaactgcatatgtgaggaatctaggatgtgtgctccttatgagaatctaatgcctgatgatctgtcactgtctcccatcacccccagatgggactgtctacagatgggactgtctagttgcagaaaaacaagctcagggctaccaccgatttgatactatggtgagtatgtaatgataataaagcgtacaataaatgtaatgtatttgaatcagcccaaagtcacccccaccgacccacccagtccatggaaaaattgtcttccatgaaaccagtccctgctgccaaaaaagttggggactgttgccctagcaggtagagcaagggtatttcacttaggcttgaccaatcgaatgccttcattctggattttggatctgggagaagtcttgcagagacgaagcaacatttgagaagggttttaaggctagtttgagtttagtgtgctggtcctggctgccatgcattgagcagatagttcctgtggtaagacctgctgcccaagccacccttggtttctgcctagttttctaacacttctgtcaattctccattcttgaatagtcttctaatataggccttttctgctttaggtagccagacagaactgttccttgcaaccagtgactgtctaattcagtcacttaatgttttgtagctttgttcagttactgggcacaacccactttctgctcaggcggcttggagacagccatgggccatatgaatcgctattattttaactttcatagtaagaacttgctccatgtgggaaagcataattattttggtttctgagtttaataagcagaaagcaaagaagaaaaaaaatactgtttgcactgagcattaaaatataaggaagtaaagttgtttatagatagagtttcagctaagcaccaaaggtttatttatattttttgccatttatattttctgcctagttctgcctaggaaccagggaaatccatggcaaggagaaaataaagcatcaaagaggatgaaaatgttgaataaagtattagaacccagaacacttaaatctttaacatccatagtaagagtccttcacattactcaggcagactttttttttttccacctcttggtattctgtgcctacacttgcatgtttaaataacgatttaaaaatcacatgagaaatgatcaggctttctttttcccacttgactctcagttatttcaattctttgagacttgttaaagaaaccgtttagtgttgtaaatgccaccaagtctctacctagtagagattagaaatcctctcaccaattccaagttaaaaaggtcctgacatattttgatggaattggcccatgttctcatttaccagtgaccagctcatctccatgctatgatgctccccaggaaatgtgcatggtttttgtagaaggtggcgagaagcttcatgggcaccagcatccacaacccacttcttgaaaaacaaaatcagatttatatttagctgaccacctggcaagatctcctgtaggaagagaaggaactatacccctattactatttcagcttttattcacaaagtctttatatttgaaaaatgctttataatcattttaattagtggtttctcaccaaagccctggatgtggtattattggcaccattttctgagaagaccgtgtgccattgagatggaattgacacaagatgttaatgggttagaagctggtactagaatcagaatgataggccataggactcagcaagccatgctatttactgtcatcttagagggctaggtagggtggagggaaggagttgatgactgattgttataagtgaaaagggcagcagtgacccaaaacaccattgcaaatgttaacagaggcctgttacagagttaaagctgggttttccaaaacaacacatctgagtaaaagcgcccttggtacattagccagtatggagccagcacctgagatcacactgtgtttgcccctttctgcaatggctattggtgctggttgcttgtcttggcctaagagttttcagctgggcttttgagcaagctgcatcttgaatctgaggatgcgggcaagccaggcacagaactgtgagggtccttgcaatgggctgctggtgttcctgtcattcataagcttggacttggtccccactgtgtttgatttgggagaggttctttgaccatacaactcttaccgtgtaaatgtgctacaatccttgtcaagacatagcaaactatatttgaacattgttttaccatttactgttgtgtgcatgtgggccatattttcctagtcagatggtgagttctgtgagggcaaaggctgagtcattctctatttacattttaagtaggcatccagagacttggttatattctgagtctgtattattgatcaaagccctcacctggagtttctggggccattcactgacccagaatctggtgacattgacacagggagggaataacatccagctacagatggttaacacaggtctttagtgccccaatccccattttgctgactcatctatgcctcaagaactccaatcttcatgcagattctgttgcccttgagtactcagttctgtctcttctgcatacctctgtggagccttggatcctgtcagactcttcgtgttgctgaagttctcagtcctctctctcagccgagtgtaatagtgccccagtgggcactgtagggacagaactgagtttcttcttttcttttaggagttgattctctccgggtaatatctggagctctctaaagtttcagagagaaatacgttccttataaaccttgtggttgtcatgctggtgactccttgagcctgtcctgtgctggaccgtgaggaaggacacaaggccatccagactcctggactcacagtgatttcttgtcctccccaaagatgcctttgcctggtgcactctttaatagcccatcacttcttgctggctgtgtccccagctgagttcctccaggatatggcatcaactctgaacacatctctgtatattccctcttaggaccataagattcatgttaaacttagtgccagaaataaccttgggtagccatgttccttatggttccttagattacattcctagattacacattttacattaaaaaaaaaaaaacaaaacccaaagcacctagaaccgtgctggattcttgataaatgcttgtatccattaaatacatattgaagtaacttctactccagtgacccctctcttgaggcttactgtttacctcctcactttggggagctacccagccaggaccttctgagagagaaaagtggtatatttagtagtcaccagatagttactgttaacggtgctgagttcttaaaaaaacctgttaattgtactagcttaagactaaagtatatgttcctctcctcgtagagtgatgatgatggttttataaatactggttggatagcactgtaattaatgggcacaccagcttttattttggtaacaatgtattcttataccacatttaagaggtttctctttcctgtggtcataaagtgattaaaaaaaaaaaagagaggagagagatgacatcctttttaataaggcatcccaagcagtctaagtacctatgaattataaatgaaaacttttcagtgattaaaataaatataccaatgcagtccccttctctgcgtcattgcttcgccaggcctgcatgaaaatcactcagaggaagtcccaaggggccctgagatcatttgcatctgttccatgtgtttctctgatttatatcagagtgcatcaagggcagtggccttccagctggtttgggaagagggattcttttatccagaggaggcatcagctgatggtcagttagggctctggagtgcagctccatgtaaacaactagcctttgtagtaatggccatataatataacctagtccatgttttgttccctcaagaaccaatttacaacatttaatgttcaaggatggttccattcctttctttgtttacacaggtgaggctttatttagtagtgggaagtgaagggcagatggtttaaggggttcttaatgctgcaggagaggcccataaactgaagtatccaagaaaatccattctaaataagaggcaaacagagtctcagatggatataaattagtattattcttaggaatccttccttcccatttctcagacttatagcaaagctcttactgatatcagtggccattgtgcaagtgggtagcagggaaatcaccctcaatgaccaaatggaagtacatgaggaaaaagatggagaatcctggataaagaagacaactggctgggctccatggctcacatctataatcccagcgctttgggaggctgatgcgggtggatcacttgatgttaggtgtttgagaccagcctgaccaacatgacaaaaccccatctctactaaaaataaaatacgtaaattagtcaggcgtggtggtgggcgtctgtaatcccagctgctcgggaggctgatgcaggagaatcgcttgaacccaagaggcagaggttgcagtgagccaagattgcaccactgcactccagcctgggcaacagagtgagactccatctcaaaaaaaaacacaaaaaactgtctttttctagccctatttatttcaccctacactccatttaccttttatttgttgttaattaaataacattaatttttgttgtaggattatacgtaagaaactattggccttttgctgattgtgctggaatttaaaagttgtagggattgtgggccattgttctaaaatggctcattttgccaaacatgattaatggcttttggggtgcagtttatgtcaaggcaaaattagtggacacttcagcaaactggaatgtggttctgagctaaggggatattcacttagccattcctagacctttcttctatcagaacacgtctttaaggttgaatatccaacattttcaaacattttagtcttaaattctacctttagagtattattgatggtctgattagataatgaaataaattttctctcagcaatgtctgtaataaaacataatgcaggaaagatagcatttaataaaatatttgtttaatgttaataatatttattaccatcagattagaatcaagttaacatcaaattagtaagagatatgtcagtcacaggacttgtagggatgcgagaaaaagaccaccagagaaactgaagaaacaactggaatcatctttgaagaatttcaaactcatcattgagacattggcgagactgggaaaattatttctgaatcttgaaagaatgatgccccaagaccagatcatttaaccattatgtgtctggagagccatcatgcttcctggtatatttactgtggaaaaccctgactctcaaaaattaaaggaaaattacaactgtaataaattggcctgaattgcatggattcataagaccactctctttccatttcttcctacttaatgttgttttcacatagtgatcacttagcagagtttgggaataataactggcaaaaaagctaaaattcttagtccctaaaggaaaagtttgcaaacttattatttaatgttttaaaacccctttcccccgatgaatgttaccctgtccctaggagaagcttctctttcatgagttcatagatcaacagtggaaagatgattgtatttttgagccttgaggttcaactttttctcttctaagtcttttattctgcaagagcccttttgaatgatttaaaatggcattctccatttattcgtatttatcgaaaatctatttggagcaaggtattacatttaaagacagagaagaaatggttcatccactcagctaatatttattgtgtgtacactatgtagctacaagctgggaacagagtggagagcaaaagaagacaccattcctgctcttctacagttgagtctggtagaggagacattcatgattcattttttttttttttttgaagcggtataaccacccagtgggttcacattgcctgctgccttcacagagccaatgtatcgagacaggggaattgcagtgaagaaagagtaattcacacagagccagctgtgcaggaatgagagttttattattactgaaatcagtctcctgaagcattcagggatcagagtttttaaagataatttggcaggtaggggctcaggaagcgaggagtgatgattggtcaggttggagatggaatcatagaggggtcgaagtgagtttttcttgctgtctatgttcctgggtggaatggcagaattggttgagccacattactggtctgggtggtgtcagctgatccatggagtgcagagtctgcaaaatatctcaagaactgatgttaggttttacaatagtgatgttatccccaggagcaatttggggaggttcagactcttggagccagaggctgcatgacccctaaactgtaatttctaatcttgtagctaatttgttagtactgcaaaggcagactggtccctaggcaagaagggggtctacgtgggaaagggctgctagcaattttgcttcagagtcaaaccatggacagaattccttcccaaagttagttcagcctacgcccaagaatgaacaaggacagcttaaaggatagaaacaagatggagtaggttaggtctgatttctttcaccatcataatttcctcagttaaaattttgtaaaggtggtttcaatggagcctcactctgttgcccaggttggagcgtactggttccatctcagcttactgcaacctctacctcctgggttcaagcgattcttgtgtctcagcctcccaagtaggtaggattacaggcatctgccaccacactgggctaatttttttgtggatttttagtagagatggggtttcaccatgttggccaggctgatctcaaacttctgacctcaagtgatccacctgccttggcctcccaaaatgctgggattacaggtgtgaaccaccacgcccagccatgaatctttagattactcaagtaaatgtaaaattataagtgtggtaaatgacaggagatgtatagtagaggaatctcatctgtctagggataaagggctcccctgtggaagtgatatttaagggaagattaaaggattaagaacaattaatttgggaagggatggtgtcttagtctgttctctgttacctgagactgagtaatttattttaaaaactcagaaatttattttttacggttccagaggctaagaagtccaaagttaatgggctgtcatttggcaagaaccttcttgctctatcatctcatggtggagggcaggaaagcaagagagcacacatgccacagagagcaacagagggccaaactcacttttataacaagcccagtcttatgatacaaacctactctcacaataatgacatcaatccattcatgagggctctgccctcatgacctaaccacctctaagttctacctctcaacactcttgcattgggggttaagtttccaactcatgaacttcagaggacacattcaaatcatagcattctgcctctggtattcaaaattcacattcttctcacatgtaaaatatatttatttcataccaattgctctaaaaatcttaactcattccaacatcagcttaaaagtccaaagtccatagtctcatctaaatcagatatgtgtgagactcaaggcatgattcaccctgaggcaaattcccctccagctgtgagcctgtgaaattaaacaatttatctatttttgatacaatggtgagacaggcataggatagccattcttattccaaaatggagaaataggcaagaaaaaaagagtaactagtcccaagtgagttcaaaacccaacaggaaaaacaacataaagtcgtaaatctggagaataatctccacacccttaatattgtctcccaaacatgcttttttcattctttacatggccaggctgaaaattttcaaaacttttactttcttcttcccttttagttacaaatttgtctttaaatcatttccttcttattttactgtaagtggctgaaagaagccatgcagcaccttcaactttgctacttaggcatttgctacttagcctagttcatcactcttaagttctgccttccataaagtcctaggacatagacacaattccaccaagtttgtaactgtatcacaaggatggcctttactccagtttccaatacactgttcctcagatccatctgagacttcatcaggatggccattactgtccatgtttctaccaacatactgatcatgacgtcttaagtaacctctaggaaatcccagtttctctgcagttcttttcttcctctgagttctcaccagaatcacccttaatgccccattcatgacaatctatgcttcttaaaatcttgctcctccaaattcttccagcctctacctattactaaattccaaagcttcttccgtgttttcaggtatttgttactgtaataaaccctcttctcgataccaattttttgtcttagtttattttgtgctgtttataacagaataccagagactgggtaatttataaagaaaagaaagccagcgtctggcaagaaccttcttgctgcatgatcctgtggcagaaggcagaagggcaagagaacatgtgcacaagagagaacaaaagagggccgaactcacttttataacaaaccactcttgcaataatgacattaatctattcatgagccctcatgacctaattgcctgttaaaggtcccacttcccaacactgttgcatggggattaggtttccagcacataaactttggagaacacattcaaatcgtagcacatggggtacagaattatattgcagatacagacagcagctcatgccaatgctgtgtggtaagagaaagcacagggctattgaaagaatgaacaagggtaagggcactggcacccagagggcaaggaagagtacaggtgggatgaatccagagtgggaggtggagactaccaccaggctatgcaggaccttataaccactttaaaaatttgagaagtctgggtgcagtggctcatgcctgtaatcccagcactttgggaggccaaggcgggcagatcacgaagtcaggagattgagaccatcctggctaacatggtgaaaccccatctctactaaaaatacaaaaaattagctgggcatggtggcaggcgtctgtagtcccagctattcaggagactaaggcaggagaatggcatgaacctgggaggcagagcttgcagtgagccgagattgcaccactgcactccagcctgggtgacagagcaagactccatctaaaaaaaaaaaaaaaaaaaaaaaaaattgagagataggagggtcacttgaggccaggagttcaagaccagcctgggcaacatagcaagaacccatctctacaaaaaaatagaaaaaaattatttgggtatggtgatgcaaacctgtagtctcagctactcaggaggctgagggtgggaagatcacttgtgtccatgagttcgaggctgcagtaagctggtattgtgccactgcactccagcctgggcaacagagtgagaccctgtcttttaaaaaaatgagggttttattcaaagaacaatggaaaatcattgatgggttttaagcagtaaacatgaagggaacacatttgtggtttgcaaagattgctttagtgcctttggagaggagtggtagtaagatcatccagggtgctattgttcccaggtgaaagatgcaataattcaggtggaccccttaaagaaagagatatggatgagttctagagatgtggaagaggcagaatcaatagaacttggtattgattgaatatggtgtgggggcagggttattagcatggcccctagatttctagcctgctgagtaggatgaatggtcacaccattcactgagatagaaagctgagataaaacaagatttaggaggaaagttgacttttactttggacaggttgaattcaaagtatagtatggtgtcataaagtaagctgttgttacatagcctaaaaatgagtggatttttaaaaggtcaagatgggcagaagtagagcattccagttatctaacattgcatgataaagtcccaacagttatggcttaaaacaacatttactgtgctcattaatctgaattttggcaaggcttggtggatagcttatctccgcaccacttggtgtcagctgggggagcctgaggctggggttggaatcataagacagcttgctcactcaaatgtatggcagttgatgctggctgttggccgaacttgagcaggggttgtggctggagcacctactcgtgtcctttacatgtggctgcttagcttcttcagagcttggtctgctgggtttcaaggtgagtgtcacaagaataaagtgagagccagacagagactatcacctttcatgacctcgcctcagaagtcatctagcatcacttccatggcattctgttcattagacatggcccagccatattcagggtaaggggaattagagttcactcttcaatggggggagtgttgaagaatttgacaacatgttttaaaaccaccacatggcggggcagagaagaaatcagttatcattccagctggaaggaacaggttgaaacgggaaggtagaaattatattcaatagaagtggagtggttgctgttggctggcctggagcatgtatgaagggttatgaacagtgtgaaatataggttaaaggaacgtttgggaccaaattatggtggagcccaaatttcctgaaacccattattttgaatctggaaacaaattgtcagagaggaatacaaatcagatttattaaataaagataaaaagtagaagcaaacagtgactggcatgggataggaataattctacttgctgataaaataattcatgccaattttggggtgtctagtctacagatttggggtcatatatctccaaatttaaattgtagacatattcaaatgtctttagttgggctttgtaccttatgccagtcaaaaacatgagtcaaaaaaatcatgcctgtatggttcccttcggaggtatctctcctttatcctttagcagattaagataagaatcttggtctttttgatcctggctgtggcttcaaatttttcccatcttactattgggctacccaaaaggactgcatcagacaagactggtgagttgaatagtgttcctcccaaattcacgtctacctggaacctcagaatgttactttatatggaaataggaactttgtagatgtaattagttaaggttcttgagatgaaatcatcctggatttagggtgggccctgaatccaattattgttgtcattaagaaattgagaaggcacagagacaaagcaaagaagcccatggggagatgcagaagctgaccttggagttatgcatctagaaccaaggaatgccaggagcaccagaagctggaagaggcaagaaaggattcttccctagagccttcagagggagcgtgaccctgtcaacaccttgattccagacttcgggcctctaaaactcagagagaataaatttctgttttaagccacgtagtttgtggcaacttcttatggcagtcctaggaaattatacacgaagttagagccaggcatgatgtattagtccattctcacactgctataaaaaattacctgagactgggtaatttgtaaagaaaagaggatccccaggctctatggaaagcatgcctggggagacttcaggaaacttacaatcatggcagaaggttaaggggaagcaggcacgtcttacatagcccaagcagaaggaagagaaattgctgcgaggtgctacatacttctaaacaaccagatctcgtaagaactcactcactgccaagagaacagcaagggggaaatccacccctaccacccagtcacctcccaccaggccctcctccacattgatccaatcacctcctaccaggcccctctttcaaccttggggattacaatttgacatgagatttgggtagggacgcaaatccaatccatgtcacgtggaaaatatgggtgttggtttgccagatgccaaacagaaacaacatttgatctgttgataattgtgtatcctctttatcaggtctatcttaaggaaatcagagagtagagcatattttcttcatggaatggtgagacacatattagcctgagacaggagctaaggagagtgagtggtgggctccaccaaagtgccttcatacaactacactggtaggtgatcagaacaaagggacacgtagaacgaagacccgggtgtgtaacccaaatgcctaacaaagtccattcaatgtatgaggtgttgctgctgtgtgctgaaggaggaaacctgggtcttagtctctgttatggtaaatagagaagaaatcaagccttcctacgacaataggggatttttaatgaagtaaaggagacagaagaaatgtcccaaaggagaatgaagtatgtcaaaaacagattgcgcatgtaattactttctcaggccttcctgacattatcagcaggacttgtgttttgatgaaaaaacttaattaaaacttaatttttttaagtggaaaatattcagcatggttacaggaagactgaaatcagggcactgtgtaattttaattgccttcgagagatgcacttcacgtgaagactagcatgggggaaaaaagctagaggcacaaagtctgaggggagtggccacgctgaatctctagctgtgtgcttgggcgccattttccccactcttacagttgacgggatggcatctcaggtttcacgtgtaggggaggagagtgggtctgttctggagtgtgccggtcaggccatacttggcatacacattgtagaaagtgtcttgatttttattctcctaaaaagggtaaaaagagattgaggagattacatatcccatgaggcagcagtttttaaatgccactctctggatcagttctatcagaaccatctggttctgattcatttaatctgttttaggacctgtgcacagtgtttctattttaaaaataaacctgtcctactcattcttggagtcaggtgtgggaactacaggtttttaatggaagaaacatgaacttgaaaatgagtaaatatgggctacgtcctttacttcccaaggagatttgggttgactgcttagtttcctccatcaaatggggataatatgcttatttgatggggttttgtgaaaataaaagataacacaggtaaagtgactgacacatacagttaagtggtctaaaaatgataaaactgtagaagaagagttggatcaggctgcttgctaaattgggaagggataaggtagtgttcttcagatatttcaagggcagctgcatgagagagagagagagagagagagagtgtgtgtgtgtgtgtgtgtgtgtgtgcgcatgcagcctttagaggtcagactcaagtccagcaggtagaagttatagggagataaatttcaacgcaacagaaagtggaactgtctagtgaatggtccagggatgtcatcagtttgctccagagggtagtacgttccaaatcactggagcaattaaagcagctgccatattttgaggatgtacagggctgtggggcagcaattgaatgagaccacttggttcagctctgtaatagggtttctggcttcctgtggggctgtggctgacatacagttgttttgtaaactaacaacacttgaagaaggttttagcagaaaacgtttaccagtaagatatgtcaggtcaagtacactgttttaggtattctttactggggacattcttgtgaccttcatcccaggcctttcagaaaagggatggggcatatttagaagttattaatgactgagaagctcctctggcacttcaggggagggaactagagctataaaatgtcctgtgattgttctaggactttctccttagtttagctaacatctgggtccttgtcacacggctatgaaatattaggcttacagacactttgaagggtgagaaaaatggaatttattgggtaaaaaggaaaaaaagggaaacagggatgctctgcagagccagattcctgctagtgtgcttcctgcctcacagactgaatcccaggtaccacccaggaagaggaggggccaggctcctccccactgcaaatggcatgaacttcccaagacccctcccccagtgtgcaggccacttggaggttctctggtgacccctttatatttggctgtctcattatgaatgggacaggagtgcgaaattatcccacttcaaatgtcacttgctctctgttgggaaaccctatacctcactgaagcccagatgatctccctgaaccagcctttgagggtcctttttggagccctttggaaacctggtattggatgggttgggttacagggctgctcagcctgacagcctcgcattatctggtgaccacagagtttaaagcagaacattgggaagaaggtagactgggccagttgcacaaagcagagtgtgaagagtgatgggagatgaaggctgtttgcctgcttttcactggggaccagatttggatggatgctggtccaatatgagtgacacagttaacttatcagtgagatccctcattcttctcatcagtgagatagctgggtattgggggaacctgcccccagtatttcaatgtaggttctttctattttccataatatcagctggctgagaaataaagagaaagagtacaaagagaggaattttacacctgggccgccgggggtgacatcacatatcggtaggaccttgatgcctgcccaagccttgaaaccagcaagtttttattaaggatttcaaaaggggagggggtgtacgaccagggagtaggtacaaagatcacatgcttcaaagggcaaaaggtagaacaaagatcatatgcttctggggaaacagaacaaagggcaaaaggcagaactcctgataagggtctatgttcagtggtgcacgtattatcttgataaacatcttaaacaacagaaaacagagttcgagagcagagaactggtctgaccaaaaatttaccagggtggagtttcccaatcctagtaagcctgaagttactgcaggagaccagggcgtatctcagtccttatctcaaccgcataggacagacattcccagagcggccgtttatagacctcgccccaggaatgcattcgtttcctagcgtattaatattaatattccttgctaggaaaataatttagtgatatctctcctacttgcacaaccgtttataggctctcggcaagaagaaaaatatgtctctttttgcctgaccccgcaggcagtcagaccttatggttgtcttcccttgttccctaaaagtcgctgttattctgttctttttcaaggtacactgatttcatattgttcaaacacacgttttacaatcaatttgtgcagttaacacaattatcacagtgatcctgaggtgatgtacctcctcagcttatgaagataacggtattaagagattaaagtaaagacaggtatgaattataaaagtattaatttgggaactgatacatgtccatattaaaatgaaatcttcacaatttatgttcctctgctgtggctccagccagtccctctgtttggggggggtccctgacttccaacagctggggaccacttaatcagggtaagggcagtagtttgtgttcacagtttgatctccctgcatggtgctaaccaggctgcatggggatctaatgtctgactttggccacggcatcaggctccagccaactgacgtgaaagcaagtttccaaatcgtctctttctaaatagataaatgatactcagtgttcctttagccttccttattttttgcaaatgcctgtccccagtggttctgttgtttgctctgattgccgttttccccagtaagtgggaaaaccccacatcttttccccatcagtattccctaatgaggcttgttccctcaaggggaccttgatgagttacaacagcatgaccatgttcccaagcagcatgctaagaaaaacaatccccagtgatgccctgcaggcaccatttaggagcgggcggtaatgaatccctgagagaattcagtcctccgtatgaaggtgatccagagtgaagtaaacaatttcaccgttaggtggttcaccctgcatgcctcattgctggctttctggaaagccagtaaataaggcagaaaaaatgtatcattccctccagagtgcagggtcccctgtcacccacacaggactcctgcctgtcactttgagtcacagctgggctttctggaacccggattcttgtctctggttagctcaggtcttgcagccatgccaaatccaaactgtgacattgtctgaacagtagggcatcctgttccctggtttggctgagctctgcggagcagaacagtggccgaggttaacatcagataatttcctccaccattcctgagtaccctgagggcttgttacctggaatcaaagacttgtcagaactcaagatgaccttaaaggccagcttattcaacctcccacccaggatatgacttccagaactaaccacccacaatgcagattagtaatatcatacgtggttactcaatgcaattgtgtcatttcaggagaaatgacctgttaccaaagtgtcatgaaacccacattaatgagctgggctgtagtggaggtttactttgatttctgaccttaattattagtggtttggattctttacgtttatgatggattttctgattaccaattatgattcactgtaagccatttttaaaaatatgacatgaagctctgacccacttttaacaacacagtggcaaatgccaaacaattggcaatttccccttctaatatcagctgtttgaatcatcacatctactgtggtggctggggaccactttatcttcattctctggcttcagtattcttttctggtattgtcattactgacctaggtgcatatctgtactaggctgggacctcagctctatgccagtgagaaaatgaggttcaactgggaaaacggcctggagcagttgctctcaggcttgtctgcagattagaatcacctgtagacttttaaaaaatactgacacttgggttccgctcttggaaattctaatggatctggggtgcagcctgggcatctggaattttacagtctacctgagtaattccaatgagcaggtgggtggccttgcaaaccggggtctgaaggggctggtcagcaaggagtatgggcaaaatagtgctggctggctgggcgcagtggcttacgcctgtgatcccagcatttgggaggctgaggcaggaggatcatgaggtcaagagttcgagaacagcctggccaacatggtgaaaccttgtctctactaaagatacaaaaaattagctgggcgtggtggcacgggcctgtaatcccagctacttgggaagctgaggcaggagaatcacttgaacccaggaggcagaggttgcagtgagccaagatcccacttggctgccactgcactccagcctgggtgacagggtgagactccatctcaaaaaaaaaaaaaaaaaaaaaaaaatagtggtggccaaggggtgtttataaaacagagttgtgatacatgttcatacattcacctttgaggtctgatttggtggtagcaggagtttcaggggaaatgtttactgatcaggttgatgagtgtccagggacaagatgtgtctgctaagagttagattgatggcaaagattgggcagattgatagttctctagcaaataagatgagatctgctatttcagcaggaaacaagtaaggaagttgaacaaaaagctagtggtatgggccatgtccacaagctgtggttaaaggcaaaggctgaagcctgattggcgtgcccacactgggctgggcactgtcagggacagccaggctgactccagagcctgccttctggttggcttctcccggcttaagtctggccctgcaggaaaaccgacaggagttttcatgccaaccaagactgagacaatcagagactggcaggtttggaaccaggaggtctggatggggaggttggctctgaatctgttgtcattatcaggtgagtcattaggaccacctggaaaagtgaagctgttcttcaccttctcttcttgtgaaagtgattcaatctcccaaacccaggttgatcataccctttaggtctaatataggaagtgttgaattaggtgatgtctctaaagaactctctctgggttccttagagaaaaatagcatttgaacattgtgcctcagcaggaaagaagatgcaatttaagtcctgcaccaaggcattcagggctcacctcaaagtggactcctaggaacaagaagcaaatgattccgtggagagggttagatgtctggccaatggaaacggggatgtagttcaggttttctagccccagaagttcagaacctttgggttcctcggtggacatgtctgttactcgcttgaaactagggaaagtctcttgtgtagaaaacctgttgcatgtcccttgactaccagtagcagcagaggtgctatgtgtggctgaagaattttcctcctttttctgagagatgatttcccaggtttccttctccacaattctgtgggcgtgtactgctgtgataagatgtttgttctctggcttataaattacaagatattttcaggaccacttggaagaaattggaacattttcctggaggcagtgggggagctgctggaggttttcggacaggcgggccacatgctgagagaggtattttgggaaaatgcacttggcagtcatgtgtgggtgaggataataatattaatacttaaccactggcttgttgggaagagtaaggggaacaatgtaagtgagtgtaaagatgcaggaccaccattcctttgttcattctttttttttctttttctttttttatactttacattctgggatacatgtgcagaacgtgcaggtttgttacataggtatacatgtgccatggtggtttgctgcacccatcaacctgccatctacattaggtatttctcctaatgctatccctcccttagccccgcactttgtccattcttttagtttctctgagacctggtgccccaaggataccatcttctcctgaccagtgtatcagtttgcgagagttgccataaaaaaatagcacagactgggtggcttcaacaacagaaatatattttctcatagttctgtaggtgggaagcctgagaatgaaaggcatcggtagggctggtccctcctcagggccgcgagggcagggtctattccaggccttcctccttggcttgtagatggtcaccctcttccctgtctcttcatgtcatcatctctctttgtgtccgaatttcttcttctcgtgaggacaccagtcatattggattagggcccaccctaatgactgcattttaacttaattacctctgaaaagatcctgtctccaaagatggtcatatgtgagatactggggttaggacttccacatataattttttgaggggatacaattcagtccataacagccagtctttttgaagactttctcttttgggggctttacacttaggtaattacaggatattttaaggggtatttcaagacccagcaacccccttctccacccaccatctcccccaaattatgttcgtcacctcctggtacctgttatatcatcactagaattgcttggttgaatcaagtaatgtttcaagataatttccgtaaacatgcactctttttatgtaagaggggtaataatagagccagtgaaatactggatgaattcatttaccaaactacgtaaaagtactgatatatgacaactacttagggaacctaagatttgggacatagagcagcctatttagaatatccggtataacattgcagggaatagcaagggctctagagctttccgcctgggttgaaatctcagctccacccttttctttctgtgtggcattcagcaagttacttaacccacctgtgattcttccttcatctgaacaagcagcataacaatagcatttacctcatgattctttagaaggtgaatgagctaatacctaatatagtgcttagagtagtgtcttgtctgtggttggctttcaataaatgttagctgctattgttgttgttaaactatttaacaaactacgaagcacattcctatctgctttcttctttgcccttgtaacagccctgtggagtagaaggagttagttacattttacagatgaagagactgaggctctaagacattatgcgaaccatctcagggcatatggcagtgttattcagaacatctatcggtaaagaacaagaattccaaaaatataggattttccccaggaaggagggccagagtgtgggctactgtgggatggcctccgggcagagtgtgagggtaggcgctccaaagagtaaggcatctggagaagagaaacaatgaaagaggcaaacgctggatgagaaggacctcaaagcagaactttgcctctcggcctctcagtcaattgtgatctgactgacatccagattgtgatcttgttcaggtggctgaactttgaacccttcttggccatttgatgctaaaggcagtctttgaatgtgatgttttcctagatcgtactggtggaatttagttgcctcagatttcccagtcatgtgccagcactgccaagtgatctccatgtgtgggttttatgatgtgtttccagtgctccacatatggcctgtgatttttttttcctatggctcctaatgaaacactcagaacactgcactgaatagaagtttctccctattctccagagtggggatccttattgcatcgtcaagcatggacaccaaaaataaatggggagaaatctctattctcttagtgatgaggcactcttggaggaagatattattaacatgactacgtcttgccaatttgaaactttgcaaatatctgtaaggttgaccagtttttataatttcaagattttaagttcaacttaaggtactttacaaaattatttttatcataataaattacagttctttacacctgtgtcttttaccgattagattgtgagctactttatgggtgagcaccagtatctacttaactttgtactaaatggctcaatattgcctggaaaatagtaggtgcccaataaatagtaaatgttgttcgatcaaatcataaatgtagatataagctaaacctcttccctgggcaactggaaatgcccatgttatgtcttaaaacacattgaattcaggtgggagaataaaaatgattttaacaaatccagtgtgctttttgaaggcagaactacaattacttcttttttccctcataatcaaatcaacctgtgaaattggaagccaataaatatgtaaaaaagtcatcaaatgtcataggagaggactactatttgattcacacgtgatctttgtcgtttaattgcgtgtggcaagaatgaatggaagtgatattaagtggagaaaaactcagtcccattggtgagttatttaccttgaccactgtgatgggctgaattgtgttcccctaaaattcctatgttgaagtcctaacccccagtatctcagaatgtgactgtatttggagatacagtctttcaaaaggtgattaagttaaagtgaaaatgaggcctttgggatgggtcctaatccaatatggttgttgtctttacaagaagaaaacatttggccacatggagagatacaagggatgcacatgcatggaggaaagaacatgtgaagacatttacaagccataaaaagagccctttcagagactaaccgtgctgacaccttgactttgaacttccagccctccaggactgtgagaaaataaatttctgttgcttaagtcacacagtctgtggtattttattatgatagccctaccaaactaatacaaccacctactttttagaatttgtagaatccaagcacttaagattacaaaaatgcatgtttattgtggcactattcacaatagtgaagacttggaaccaatccaaatgcacatcaatgatagactggataaagaaaatgtggcacatatacaccatggaatgctatgcagccataaaagaggatgagttcgtgtcctttgcagagacttggatgaagctggaaaccatcattctcagcaaactaacacgagaacagaaaaccaaacaccgcatgttctcactcataagttgaacaatgagaacacatgagcacaaggaggggaacatcacataccagggcctgttgggggctggggagctacaggagggatagcattagaagaaatacctaatgtagatgacgggttgatgggtgcaccaaaccaccatggcacgtgtatacctatgtaagaaacctgcatgttctgcacatgtatcccagaactttaaagtataataataaaaaaaagcaataaagaggaggtgatggtaataggcacagacttttgcttgcgttgaggaaatattctaagtttcacaatggggtgtggaagaatctgtgcgaatctccttctgacctctcgtggtaccatttcctcattactcagtgatgaccccagagccagtcttggatgaggcggggtggaattttccacacaggtgccatgagctagggggctcaaaacagacactgtggtgaggttattactgaaatattctgtttctatgaagtttctaacgtaattctgggccctctttctacaaccttagcaagttgctgaactacaggagtgcggagtaacaatgcctttcatgtcaattctgtttacagccaggcttgcttgcattaaactggacacatccatcaactagagtgctggataacagatgagaaaaagctaagtttgagttgtcttttatattgtataatggtgcttctattttctttgttttcttcttgttcttaagttctgtgggaaacccacgggaagaggagtctatccagggtatttgacttcaaatcatttcatctcttctgttcttcctctcatctagtcctctgtgttcttgtaatatacgcaagggcaagattaatagtagaacagaattctgctatgaaatttaagtgatgtgaattctttctcaaaattccaagaatgaaaactttgactatgatatagccaataatttgcacttgtttgcatttgacattgctcatttacattaactagcgtaaaatacctaattagtacagcagaaaaaaaaaaactatatgaggaaaaaaagaaatgattgctcttttactcactggagggaaaggttggatttatttcagctctgtgtttagaaaaatacctttgctgggcttcttggagtgtgaaaagagtggaccctgacccacctctattccctgctgggccatctggaaggattttcacaacaaagataaggctaaaccactctgcaaaatgaaaccagaggaatttcatgagttctggggagtagaaagaagtagggtgagctctgacaaggatgatggggttgggcatgtgatgtctggagttggggctaaggaggccagtccaggagatggtccctgaggtaggatgggagtggggccaggcaactgtaagacagcgatgtctcatgttattgagctttgctatttcgtaacctctatctgccacactttctaaaacctttgcataactactgggtatctaccgagaggaaaagaagtcattatacgaaaaagatacttgtatatgcatatttatggcagcacaattcgcaattgcaaaaatatgtaaccagtccaaatgcccatcaatcaatgagtggataaagacactgtgagatacacatatatatatacacacacacacatatatatacatatacatatgtgtgtatatatatatgatggaacaccacacagccataaaaaggaatgaataatggcatttgcagcaacctggatggaactggagaccattattctaagtgaagtaactcaggaatggaaacccaaacatcatatgttctcactcataagtgggagctaagctatgaggatgcaaaggcataagaataatacaatgaacttcggggacttgggagaaagaatgggaggtgggtgaggaataaaagactacaaattgggttcagtgtatactgctcaggtgatggatgcaccacggtctcacaaatcaccactaaaatacttactcatgtaaccaaataccacctgtttcccaaaaaccaatggaaataaaaaattaaaaaataataaaaataaaataaaatctttataagactactgtacctgttagagcctcctttctgggaaattaaaactctaattgtttccacattagcttatgaggtggttggtaaaagagaatgactacaggaaatgaaatgccaatgaggttgataattcagtgggaccaacaagtcacagtcaaccagtgatggagatggtaaacctactaggaatccacagaaattttgaggcaggtaccggactctcaagagtgtgtgagattggtgaggctttggcctgagccattgaaaataaatgcataaatagcaacacttagcagaccggaaaacatgggggaaaacccagacaagagacacttgggatttgtcagtaaaaaatggagttgtgaggctgggtgcagtggctcacgcctgtaatcccagtactttgggaggctgaggtgggcggatcacgaggtcaggcgttcgagaccagcctggccaacgtggtgaaaccccatctccactaaaaatacaaaaattagccaggtgtggtggcactcacctgtaatcgcaactactcaggaggctgaggtaggagaatcacttgaatctgggaggcaatggttgcagtgagccaagattgcaccactgcactccagcctgggcaacagagtgagactccatctcaaaaaaaaaaaaaaaaatgcagttgtggaagctttgaaatccctgctgtgaggttatggaaggagaatgtttctgttcaagtatgaatcttttttgggaggggtggcaagaggaaggtatgcaaagggaatggtgaataaaatgaaaaggttcgactttttggtggttagtcacctaagaaggttttgtgggggaaataatgtgttttagccagcaaggggattgtttaacctgccctctaccagtctgccgtgcctcacccacttgtctacagctgtcctgttagttgtagcattttgttttcttttatgcaaagggattttcttatgacactcaaggagaacccaggagagggaaggcatctctgccttccagggacaaagtttcagaactgtactgctctacagtggtaaaaagacaacaaagtctttgatttgcaggttgcttgtttcacttaccctgtgaagtggagctcagttggaatatttcatctggccactctttagatgttcacggcagccctgcctggccagccatgaggtcgggcggagaaaggaagcaaggatgagtgaggagggagagaaatggccctggagtttgttgttggagatcttctctgtgtcaaacatcttaagggaatcacctcatggaatcttcgccacaacccattgatatggggattattttccattttataatgaggaaatgaaaccttagaataacagcaagaagctcagacaactatgaagtggcagggtgcagttatgtgactcaaaaccagtgttattttcagaagtgggaaatgtcatgactttgccctcccctccccttctctctcttccttcctttttgttggctatcttgagctgaatggtgataacgcttaactagtggaggtacattttgaataaacagcgactgacttaaatttataatcataattttattctagagttttaacaaatggtaaaacatttagagttatttttccgcagacttgacaaaggtgatgcctgactgtgcctgccgtcatttttttctatttataaaatcagggtaaatttgcaaacttctaaagaagcagacatggcttcagcaaccagtcagggtggaggtgagaccaggaaggttggagctcatgaaaggtcctcctcttctgtctaaggggcacttacttcattggtagctcagctgatactttgggaattccaagaaagagccaggaaccctgctaggaatagagaagcaaagaatccagggctctcactttgaattgctcaccacgtctagaacatgagtcaggcacagacacagaaaagtcagcataatgcgtatgtgcagtgattatgagatgcccatgcagcgtctttacaccagccagggatgcaaggaagaatctccggagaacatctacccaacaggtggatttgcttgtggggaacagaatctgtcaaggagaaacaaagcagtgcagtagttgcatcatcatgaggaaggatgatgtgcagagttagtttcctaagtggcatcgcctataatgagcagcgtgttctcctaccaccttagctgcaagcagttatgctgtatagccaacatctttctcctagctcacaattcaaaagcacattgctgggattccttgggggctttgcgtttatttgttgtggtctagtggtttattctggcaaaatacactgcatggatttttacagtttgctttgtgcttggacatctttccacccaagcaaaatgtttacaaatgccagcacgtcgttttctgaaaatattgctgaaaagaacaaatgtgttgtgatgtgccatgtgtttgaagagaccaggcaaccaaacactaagattgcctcttcctgtcagtgtttttgctcggaatcattctttattgtgcctgtttctccagaactctgtaatccaaaatggtcctgttctctgtggacatgtgtttattctgcaagttaaaaccctttcaagcaattcttgctgtgttaaatataacaatgcactgataaaattctgtcatacattctagaaaatacctttgtataaagtactcatattactgaatttaccaaaacagcataggtaacagattctaagatatcttagagttaattgataatatgtatctgaatgttgtaaaatttatctttcctatgcaaatcccttcaaaccatcccttctagtcccatttttgagacacacacacacacacacacacacacacacacacacacacacacagactgactttgttattccttactggtttttactgatggtcatagacgtctttcttctctgctacttccattatcttcctgccttcaaaatctccactttagttgcagttttgttttactatatttcttatttttaaaaatatataggtaaatagaaattgaaaagctcccattttttgttagattcatgaattcctttatgtaattatttttccaaaattaatcctgaatacagactagtaaatttatatgacaaagaaaatttctatgacaaagcaaaattaatgctgaatacagactagaacatttatatgacaaagaaaatagggaactgtgttgtttcacatactcaggagcttctgaattcaggaattttctagatggagaagatctcattatatggtgacaccagctagccaggtgtactactgaggtctgtctgtgttagactttagaaatagaccaaggatggagggaggtttgagaaatctaagtaaggaagcataggagaccttcttgtttgaggtcaaagaataattggaaggagtggttccatctcacaatttgaaaatgttctaaggaacaaaacgtacttttttatagacctattgatctcagaagatataacacagctggtggagggtaatgatcaatcgccagactaccaccattctattttcttctctgtcaaacgtactcactatattgtgagtgttttcactgcctaatttttcatggcaatttttgaggactggtagctgaactaatttaattctcattctctcacttgttcaccaaatcatttcatgtgtgtttttgccaggtattgttttaaatattgggcactattttcggttcagtaattcaacctattttaatcccttactagcccagttgtaaatttcaaataagtcattttttttcataccagttccctgctttcgagtctctgatgaggctacgctcaagtattacccaggattaggtcctatctgaaagctcaactggggaaggatccacatttgagcttgtttatgcagttgttggtagaattcagttcccttaggacggttggactggggggcctcagctcctagctgactgtgggccagagatcacccttggttccttgacagatgggcctgcccattagggcaaattgaagcatctaagtcagtgagggagagactctactggcaagacagaagtcacaattatatataatggaatcactgaagtgacatctcattatctttgtcatattccattggttagaagcaagttacagcacccacccacatacattcaggagggtgtgtattacacaagcacgtaaacaccaagagatgggatctttggagaccatcatagactctttcctccataccatctgaacatttaatattaatgtagtctgtatttctacataacagttctctgaaaggaaactttgctgtgtgccagataatactttttgatcttcttattttacctttccttaccccacccatgattattactatcaaagctttagggcataacatagtgctaaaatagaacacttactccaaaaatttaattaacaagcaacatgaaataaaaggccatttgcatattgtaggcaaataaaaacattatcaccaggagaagtgagtcagaatatatcaaatataatagctaatattaaatagctgggggtgagagttggaataatgagcagcctctgtacagagggcatgtcaatcaattactctggccctattggagcacctgcctagaagtccttgctgtgcctggttaacccatcagttgctgaatagtggggaggtctctggtggggattctgggaagaggggctgagcagtaattgcggagaaccctaggggatcccagcagtcactatttactaagacatttttattacctaatactctatggctaaatagttaaaagaattaaaaattctcaaatgctttcaaggttggagccagttcatggggtcaggagagctatctccaggcctgcattctactccccttctttttccatccctgccccatccctttcaggcagcacctggtgcacactcaggtgacccagcctacatgtcgaggatccacgtaaacacccctcaaacagatggtcccccgcaggcctcggaatgtggcaaggtctaccattaggaatgtaggctcaggaaaggctccttcaggccctgagagtggacgtggaatcctgatggcggggaatcccagggtcctgtgacccagagcatggtctagaactgtgctgggcagcacagcagccgcacattggctccagagcactggtcgagatgttccttaaatgtaaagtacacaaccaatttcgaagacttaatacaaaaaataaagggcgtaagatatctcatcaataatttttatgttgattatgtgctgacacggtagtgttttggatatactattgggttaaataaaatatataattaaattagttctaactgtttttttctaatatagctactaacaagtttaaagttctatgtgtagcttccatttgtggctcccataacatttctgtggaacagcactgctctagaagggagaagtacggctctgctaggacacatctcctgctaccttggaccccttgccctgtgaggaggaggagctagagcagagccctctaaagcgtggagtcccaggcaggagcctttcttgccccagggtggttttgctttaaggtgatatttatagtctatttggtctcactctgtcatggctaaatgactccaaatctctctcctttgcctacttctgggttttgcccaaggcaagaaaatagtcttcctcaccttccacctgcccacccccactgccactgccaccaccaccgcttttgaatcaatataaccaggcacagaaagtaaaattgttctgtattgacatgtatctttcaagaagctgttattctttgggtgaaacagaatctaatcactaagcaatttttctacagagagagggagacttttcactccccttccccttggtttgtagagtacattcatctttgataattgattcttcgggtggagtaatgatgtaggctcaggaatacgttttttgattcaaagggtataaaaagtgctatgtgtgttaggggttaatgtaagctctgtggaattacaatacggatgtcttctaaagaaaattcactaatctaatctctagagaaggaaacttttagagagtcccttatgactcccttaagaaattattgtggatagtatgttgctgtatgatggctttaagaatttatggtgaatgcttcagaccatggctttagtgtttcaacagaaacagtggcttacttagggtggtggtgcatcttgctcttgaataaatctgatctgagcttacaagtaggaaggagtaatgatttagatgtctgaaatctctttagtttattgtttcttttcttatcgtggcagagagtgactgttaaaactttttcctcctgggcacgtagctggcctacatttcccagcatcccttacagatggctgtggccatgtgactgagactggccaatgggatgctagtggaggtgatatattcttgtccaatcatctactctttctccttttcttctgcctatgagatgcagagtataggggcacatgggcaccacctgagaactctttaggaatgcagaatctttaaccttctcctaggtgtagggaatcagaatctgcattttaccaagattcccaggtaatacctatgctcattaacatttgagaaatattgccctttgagatgacagagccagtagatggaaagatcttgggtccctgccttgtggcttagaggagagccacccaggagtgtggcttcttgaagcagcctgtttagattggtacataaacaggaagtccaattttatcatgatgaggtcactgagattttggagttgtttgttatagcagttagtcttccctggataatatactcacaaagtatttaaacaatgccatgtacctacaatgtatccccttcttaccaataaattctgccaaccaaaatgatcatattgtacctacaatgtccaaaatgtttaatacagactgaggtagaccttataaatggtattggtgaagcctagtggacaattttaagaaatcaccaacattacaaaacgttgactggcaaacttgcgttcaccctatatatgctctgtaaatgttcctagctccctcacttttttgtctttttcttcttcaacggcctccttcacttttcagtagcagcaagattaagaggtgaaaactgccattactccagtgaatgggtgaggtcactgatttgcacaattcctatgagagcccaattaaaagaagatacagagataagcatgtacgttttcatctctcttaactccattatcttattgtcatttggctatgatttatttaggtcaacattgatttctgtagcttatttagatagctagaatgataaaaatatctttttgttatcacaaggagtacaattatttacatatttacctattcatccattcattcttagtatacagaacagtccaatcaggaacaatctgtagtacctatgacaggtacagaaaagcccttaaagattagcctctaaggtgttaatgggagagatttactgatttatatttttccctatggatctggagatacagggtattaacaagatggatgagttattgggggtgcatttgtatgtctcagggtgcatgctgtctctgataattgctgtctgtgtttgattgggcagagccagtatcttaaaaccttcactagaatttcctatattgagacatctaaagttaagaaatctaggtaatttttgcttatcggtttaaattgtgcatagaactaaattattaaataaccagcatgtctaagccttacccttttctttaattacacacatatccatgcatgcacacacatacatgcacacacatacatgcacacgtgctgaggaggaaaaaaaagctgaagggattttgtctgtgcatacatgcgtacatatgcacagacacacacaagaggcacatgtacacatgtatggacctgtgcatgaacacacaaatcccatcaacttctttttttcagccagtcattatagagaggaatgacagcttttatttgctgcaaaaattcaagtggaagaacgtcatatacaagaactaccagcctagtggtagagaaaagaggattctttgaagctctttttagtcagtctgtactagcaatagtccagtgtttcccaacttgagggtgccctcaaggcgttgaaaacataaggtaccactgtgatcgaggttttaccaaattttaactttccttcacttctcacctaaaatatcttgagggtgatctgtgctcagatttgttttaagggttggggggagtattcaccttctgaagtaaaagaaggaacaatttgtcctctgtctggcttctatcatgaaacttcataacccaagagcacatcttgacttcagctttgttatttttagtggtagaggagaggaaacagtaatctgcaaagtgtgagttcaattaccctgacctttcatattgaaatctgaattcttaataagtgttttatgtgcattttatcatttaacccttacaacaaccctatgagataggtagtgttattataccactttgctgaggaggcaactgagacacagaaattaagtaacttgcccagcatttcttgggattctaacctaggccatctggctccagaagctgaactcttaaccacactgctctcctgcagggtcgatgagcttgccatgcctcttggtcattccctaaggtgtggcattttgtgattcgggatctggctaactcatttaaatatggaagtttcacaaagattcaggctgctcagggatacaaaatggctcattggcagggtggggcttccaaggaaatcgatttcattcctttcctaatgggctgcgctagtttgcaaaaatcaagaactgtgacgatttaagatgcatctgaactcttttagatttccatagaacctcactcagcagtcctttcgagatgatgtcatagttcttttgtgtaatctagtaatgccttttaggggaggaagccggtgtattttacaaatgttatcttatccttacaacacccttgaagcttagtaagtgatattagttactgtttgggggattacaaaaattaggttgtggtttttaatgtttatttttatagcaatgagaagtggtacacacacacccatacttatatgcatatttgtaaacatgtgttatgtatattattatatacacgtatgcatcctccccccagcattgatgtgtgtaattcaggtggtatttggttgactccctcctaatattttgcaactgccactaattgtgatggttgttgcactttaaaatgttaaacttttagaatatgtgagaagtgagcaatttggcattggatctagcactgtgtcctcaagtccctttcatgtgctcagtggatttttattgagtgccaattgtgtgccaggcagtggcattacaacagtgaccgaaacaaagtcactccacttgaggacctgaatgtctagtcaaggagctagagagaaaacaaatatatcctctgtcaggtgggggtaaagcgcttctgatgacaaataatgttggctgagctatggtgacatttcagcagaggactgcacgagctctcccaggcttttcttgctctaaagcagtagttctgaaccaggggtgagtttgcagtaactggagatatttttctgccctacctggggcagggctgctgccaggatttcccattcagagtgatttgagaggatctcagtccacctgtaaagaggaaaataccctcttagatttgtagggccacagcctcttttgctgtgcctggaacatactggcagacacctttcctgctggggattttgcaaaatctggggacgtttttggtggttatgcttcggggaagggtgctgctagcatctagtgtgtgaggctggaagtgctgctaacatcctgcagtgtacagggcagctgcccacaacagaatgatctggctcagaatgtcagtagtgccaaagtggataaacctctagaaccacactccccaggggttcagtagactttcccgagtgggcatggaaaggtaaactcaactccctttctgcacgacccctttttctggcccatgagagcctatgctgtggccagtcgctgtgacagaatggttttctgcagggcatccatgctcacagcaggatcagatgccatcttcatgctttgacttgccaaggacattcaccaataaaatgcgcgttcagggagacagctgtcatgacacaacacgtttttcccatgacacacatttcttccgtccctctccaataacctcgactcttgaatgggtgagggacatttcctcaagagctgtttatctgggctttggggctgtcttgtgaattctatttaaaaatactcaaagtccctgagatctttggatctaaataacatactggaaccttcccgtcccctcctctccttggggctatggtaccaacagaagatgaaagctttatttcattttcaaaagtattttatatttctttattttgtaccctcttgataattgatcctcagctgccaggatttcccattcagagtgattcgagaggatgcccaggccacctgtaaagaggataatacactcttagatgtgtagggacacagcctcttatgctgtgcctggaacacactggcagacccctttcctgctccgagtatgcggtaagggggcaagaagctgtatggtggcttctccctggagaagcagcttcagccccttgtgctcctgcactcctgtgctttaagggcgagaacacattggattctttttttttgaggtggggtttcactcttgttgcccaggctcaagtgcaaggcacgatctcagctcactgcgacctctgcctcccaggttcaagcaattctcctgcctcagcctcctgagtagctgggattacaggcataggccaccatgcccagctaattttgtagagatggggtttctccatgttggtcaggctggtctcgaactcctgacctcaggtgatctgcccgccttggccacccaaagtgctgggattacagttatgagccactgcgcccggtgaccacatctgatgctgaaccaaaggcagctcttgggaggtggctctgagcctcccagccgcaaggtaggggagctcaaagatgttttaggagtaagcttgacaagagggtatcaggaaaaattgtttttctttgaatctccccggaatatatcatgtaattcacctcttgaggggtcctagaaagaccacttgccatcccaatatctagccagtcctggagtggacccagtcagagtgcatgaactgtgatacaaggcctatgtcttggtttttttcacctcctgcaagctaggagcctcccaactacccacagattggaagggacttggtgcagggatatggcttcgggtgacaacccacctatcagagctattcaaccattgaacagcatggctgtcagtctgaggtcgcagtgatgtcaggaggtggcagttttggcagctgacagccctcacagatgcccttgtgcagaatgaacctatcaagcattttctctactggctatgaaatggaaagtgaggcaagacattcagttgctgcacaggaaggaaagcagtcagggtggttgcctgagcgtccaggtcccagacaggtctgttctccatggaatacattaagggattgatttacctgtcttggagctgcttcacattgcagtagagggactgtgccgagtgtcatgcaatggccagttatcttgcagaacttgtttgtttctgcaattattaaaagttttcctggcagtttttttgttttgaccgagagtctttcctccaaaaatcattctctccatcctctcagaaccctggataattctctcctgtttgtcgtttgcataccatgtacctggaactcttatgttctggttaagtattctagcataagagagaggaagcaaaataagtcagcagaggatactttcagcatactgtgacttttagaatgttcagttagtgatactaacgtttcatagcctgtaccaataatcaacttttctttcccctgaagacaaagtagcatggttgtgacctatctatactgacttgttttcttcatgcatgcattcaacaaatcttaattgagtgcatgttatgttctaggcgtggggctgggctgaccctctgggaaatgacaagatgaaatgagacacattcctcctttcaagaaagtttgtgtggaatgtagaagatcattcattggttgaggagattgtaaactatcctggaacacagtggtttaggatgaaacaaagcagtgcacaaatgaacgctctagtcagtgaggctccattagaggttcctcaagggtggggactgcgttgagtgtcacgagactcctagggtcagcacagtgcccagcggctggtacgtgctttctaagtatcagctgaaatgctacagcagcacggcctagtggggagggagagagaaagggaggaagagaggggaagggattgaggaaactgacctagattatgggcagtgctggtcccccactctcagcccatgtggcttgggagaatgagcctgtctcttgatgctgtgaactatcaccaagagatcccctaccttgctccccaagttcaccaccaggcttctctccatctcagagcttattgaaaggacatggaatcctctggagggagttctccattgaaaacaaagacaataaattccaagtggcaaatctcataggtggccctgagtccctgtgatttttccagtccaccccttagttgaagtaaggcaaaatttgttttggggtttcataacagtgatgtaagtgcattgctttgaagcagtttttgagggagaggggaaaagcctgagttttggagaactacatttgtggaacccaagaaagtgatacatcttccctcctcccacccctcattgggggagatgacatggggcatacttccctatgtgctttagggggtctctacagaaagggggaaatgggattttgctccttgagtttgctgagggtaggacctgcagacttgctgtggtgccttcagagcaagagggaaagaacacagaaatagataccaccaaaagggatgaggatttcagatggcacacagagcctgctgagcgcatagccatgcaccgctgtgctgtgccttttcctctgacatccctttgcccacatataggagacaatccccttacaaagagccaagagcaagcctgaaggcttctgggagtccagtcggcttggaagtgagggaggaagctgggaaagagtgagcttaggtccgtgaacagtgatgagttcatgaaaatatttgaatctacctgaatagaaagattattttaaactagggaaaatttattttaaactggaagaggctgaaaatataaagtccactaatcttgtctgtctccatgagcttttacacatacgcacatgtgcacacacacgctcgcccatgtaatgttcacttaggtcaagatacagaccaacccaccaccccagaaggagctcttgtgcccctttccaatctctccccaagataaccattattctgacttccatcaattaatcaattttgcctattctttaacttaacataaatgaaatgatatgtgtacttttttgtgtctgactttcttctcctcaatataacgtttatgaaatttatccaagattttgcatgtatcatttttttaatgctgtgtataattccacagcatgaataaaccacaatttgtttatccattcacctgttgatggaaatttgagttatttctaatttttgtttttttcaaatgaaactgccgtgaacatcttgtgcatatcttttggtggacataggcacccatgtctctcagatggataagattcgaattataggttccataggccacatataggtaggcctatttgtatctttatatttgatttgttctattcttctgcccatgacaaaggtagtaaacagggtgtctttgagcagggaggctgaaaatgctctcttgtgagcagggtaagtagatggcttgtgctggtgcagaaaggcaggatgctggagaaatcccaggggaagcatggcaccagtccaaccagagactagggaagactcattaagaataactttttactacatgtaggtccagggaaagctgacatgggaataatgattaaaaggaatcaagtaaaggggcagagaggtagatttaagtaatggaaagatttttggtctgctttctagttttgtcctctagcacaatacgaaataattggctgtgggtatattacaggatcccttagatcttattgtctcatttataaaatataaaggctgtacagggtagttcctaaatggcctttgagctttcatcttctcataattgcatcaataatggcttagttgtaaatgaccaattctagtaataggagaaaatcgcatggaaattactgagaaaagcccagtttacttcatgctgttatcttaacatccacaactacatgtcgagagaatacgaaaatgtgttcttaggcttttccttgttcaaccagtctagccatgtgccattggtccttcaagggcagtggctgagcctcttttcttcctcccccactttttgctccctaccagacaaccttctcccataggtgctagtctgtttcctccctgactcgcattcctgcagccaatgcacctgctggtctgctggctgttgtttctcactcactgaaaaccagatctcaggatggacataggttggtggaccattttcttccagtcattcattcattcacttacagattaactccagttacagtcactgtagctagcatcacatacactaagctatctctcatactcttccagacattgcctaaggctgtggccacccagcccctgccctactgggtggagcccacacttgtgatatctcagagtgcttcctccaaccaaagaacccagccttctgcaggagggacacccctttccccctcagacagtcctgattctggcatattaccagaggccagtctttcctgatctcctcctatcctgagacgttctaggcctccttgagttccagttcgctctttcaagagctgcaccaaaacatctttacaacttgtgtttattatttgctgaagtttagctatcttaataaagaattatacttgtgatgaagtcagggccaggtcagtttgtctttctattcttggttcttagcttgttatctggtatatacaaaatgtttcatgaaaattcttcgtattgaagaaagggaagggttttgccaaaagccctactcaaggctgggaggtactgacgcattactgacacctagggataggctacctaaattgcagggtcatggactatgacaaaacagagtgttagtagtgaacatctcaggtaataccacataactttttaaaggggaaaggtcttcctaatttctataaatagttcaaactttcagacttagaatagtcctgcacttgtggcagtgccctcatagatccagaaagaactgatgttatctgatcttggggaaagtccccgccttgggtttgtaaatatccttactgacggtttctagacatttatgcacgacgttttgtcatgtgggatccagcacatatttctgacctggcgaaaactaagaatatctcaatcataaaaataaccagaaaatcataaaacagaaatctggcccaagattttctctggaaaagtaagaagctgctttgaaaggtgaaaatagaccagtgagcccccgcattggaacagattattccaaaaattgtgagcaaaggtctttttctgtattgtgcaagttaatctcctttgcccctttttgtggctgaaatgcatgcctaatctgcatatgagtgcctgccccaggtgggatggggcatgctgggattcctaaaattcagctggcttgcttgaagagggctatcaggctagatttcatgtctcaacaatttctagccggtctccctgagctggcaagcaccgctcagtttataatagtgcctggcacatggtaggtccagtgtttattaaactaacagatattcccaacaggtgtgggcagcagtgctgctaattagcagtaacatagccgcatggcagggacaggaaaggggagccttctgtgtgtccctactatatgcaatgtatgactccaatctcaaaagaagcagagaatactcagccaaatatttgcattgattcctgccaacaccatttttttgtgatttgtatgttcccttccccaccccccaccccctgtactgttaacttcatatttgaagggggttatacttttaggttatttgtgaattgagtcagctcatgtaacagtgattctcaaagtgtggtcccaaaaccagtgggatgggcatcacctgggaacttgttacaaatgcagattattgggtcccaccccagacctactgaatcaaaaatcctggaggtgggtccagcaatcagtgttataatgagcctaccagatgattctaatgcacattgaagtttgaaaaccaccattgtttaaggatcacaacaaatccaacagcactgtcagaagaacaactccttattctaatgggtcaggtgctttctgtgttggctgtcctgcagagcatctctagtgatagttgtattttcaggattagaggtgcaaaactaatgggagtttaagaaggaagtttgagcctttactgctgggagaatcacaagccaagtttatttctcttccattatttgtatggtagctaaaactgccaaggactactgtgatccattgaaacatcagtgtatcacatctcttcttacatctgagctggcattttgggtgtagtgcttcagtaacagttgtattcccaagcaaataaaatcttagccaccagaaatcttgagttggactagacaaaggcacctctccagatagcagctgttgttggaattgaatataagagatgcttaatcaatgtttgtgtaattgaatagaatgggaaatgaatggctcactccaaactttatacaagacagatgaaggcaacttcgatcttaacctttatgatacatagcattttgtactacccttgagaaaatctcagtctcgggttatcatagactcaattggctatcatgggaaattctgtctcagtgatgctccatatctatttaattgaggtttattatcaatttgaaaaatggaaaattcacctcacatattttaaatagccaagatagccagagtgtatgttgtggtttcaatatgtccccaagagttcttgtgttaggagcttggttgcctttgcagtagtgttgagacgtggggcccttgggaggtgattgaatcgatgctgttatcatgggaatgagtttgctatcttgggagtggggtcctgatataaatgatacatttggctgccattttctcttgtttcatgtgcttgcttccaccttcccccttccaccatgggacaatcctctccagatgcctgtgccatgctcttggacttcccagcctccagaactgtgagaaataaatttctttataaattactgagcattctattatagcagcacagactaagacagtgtaagaaagctcttatattataactctctccttctatttgtattcaggttttctcttaattctggaaagtttgggcagcagctgggaatgggaatttattataagacatcccttcagtgtctctacagaattgctttaattaaagtactttgttttatttgtccccatttaattataattcacatcagagaaagctattgttaaaatattttggttagttcagtgtggggaatgggattttccatcccttgaccttcatgactcagtaaggagcagataaaataattttctttgctgggtgattattatgcctcagggacaagtcatatttaagacctgatagtttgattcaagctctcataattgctgtgcagacagtgttcaaagccaaagtcttcctgatcataaggtgctgagaggacattcattttttgccatcattcagagctctgcaagagagcaaattgcttgttacttaaatgtgttacctttgaagaataaaaatctgaattgacactgctgttatttgagccttcaggtgtagggacttggagcacctatgtataccatggaatgtggcttaacaggactaaactgattccttctgcataatgtgctatatactgatttgcactgtatggagtaaaacctcttcaaccatatttgaaagattgatatttactctaaaaagcctataccttgatgatatggtaaaataatcaggttctctataaccttgaatactagtaagctgtttctttgccttcctaataacatgagggtttttagtttttgtttttaaccagcatttgagtacctactatgtgcctaatagagtcagagtgactcacattaaaattaactagagttaccaaaaatttgtccttcttacacaaatatgcaatgacaacagaatgattatcagtaataaatgtatgtgcacttgcagattactaagtgactgatttaccacaaaaaaggaaaggaacattacttagatttgttgctgtccactccttgtttttcattatggttcagtttggattttcaccacaattcagacatgaaaactattctttccataatgaaatcaggtgtgaggttttttttctcattcttttctttagaaaatgtatagcttaggccaggcgcagtggctcacgcctgtaatcccagcactttgggaggccgaggtgggcggatcatgcggtcaagagatcgagactatcctggctaacatggtgaaaccccatctctactaaaaatacaaacacattagccgggcctggtggcacacgcctgtagtcctagctactcagtggtacatgcctgtagtcccagctactcgggaggctgaggcaggagaatcgcttgaacccgggaggcggaggttgctgtgagtcgagatcgtgccaagagagactccatctcaaaaaaaaaaaaaaaaaaagcaagcaagaaagtaagaaagaatagcttatattttctattaactccaaccaagcaaaatttaaaatgctaggttgcactccttgcactccgtagtgcaacccaatagcaccatggctttttaattccctgagagagagatggtggacagggtgttctgggaaactgctgacagtaacatctgtccataccgaaagtcaagtgaaaacttggttcacatgagagcaaatgaaaatatgatgtttttaaagaggctgggaaaaagtcagagaagtgctcccactattttagatgagctcagcagcaagtttctagtaggtaagagggaaaatccattgtggggaaatgtgccaatgactgtttttggttaaaggtttgaatgggcacgatttagcagaactttacaaagctgtgtcttgaagagctttggaaaaacatttagtgttgttgtcgttgatgattttttttcatactctctgttgttcaggttatatgtgactgaaagaaagaatgatgtagtttcagttacttccatgacccaccccgggctagcacctccttcagccacatggtaaggtcccagaaacatttgatagagaccacatgaaagtagatgcttatgcagatgtgacttttgaaatacattcttcctggctttcagatgtgctattaattgcaggtttaaaagcccttttttgtttgatctgataaggtaggcttactttatgtcaccttaaaatgaggttaagccaagaattgcaagatataaagtattcaatgactactctccatttctgctgggaaaaagaccatctgcttaggtaattgcattgtaatactcaaacctggctgaattgcttctgtccctgcaaacgtctcttctgtcttttacattcacagtcatatatctctcctgcatgtagatccaagacccagtgtagccttttgtataatttgtaggattaatagactctgggtctggcctagtacttatattgtaggtctataaattatcataataacataggtataattgcaggtagagttttatatctgggtctgcagtggtttgatcattgactcactgagaacaattattaatcttcaactccaaggtaggacacacagttccaattggtacataaatagtacatacatttacattacagcagggggacattgtctttgaaagaacatgaataatacgttaaacctggaagctgggagggggacatacagtaagtgggaaaagagatattgcagaaagtttaaaaacagagaagaagaaaataaaataaataccaaagcaagcatgctgatatcttaaattaggtgcaaggaattctttttccttctgtgcctcagagctgcctctatgtggccatatgtgccttgagggggaaggagtatagtaagctttgggaatgatgattcttcatcttgcaggatgtagttgctcgtgttggctcaactcagggtaaatattctagatgattgatgtatgaaatcctaatagtatgccatttaggagtttgtttaccatcagtctccacattcagactttttcttgtgggtttgaatgttctgtagtttctgtaatattgaattcaaaggtttgcttttgattggactttcctaattaaaagcaaatttattgtccctacaccttgcctctacttagcccaatctcacacaccctgtgaggctttttcccagatgttatttctccttcttgaagcttcttataggcagaaactggacctcattcatctttttatcttttacagtgctctcgcaaatatttattgaataaataaatgacataatttatacagtctgtgaggcttacaaataccttctttaagctattagtaaaacaaaagtactggcacaaagtgatttcttgttcatataacagaagtattttactttcaaacacacacacacacacacacacacacacacacacacacacacagaaagagggagagaaagagagagaagcccaacccaacaaaccacttaagggaaaccatgaaaatggtatctttgttgagagttaatgagtttatagttaatttatgctttccctggaatacatattatactcattatgtacaagtaaactatgactgtttttacacctatcacagatattccagatcttaaaatgctctgtttgaaataaaaggcagaaggggggacttgggcatattcccttatagttattcttgtgtctcttatggaatagatgcaaaaaagtctaatttgcctttctgtcacttggcaaagtttattatttgcttaagcacaagaagataaatgttttatcctactggcaaaaagtattgtttgcacaaatgtaaaattctgttaaatgtatttatatgtattgtcttagtcagggttctctagagggacaggactaataggatagatagatgtacatatgaaagggagtttattaaggagtattgactcacatcatcacaaggtcaagtcccacagtaggccatctgcaagctgaggagcaaggaagccagtccgagtcccaaaacctcaaaagtagggaagccaacagtgtgcccgaaggcccaagagcccctggcaaaccactggtgtaaatccaagagtccaaaagccgaagaacttggagtctgatgttcaagggcaggaagcatccagcgtgggagaaaaataaagaccagaagactcggcaagtctagtccttccatgttcttctgcttgctttattctggctgtgctggcagttgattagatggtgcccacccagattgagagtgggtctgcctctcccagtccactgactcaaatgttaatctcctttggcaagaacctcacagacacccccagtgacaatactttgcattcttcaatctaatcaaggtgacactcagtattaaccatcacatgtatgtttctatttgagtgtttctgtaaatgacatgctttagtttttgacaagtcaaatcctaccaaaataccctcatagaaaactcttgatgagagtaatggttatatccaagtcctctcaataacaaatttatttcaatcaatatttaatatcacaaaataacagtatgacaaatgaaggatagaatgtggttaactagtgtagagtgtgaattatttggactggattgtgaagtagatgtaactgatactcatggatgaacttgcagtaattatagataataaaaaattaccagccaagtgctgtggctcatgcctgtaatcccaacactttgggaggctgaggtgagcggattactgagcccaggagttccaaaccagcctgggcaacatggggagaccccatctctacaaaaaatgtaaaaagccaggtgtggtagtgtgtacttttatgtaatcccagctactcaggaggctgaaattggaggattgcttgagcttgagtcaaggccgcaatgagctcaggccactgtacttgagcctgggtgacaaagaccctgtctcaaaaaaaattataatgcgtacataattttttcacacatcaaccactttcctaacaagtcattgatcctcaaaataatcctgtgagtattattctcttctatgtaaatggaggaactgagtatctaataggtgattgccacatctaggcagctggcgtggagggtgttgaagatttgagtccggtgcctttgaccccaaagcctatggctggagatgcctgccaaggcaaaactgcccttaccaaagcagattttatcagctgatcccatttctctctcactaaactgagtccatgaatccttctcaatgtagacaaaatctatctgctatcctgacctatgttatttctaagtgtattttgctgggcattaacgcagatggaatacagccgagtttgcgtaagttctgtatagtacaccaccaagcaccttaacaggagcctgcaaattgccgttgagggaggtaacttttagcatctgaggctttgatgtgtttatcttctccaggaattttgttttgcctcctttgggaggggagaggtcttctgctaagcatctacttcctttatttcttactgcacaagaacttcggtctaattggccaactttgagtgtgctgaggtgacctatttctgtctgggataataaaaacattccagatgactgacgccttttactggggacaatttgacctgattctaaccctcctgctctgcctgccaaggaagatgattactacaggccttagtaccgacctctatttacttcatctactttttttttttcattttcttgcaaaaatagcaggcttgtccaagtgcctagctactatggcaataagtgctatttaaacagatgccgatgccgaatacatgtgtcccagcttaaatgagtcagtgggagcagttgtaggatctgattgcataaatgcatgggaataatgtctgtctctggggcaacagaacttcttttgagcccttgagaggaccagttcagttgcagaaaggctgatgtaatgatcacacaccttcaggtgaaagggtcagtttctccctgaatggaaagtgtcaaaaaatggccatttagactttctgctttgtaactagagcaaatgcctcaagaaagagaaaatgaacaggaaagccctcaaaagctttaaagggcttagaaaatgtaaagccattattgttggttattcaaatatccctctgattcaaatagatgcattgattttttaaaaaaatctacagttaacatcaagaaacttgagcctcagtaaatgagcactgccttatagaatattgctgaatatgtcttgaataagttgagaaagcacttggctgtgtataactactcatgtaaaatgctattggcacaaagatgacatttttttcaaagatgcctctatcatgtggctacaagtagattgtgctgattctattcctctacaaagctcagggtcacaggtggtctattagtagttgttggttgttagctctgccataagaagatggcatggttccttaggttagatgcattcagagttggtggtggacttgagtgtctacttatgcgcagagattttcagtcttttatttccatcttgacagtagacagagaagcaggggacaggcttgaaatttcagtcaaatatcaatccagcatgaaggaggacaccctgattttaaacacccactaatatttccttggaaaaaaaaagagcctaacacatctctggctccagctcttctctcctcccctcccttccctcagcccccaattctcttttcttttcctgtcttcagaatatgtgaaatgggggaaatcataaaacagtcaatcttcattattcacagtttccatatttgtgaattcactacttgctaaaatgtcttcgtaacggcaaaatcaatgctcactgtgcttttgtggttatttgcagacatgtgtggaacagtgaaaaactggagttgttccccatgcatgtttctagttgaagttaaaccaggtgacagccctttttgtttcagccctcatactgtaaacaactctcctttttgtggtcagcttagtgccacattttaaaacatttttctgcttttttttttggtgattttactatttgaaatggtccaaggatagtgccagcctactgtccagtgttcctaagtgcaagaaggctgtgatgtgccttgggaagaaatatgagtgttagataagcttcgtccaggcctgagttgtagtgctgttgctgtgagtccaatgttagtgaatcaacaatatatactcaataaacagtctttaagtagaaacacatgttaaacaaagttatgtatttatcagttgatgaaaatgtgaccagaggctcacagacacctagccctgtatctctccccagagcaatgcttcagtatttgctcagaaccaccacaagtaatgagaacaggctaacctaccccttggagttgacgtgaggatctcatgagctaatgcccctaaaatgcatggtgccttacagtgtgccccataggtgctaactatagcagttatcatcatcatcatcatcatcatcatcaatgaaaatacgggagaagaaaaaattaccaataatcccactattgtacctcaacaactctcttcattttgggtattcccttcagtcattgtttcgttgcattcacatctttgtataactgcattaaactgcatacaattttgaatatttctttgctatcattctgtcatgtgcatcaccctgtgttgcgacacagcctccatttctgtggtcttcttgatggaaagcggtaaaaactttgttcctgggctcatgtaagagcagctctcttcaagcatagggatgacttcattgctcacgacaccaatatgccttaaaattctgtgattaattgtaaaaaagaactctctctgaacactacagagaaaactctcacagagcagagaaatttattatgtgatcttcttctctccagaggaaaatggtgtgttttaagtcagaaggtttgggtcattattcagtagaacgaggtgctcgagggattacaaaagaagagtaactctaatctttgtgagagtgatggcctaatacaggtgttagcaaacatttcccgtacaggctcagatagtaaatgtgttagaccttgtgggccatatgatctccattgcagccactcaactctgccattgtagccaaaactatggataatattaatggataatattaaacaattgagtgtggctgtgttcctataaaaccttatttacaaataaggcacaattccaaacaaaatagatctgaacaccaaagtgggcagttcgtttattgctttattcttccacaaaacttctagtatgttaggccttgtcctggttggcagtaacatcagcaagagtagcaaaacatttttctatgcctcatgaagtttatagtctgaagggggagagagcgatcttaataaaataattgtataaatgaatatataattgcatgtgttgataaatactgcaaaggaagaaaacagtgggaaataggactgtgtcagatattcaggcacgaagtttagggaaggggctgcactttgaggtggccgccagacactcattgaaataagagggccttgatcattgtgcagtaagtgatttttattaacaagaacttagtcattacatacctagctgtaagtagatgctagctctgaagaatagattttcggtggtcagtttggcattcaaccaggaccaaaagagaatcccctcattcgctgacttggggctggatttatgagtgtcgtcactccctttgtattttctttttttgtcttattggtctttctaggcagaaatgaataccacatggttgagacacgcataagattcaggtccatcaggtcttgagcatctttctggtaacttaaacataagccaggatccacatatctaacggctacatgggatatagggcctcgttcataaaaacgcatacccatacttcttaatatgcccttgcctgttcctctttagttctctcaccccctgcaaatattcttcctttttaaaccctcagtttcttcaccaaactttcccagacaacctatccccaaggactttctttatccctctttgccagccaacctgtgtaccccttttcttctggaggtgcactgaggacttttccctcctgcctgatcatctgggcctctctgggctacccgggccttgcagcttcatggttcctccctgagcctctctccctagggagggaagcacaaggaactcactggagtgggcagttctgttcacaccctggtaaatgaaatcctctgcctcattacactctgcagacaatttcagcatccagtcatgcttatttcttgaaggaaaaggactgtttttccaccatttgggtctatgactccactggggattaaggaaagagacaacattgtggaatgtgtgtgtgtgtgttgttggagacagcttttgcttgggctggtatcatgtctactccaggattttctgaagtgactgtgggacaggaagaggcccattggtggctacttagcaacaccaggcccttcacgggcagtggaaagtcactggggtaatgccccagaccctcaccctcaacaggctacacctggacagagacagggcacccttatggggctttcagggatgagatgtgttcatccacaaataagggagaagcacagagacttctacaagtatgtagaggagaatctaggagatacaatgcaagggctgagaatttgggatatacacttattactgttggtgtggtcctagccttacaacaggttgtgcagcccaccaaagcatggattacagtgttaacatgcagaaattcctgattgtacctcttttccagctgttcaatcctacatgaggcctttcaaaacccctgtgatttcttacgattagagatgtaggctgtcccatctagtaaatttgtcaaaccactactgggtatcaggtagaaatagagttccctttcatcactagcaatatgtttcttttctcaatggtttgctctcctttgctcattttccatggaaggtcttcattactcctgtattttaaaagctatcttgtcaatattattccaagcgaatttctcagtatattttaaaagggaaaactaataatgtgatcctcttgcttaaaaccctttacagcttcccaagagtgttagaattaatggggctggtactagcatgcaaaatttaagggaatgtcaaaaaagtcagtagtcaagataaataatatttaatgcactattttaaaaatgttcttggcaaactttcgtccacacctgcgtttgtaaatgaggtttcaactcacaccgtgcatgtgacttgagaggccactgcagcacggccaggcctcagtgcactctctggcctcaacgtaactcccttgaccttccatgttgtattagtcctttctcatgctgctaataaagacataccccagattgggtaatttataaaggaaaaaggtttaatggactcacagttccacatggctggggaggcctcacaatcacggcagaagatgaaggaagagcaaagggacatcttacatggcagcaggcatgtgcaggggaactgctctttataaaaccatcagatctcatgatctgtgacttagtcactatcacgagaacagcatgggcaagacccgcctccatgattaaattacttcccactggttgcctcccacagcacatgggaattatgggaactacagttcaaaatgagatttgggtggggacacaagccaaactgtatcatgtaaccaaatatgttaagctccatccatgctgactttggtggtcatgtccatcccgggcctttatatgggttgtcccctttcttcacatctctgctgagctggcccctgctcatccttcagaactcgatcaagtgctccttccctcttgttggccaccctgagccccaaggtgggatcaggctcctctgctaggtgtcctcagggtggtgcgtgggggtcgttagtgtttgtccttagaatacctggcaagcagacatgcacgtgggtcattttgtttattaacaccaaactcctccagttgattataagctccatgagggcaggactgaatttgtcattcttatcgcacagtggcttacatgtcagtcatcactgaacagttaatggtcatttgatctgatatgcttctggtataatttcatgatatcagatctggagacatgaagtcattgttttcctggtggggagtgtgacaccaccatcttgttcaccatttgcagagttctttcctgtcttcgggcaagtagattaggttatatcgttatctctgtttatagctgtctcaaataaatcctttagaagagggagaaagatggtacaaagaaaaaagaagccaaggaggaaagtgactctcagagatgctaatgactttcccaggaaggctgtcacacagcaagaactcagatatgggttttacaactcagaaactcatcctgttctaggccccaacctcactctctcaggagaaggtcctggaggagattcccctctcactttccagaaaaaggacaaagggaattaggaatcttttcttaacattaacgccttgccaatttctagacctcccctcctgctcctcccttaagacatcctatttgcacgtctctgctcttagaggctattgggtttaagcgccacaataaataaaaggcaataaaataaataaaggcaataaaagatatctcctggtaggatataattttctttctttcgttcactgtctcagagttattttatccttttcaccacgagggactcaattggaactggctctcttattagccttcaggttcaactggcttccatggaggcattgtctcctcatagacctgttcacttgacagaccttcacagaagtttcatcagtataaggacccaaaacaccatctaaatggcttcatccagccatggcagatgccctttgctgctgggttgggtttttttttttttttctttcttttttttttgagatggagtctcactctgtcactcaggctggagtgcagtggcacaatctcagctcactgcaacctccgcctcctgagtttcaagtgattctcctgcctcagcctcccaagtagctgggactacagacatgcaccaccacacctggctaatttttgtgtttttagtagaggtggggtttcgccatgttggccaggctggtctcgaactcctgacctcaggtgatccacctgccttggcctcccaaagttctgggatttcaggcatgagccactgtgcctggccctgctggttttacttctgcctgaaacccactggggtgaaaggacaggccttggaaatgttgcattagtagcaactgctccctctaatgggaggacacatcccttccccatagtcagtgcaggagtcacagaagcttgagcacgacctcaggaatcggcttccattcattcattcaacccatatttactgagccccagtgtgtgccgggtacttctggacccttgggatatgaggtgaacagctcacagatccctgccctcctggagtttacattcttatgagagaaacggtcaatgaatgagtagtcaaataagttttacttccagtaatatgtggtatggagaaaaagaaatgaaggagaacagagataaagtttggtgatggtggaaggtggcagacagggtagccaaggaaagccttgcaaacgaggtgacatttgagcagagacatgacatgaagttctgggagaaaagtttatcaggcaaggtatatggctggtagaaaactctgagtccaaggcaaagtgactatccacaatcagccagaggtcaccatggctgggaagcatggcaggaagtgggaccagggatgcatgcaaaggccaaaacaggagggagttcatgctgctcatatctgttctggaaggacactggagaaatgtgtgtgaagaggaacatgaactgacttatgctttaaagggaccattctgaccgtcatgtgcaatgaatggagttgaggggctagtcaggagtagggcagagagatcaggtgagaggctcctagaataatccaagtaaaagatggaggtgactggattggggtgttggcagtggaggtggtgaggaacggtcggtcagatcgtcatgtattttgaaggcggagttcattcaccattgttgctgtaccagttgtgggctaggaaagaaagcagtgtgggtcaagcatcactcattcattcattgacacatacttgttgaatacctatcatgaacctgcccttgttctgggtgatggctataccggtaaacagaatagtcaaagcttcctgcccttgtggaacttacactttattattttatttttatttattttgttgaaacgaggccttgctctgttgcccaggctggagtgcactaatgcaatcatagctcactgcagtctcaagctccttgggctcaagtgatcctctggccccagcctcccacgtagctggaactacaggtgatgccaccacacctggctagtttttgtagagacagggtctcactatgttgcccaggctgatcttgaactcctggcctcaaatgatcctcccaccttggccttccaaagtgctgggattacaggcgtgagctactgtgcccggcctggtttacattttagaaaaagaaacagaaaataaaggtaaaaaaacaataagtgaattataatacatgttcagaagatatttgttatggtaaaaagaaaaaaatagagcagaagagggaccctggggcaggggagcagctgcaattttaactagggcaaccaaggtgggtgttcttaaaaggtcgccaggttttgggccctaagtagttagatggaagctaatactactatttaatgagaggtctataaagattacacaaataggctgggtgcagtggctcacacctgtcaatcccagagctttgggaggccgaggcaggcggatcgcttgaggtcaggagttcaagaccagcctggccaacatagcgaaaccccgtgtctgctaaaaatacaaaaattagctaggtgtggtgacacacacctgtaatcacagttactcaggaggctaaggcaggaaaatcgcttgagcccagaagtcagaggttgcagtgagccgagatcgcaccactgcactccggcctgggcgacagagtgaaactccatctcaaaaaaaaaaaagaataaagaaataaaagtgggaagaggagcaggctggaggttagggtggggtaaacaagctgttgtcatacttgagtccttgagtattgaatttgagctgtctcttagtgacaataccaagtagatagttggatattcaaatctggggcttaggcagaggccagggctatgtatatacatttcaaagtatcagagtctagaaggtctttaaagccataagaccagatgaggtctacaaggatgagagtggagagagaaaaaagagggcccagggccaggggctactgagtcctcagagtagagagaagaaaagaggaattagcaaaggagatgcagaaggaatagccaggaaagtgggagaaaaatgaggcgcttgaacgaagagctgaagaggtagaaagcaagtcacagcgctcaaagcagcaggtgagatggtgagtgggttgggaaagtgactaggagaactttttataagcgacttcctgagcagcaagtgatcaagttaccctgttgttagctatttgacggtggtgtgtagagtcacagaaaggtggcctctccctgtgtgcccacggaaacaccagggctgagccctttgcgtttgccagtgttcatgtgttcacttaagaattaatattattctccaaggcaaggcagtgggtacagatcgcagaagagtcaataccacacacaagattttgaacttaaatttataggcaatggggatttagataaagtttttcagcaggagagtgacatatgtaacctgttccatgtaaatagtttggggagcagaagggaggatgagttggaggaaggagaggtgatagggaggccattttagtagtggagccatgaaatgggggagggggagactgaaccaaaggagatgcagcgagaattcgaaagcagagatgcgagagacacggagaaggtggacatacagcctctggtacgtgattgtgggagggtacaatgagaggaacattgaagaccactcttggggttctatcttgtgtgactgggggatggagcccactgtgggtttttgctgggagatggagaggagaggctgtcagattaaccagtttatggattaattattaagaaacagcagggacctgggatttcccctcctcactgattagttagctggtaattaggcagtggctgagaatgctactgtctgtcccccatcgggtgggaggagcagagctgagcctccccacagttgctgtggtgcatggagtggggacctagaatcactgctatcacgtgacatgccccctgttcctcctgggaacccaactctgaaggggtcttcttgacatccgattttctccttccagagctcttctgaagttcttgcctaatgaagaaaaagcaagaaaagggaaaatatgtgtaccacagaattttccttctctctggtggtgttttgcaaaaatgccatggcaactttcctcttcaaatacttgggatttgtttctcttgcatctgtcaagtgcacatcaaagttgaattttccactttggaattatgatttgtattctgcttctcccatctgggcttctgttctcctgaaaactgcctattctactgtgaaatgagcattccccaaggctgatgtagccgcttcatgctaagtgttgatgggaaacctgaagctgagttgggcaaatgtttttgagatctgtaaattccccagagacttaaattgcttgaattattgagggacattttgacctcttgttggaccaatgagaatgaaagaaaagattggttaaatagaagaaatgttcagaatccccctcagccctccaaattccaaatattttcttttttctttctttttgtttcttttgagacggagtcttgctctgttgcccaggctggagtgcagtggcacaatcttggctcacttctacctctgtctcctgggttcaagccattctcctgcctcagtctcctgagtagctgggattacaggtgcacgccaccatgcctggctgatttttgtatttttaatagagatggggttttactgtgttagccaggctagtctcaaactcctgacataaagtgatctgcctgccttggcctcccaaagtgctgggattacaggcatgagccactgcacccggccaaatgttttctagttaagttcatatacccatgccagagtgcctagctcacacttcattataaatgtctgcctcaaacagaagtcctgggtccatgtttccactgtcctgcgagggatacacaagaacacttggcaaacgaagaagggaaggcctggggctacagtgggtagggagtaccagagacccaggggacaatatatgggttaaatgaggactttatttaatagtatttttaaaaattaaaattgtgacaaaatttaggaatcagtaattatttaaaaatccaaatattctgcttctcttgaaaaatcagaagacatggcatctcggggcccaaatttctatttggcagttttcagctggaggtcagctggtgtccccctaaactcaaggcatgtggtccccagtgggtcacgcccaccagaatcctctgctgtcttgatagctctgaggtccttcagggatcactggggaatgatgttctcctagaagactttctggatcctccaggtccaggttagatgctaaccaatgctcttaaagtagctatagcaacttttattaatatagataatattttatatttttcatattatataatttttgttattatattttaattgcttcctgacttatctcagtcctcttcagtataatttagtctccataagaataagtacttgttgtgtttgttattaatctccaacatcttggctgggcgcagcggctcacacctgtaatcccagcattttgagaggctgaggtgggtggatcccttgagctcaggaatttaagaccagcctggtcaacatggcgaaaccccatctctacaaaaaataagctgggtgcgatgctgtgcacgtgtagtcccagctactcaggaggctgaagtgggaggctcacttgagcctcagaagtccaggcttcagtgagccaaaattatgccactgcactccagcctggcgacagagcaaaaccttgtctaaaaataaaaaattaacaaatctccaacatcttgcataaggcccaggccataagcagacattcaaataaattaatttactaaataaggacaatagactaaataatccctggggtccattttagttgtactattctattgctctgatgtttctctttaaagaaacagattcatgggttttctattagagtaagacactgtatttgtctctacacatacctgagtaagaatgctttgggttagatccctcttttttggttcgtaaaactagagaagagaacagatggaaaggaccttgaagttcagcttcctaatttgcaggtggagaaacaggctcagagaagatacgtggacttccttcgagtcatatagttgtaacccaggttaggacatgtgcctccagggcagagtccacctgccttggtctctagtctgaaggaacaaatgaccagtgtggtagataagaacaaagtatattcaaagcctataaaagaaaagagacagagagaggaaagtggtactagctgacaaatgtcaccttagtggcaaaaacagtaaataccgtagaggtttataggacagaaattacttcagaaacgtaacaaggtttaagcaatccagtgtttattagcaatggttctctgactggggtgtccaaatgcattctaaggggactttgagttccctttgaaaacagtgaatgtacaatttcagggattttcatcatttctgtgagggagtatgacactttcctggccattgaaggggagaagggaattgatttgtaaatgatgtgtatacacaaagtgaaggcccagtgatggaatggtgatggtttgcagtagtttggggctgtggcaattagtgacattttgtttttacattataaacagtgatgtaattggagtgaaatgccattatccactgcgtcattttaatgcagtcaattgttactggcttcgtatttagtttttacacttatgttggtgtcagaattatagaagagttgtaagcaaaagcactttgcatctagttgtgttagttttgtgtacattgatgcaacattgcaatgaaagtaatctaaaacaatgccaacagtccaagagattttatctttcttttagaaagagtctatgcattattcaagcttgttgtgaatgctgacttcctatagcacttgcatttaagttatgagaagttattggcatgagagataatttaagtggcatgagctcatctgctgtcactgcatgaattacttgggaggaacttggtgtgggagatgtgatatgctctcccctcagtaggtggctgttcccacaggcaattctagattctaagataattctgactattgttttattgactttagaaccagatcctttgtaagatgttatgatgtacagggtctaagtggtggaaggatgtgtctttcctttaatgtgatataagccagagttcagcaaactatggcccatggaccaaacacagcccacagtctgtttttgttaataaaattgtattggaatttaggcacactcatttatatacagatggtctgtggctgctttcacactataaatccttagtccaatcatttcgatagagatcctatggcttgcagagtccaaagtctttattatctgacagtgccctaggacccagggtctaaatataaccatttctgcactgtgctttcagcttctgtgtattttatttgtttctctaaagtgacctaattaatctgtcctattgggataattagggaattctagatggttgttgctttgtggaagattccgtgatttctctaataagggaatctagtctattctcaacatagattcctactttcttaaaataggatgctagaagctagcaagatgctgtttgattcaggagccccacctgccagagctagcctcaggctgcactgtgaatgagccacttgtgtttccacccgtccgccctgcttttcggaacccgcttccttcatcatgtctttgcgtcactgccttttcactccatcctgcctctcagtaacatcagtgaaggctctgatatctcacttttaccaccatttaagttcacttcatttgtccacttcttgcttcttccaagggtgtttgcacttgaagctttttgtccccactgtgtataggaagctttgccttccctgaaaggtttgaccaactcagaggagtggagggagaagggatgagggggcagcacaggacggggagtggtagggacagggctgtccctggaaacacacagtcctcctcagtgactgcacggctcattgcacctcattcctgggttgctgtacagatcagagtctacctcacctcaaaagccccacagtatttgttaaatgtctgggggattccagatacttaacaaataatctttcaatgtggtcgacttatttagggaacaaacacaaaaagactcacacaaaaggcatgggagtcaaatgctctttgggatacttgactggagagggctttctacttacacgtgcctagggaaatagtcaaaggatgaggggggttggtatgatttagggacagttcctagaaggagatacttactcctgaatgtgctctgcttaaaaaaaaaaaaaaaaaaaaaaaaaagaagaagaaaagaaaagaaattgtgttgggcgtaaccacagccttcttagccagcctgagttggcattgctcaccctctgaggattaggtcagccacagtgagctttctcaaggaagtggtgccttggggagcccgcgttggaaagcaatagcagatggctgccgtgggatgtatatggtcctgcttttttaatatgtggagaaaagagacctgcgctctctgtatgttcacatatatcaggatcattatatgttaattgcttattatggcaactgatgatttgcctcctgtttcttatgtgttctgtcagttaacatttattgggcacctactatatgtcgatagaatctgcacagtggcaggtaaagttttccctgtctttaaagagctcaagtctgataagaatgacaactcatgaataattgcaatctaggatggagaaacgggggaattctcccttagaattatatccccctcattgacttcacactaaattcgactttttaaattcagcagtgattatctaaagcctgagctgttcagattgttaaataacagtactctaagttaatctacaagaatcttaattaaagaagtgaatttgggtatgttcaaattataactcagctgaaaaacagtttctctactatgcattcccctcaccaatcccacttcccaaataaactgactgaggtgggataaaagggtccagactagaggatggcaaactccagccccaaggtcaagttacacctgccacctgtttctataaatagttctcctggaacacagaaatgcccactcatttacataatgtctatcatctgtggctgctttcaagctacaaggcagaggtgagcagctgggacagaggttgtgtgtggccagcaaagcctaaaatatttactttttgtatcacaggaaaaaaaaattgccaacccttggtctagagtaaactgaacacccataaaaagtaaaaacaacattattcaccacctctgactggcaaaatgacttaagaaccagcacactggtacattttaatagcagttaaatctagacacatttggatttaaattgaaatccaatatcctcctcttcatgatgaagtattaacatggttagctagctaagaaatatttgaccctcacgtacttaaaatatctcttgttttggtgtttgtgtacacaaattagggaatacaaattatgttcatgaagtaagtcatcttcaccaacggaaagaaatattctccaaatcgctgagaccatgcatcaaccctactgcacagttagaagaagggccacattaattacccgaggatacagaatctcttaggaagaggagtggccacagagaacaagagcatatatagtgcatttcagagaagtttctcctgccctccagattcccctgtggacctactctgagtccattctgcaagggggcatttctgcatttgagcagctcccgttcttacccattacacatccctgtgtatagggggcttcaggaagaacttacacaaccaatcgatggcctcagtttaatataacatttaaaaatatctcgctctcctgattctgtagccaaactcagaatcatcaaggccacttcctctcccaggagagtaagcaaacttactgcccagatgtcccccaaagtgtctttgccttcaactttgctgcaggctggaaaggctgtttctctacaaggactggagatgcaaacccttggaggggagggtcctggggagggcaggcacgtgttaaaaagggcagtagatgaaagcaaatgtggctgcaattgtccgcttctgcttgaacagcaagtctgtcccatgctataacagggattctgtaggatggatcctgttttttgttttgttttgttttgttttttgaggcggagtctcgctctgtcgcccaggctggagtgcagtggcgccatctctgctcactgcaagctccgcaggagaatggttcacgccattctcctgcctcagcctcctgaatagctgagactacaggcgcccgccaccacacccggctaattttttgtattttttagtggagacagggtttcaccgtgttagccaggatggtctcgatctcctgacctcatgatctgcccgcctcggcctcccaaagtgctgggattataggcgtgagccactgcaccctgccctgatcctgttttttagagaaagtagattgttaatccgtcactttatgtattgtctctaagatagcatctatcatgtatataggcacaaatgcatactggagtgaattcataaattaatagatgaattaagacctcagactctggagacaagcaaaattgagtttaaatcccatctttgccagttaatagctgttagttatctatcgctgtataacaaattgtcccaaatttagtggcttaagttattatctcacagcactgtgggtaaaggatctgggtttggctttgctgggtaccaaggctgcagtcatctcaaagcttggccaggtggggaaggacctgctttcaagctcacacatgtggttgttggctggcctcaaatccgtcatggctgttggctgacctcaaatccatcatggctgttggctagagacatcagttccttgccacctgggcctctccaaagggctgctcacaacatggtggctggcttcccccagagaggggaatctgagagaaagatccaagatggaagctacagtgtttttgttttcactgggaatgtgggcaaggcattgaaaaagatttttgtgtgagtgataaaatatacacaacattatttgctattgtaacctttctttctttctttttttttttttttttttttgagacagagtcatgctgtgtcacccaggctggagtgcagtgatacttccttggctcactgcaacctccacctctcgagttcaagagattcttctgcctcagcctcccaagtagctgggactataagtgtgcaccaccacacctggctaattttttgtatttttagtagacggggttttgccatgttggccaggctggtctcaaactcctgacctccagtgatctgcccacctcggcctcccaaagtgctggggttacaggcatgagccaccacacctggcctattgtaaccacttttaggtgtgcaattaggtggcattaagtatattcactgtgttttacaaccatcaccactatttatttctaaaacttttcatcaccccaaacagaaacttgaagctacagtgtttttgcaacctaatctcagaagcaacataccaccattctgttatattctgtttcttggaagcaagtcaccaaacatagcccacaattccagggggagggtatcttgaaggacaagaagaccaggaggaagacatcctagaaggcagtcccagaagctgcctgccatacaggctatgtgaccttaggcaggtagtaacctgcctcagtttcaacctttgtaaaacaaggatgatatcttagtctgttcaggctgctataacaaaataccataaactgggtggcttatggacaacaggattttatgtctcacagttctagaggctggaaagtccaaaggcaaggcagagtctgtctggtgagggcctgcatcctcacaggtggcaccttcttgctgtgtcttcacatgatgaaaggggcaaggggtctctctcaggcttctttttaagggcacttatttcattcatgagggctctgttcccatgagctaatcacctcccaaaagccctacctcctaatgccatggcctaggggttaggatttcaacatatgaatttcggagggacagaaacattcagacctagcagatgattttgcctgcctcatagtgctgtacttatatccagggggagcacccccaagtttctactctttaatataagattaaatagatggccccaagccatgatgtttggccaccatggactccaggcagggttttcctgcacggcttctcagatcttcatggtgcttcagcagagatcacatctttagatctctgacagcatgagcagatagagggcagagcagaggcagaactgtggcaatacaaaatatgattcctacatcttcttcccagtacaatctttatggggagcagagcttcctgtaaggaaggagaagcctcccctggacagtgttgagctcccatgtcctcatcatatctcctctgggagtggatccacccctccctcagttgctcacattcaccaccaagatactatccttgtacccattatggtttattctctttcttccatgcacattcccagtatcactttaatgtgtccgccctctttcctggtgagctgtcctgtgcagtgaataagaaacagttacttcccctggagggcttgcatatgactatgcaacgtgcaagcaggctgcttttaaaactattatttaaaatttttcaaaatggtagtatctctttccatccttgtcccctctcacaggtcaaacctaaacaattcagggtctcattccaaacaccagctcatggatgtgttctgagccatcatatattccagccatatctttatacttctgtggtcctgtggaatagtaccaatccagatccttaattagctgaaaattaattcagatgattgcatatttaagccaaagaaataaattaatattgtgtgcaaaggtttctggtgatgagtattttggaaggactgttaaacacatttgaaataaaaatagtttactggctaaggctcagaaaaaaacaaaaattattactgatcagtgttttctaaagtgtgttctgcagaccgaaatgctgtttatttgcccactgaccaaaattacattgataatctgtactaatctcatcagggttgatgagaatatggtaaaacagtcatggactgttttctgctgggagtataaattggacatgcctctaggcaagcaattttgtactatttatcagaatttaaaatgtatatgccctttggcccagcaactctacttctagaagttaatcttaaatcattcttgcacatatatacaaggggctttattgcagtactgttcatagtaagaaaacgttggaaacaacttaaatgtatgtctataatagaccaggtaaatcaattataatatgcctctactcttgaatattgtacaacagtcaaaataatgagcaggcttggtacaggggcttatgcctgtaatcccagaacttcgggaggccaagatgggaggatcttttgaggccaggagttcaagaccagcctggtcaacacagtgagacccccatctctaaaaaaataaacagcccacctgtatgtattcacatggaaagatggacatagtattttgttacctggaagaagcaagtcgtagagcaatattttaatataattacttctataggaaaagatatatacatatggtattatatatataatttctgtgtgtatgcacaatattgtgtgtgtgtgtcacacacacacagcatgttttcatgctgctaatacctgagactgggcaatttacaaaagaaagaggtttaattgaacttacagttccacatcgctggggaggcctcacagtcatggcgggaggaaaggaggagcaagtcacttcttacatggatggcagcaggcagaaaaagagagtttgtccagggaaacacccatttttaaaaccattagatctcatgagactcattcgctatcatgagaacaatgcaggaaagacccatcccataattcaatcatctcccactgggttcctcccatgacacttgggaattgtaggagttacaattcaagatgagatttgagtggggacacagccaaaccatgtcatatatgtatatatataaaatacatgtacaaccacatagatttgtttggaaggatacacaccaaactgttaatagtggttattcttcctcttgagaaagaaatagaattttctagagggtaggagggttgcttcctgctttgctgtgtatccttgcatattgtttgaattttttataattagtatacattgcttctgtaatttatgaaacaatttaaacatctcttaaactcatagacataacatatttatttttaagcaaattaagaaaaagaaccatgtaatctctctgcccaaatgtaattactattaatcttccatacctttttctatagatgtattgtttgtttttaaaaaatgtaatttttccatttagaccattttgtaatctgctgcttttatttcacaatatgggataaatgtgattattccctgcatatttatgtgccagtagatattcagttatatttctaatgacttcaatgttatggtttttaggtatatgagattactggaaactaggcatttgaaatgggcaaggtaaattcctagtgcaatatcctgttacctggcttcttgctttcatcttgttcatccgtacatctagattgtccaccctttatgcctaatctctgtcattgtcttgaataaaattttccatggctgcccattgccctcaagataaatttctagtttccttagatagattgcaaggcccctcactttccagttcatgtttcctctggcacatctttggccaacacctttatcttcaactcccatcaacagctcacctcacccaggcttattctcactctgccttccggtttcagctccaatgactccatttctgattcagttacttctctgtttctcagagcatcttccacttcttccatctcttgtttttgccacccaataggcactctcccttttcctgacaaaacagttcattgtgtgtgagagacttcgggcaaggttattaagctgtccacgcttcaggcttatcatgattcatcatctattaataggacaataatagtaccgacctcctgagattgttaattggaggaagtgaatgaatatctctcagtggattagaagtgcctggggcataataagggctctatgtgtttgaggctgcagttgctgtaattggaatcatctctcttttactcagtccacctagtttggttgaagttggttctaccctctgctctaggggttgctaaggtaatcagtaaatctcatccttctagatcctgtgatgggttcagaagagaacacaaaacccgatttgagccagtgagagtcactatgaagactttactttctgaaggagagaaactctctatctctaggcatgtgcataatgcatgctaggcttactgctattggagctgagacattgcagatggaagcccatcagagcatggaaccaacacagagggaaacacagctgagcaaagagagagaagtcctgtcctggtgatactgggatgagcctttcatgaagcgatgcctgaccagctcttcctccaattcctcagtcgtttgagccaaaatacttccttgttgcttaaaccactaagggttaggttttctgtcacttacaacccagagtttcaagagatatataccatgtcttaccaacatcataccttagtataatggtctttctattgatctctctgctgcatgagaccttaaggtctgtgaggacaggcctgggtcctatttccctttgtatctccagcttccaacatagtgcttgactatattagatgcaagtatttgttgaatgaaaaaatgtctcagaggctaccttgactatttcagcataacttgttcaatgctactggtttatccaggtctaaaagtctgctaatcgtatcagcaaggcataataggatgggaaaagaattaatattattgaatgcctgtcagtaactaggtaatgtatatgatactttacatcatgtcttttaatcagaaagcataattgctttctcccttcctgctatcccatgataggtctattactatacttccaagtcagtaaaataagaataatgaaataagaatatcaatgaaataagaatatcaatgaaataagaacaaaagtcagatgtggtggcacacacctgtaatcccagaactttgggaggctaaggcaggtggattgcttgagctcaggagttcaagatcagcctggacaaaggtgaaaacccatttctacaaaaattagctgggtatggtggcacacgactgtggtcccagatacttgggaggctgaggtgggaggattgcttgagcctagaaggttaaggctgcagtgagctatgattgtgccactgcactccagcctaggtgacagagtgagaccctatctcaaaatatataatatatgcgtacgtttagtatctaacaagaaaaatgaaaggcagataaaaagtatacatattctattctttaaaaggcaataatcatttgaatcttttgagttcaaaatgctgtgttttataaatttataaatgtgtctataaatttttctttctatttcttctacttcttcttagcattgaagtgagcaattttattaaaatctgccattttggtagtaaaacatttaaattcaaagtcaccttaagtgagtgatgtgcttgttgccagccacttaattagctgggggatgtgacacagttgtctacatgcaggacaatttcaaggtcactggtggaaaccctctcacctccccatgctgccagcttattgtcccatacatggtaacattcagatttgggactagatggccaggagaaaagcactgagtagcctcactccagaaggattttttgtgcttggctccctgacttctcctttcgttcagggagcatgcagtggtgagaacacctaaatcatgatccttgtcctccatctataactaattcgtattgttttaggttagtttctcagagcataagaatgaagactgtagtatggcccggctctttcttaagaaagcactcttgatgaaacaatctacataagtagactgaccagttaaatatggttattaatcattcagttttatctgcgtaatggtcttatcaaaactaattattgccatattaggtagatatttagagagcacccttttatggaccaaactctttgcagaatacagatactcaggaagaggatctcttgtcttgaaggagctgaaaattgagttgagttatcccagaatcgcttttttcctttagagttggaattttgacagatggagaaaattatctaataaagtgttcaaaaacttggttggcccgtgtgggttgaggattaatccgttagagccacaggcagattgagcacactattcttagctcagaagaagcaagttattcagagaaggatgagagatggcacattccctctagttcctttttgctgctagagaggtgagcttccaggggctcctagttcaggttgcttgtatttttttcacctacatttggtctccacaagccttcctttcatcgtcagatttgtccaaaatttaacacctgtgtgtgtctaatcaaggaaggacatgatatcacattatgagtgtatttaggtgagaagtcattgaggaaaataatgtttgtcatttgaaagaaagaagagtgttttatttttgagtcacttcaggtctttgtcctgaagaacagattcactcttgtttaaactctgtctcagtgagaatgtttgcggggatgggaggtagcacttcccattgcatctaatcatctagaaaacaagagactacaccttaacagtgcaaatccttttggaattgatctacctggtcttctgctttttcctttctccactctgctttgtcctgaattcccagaaatgccatcttaaaactcttctaaaactgctggctactctttcccctgtttttttctaccagtttttttgtttttgtttttgtttttttttaaaccatcatataaagagacagcttccaaatggtactctgtaattgagcaataaacaacaaacttttgtctgtatgtatccatactaccagtcaaaatacttaataacaaaatatcaataaaaaatggccaatgtgacatttttcatcttgtgtcaaaatcagaaccctttgttttaccatttgcttttaaatctggggggtacataaattcctgagaaaatactaagcatatacatcaaagaaattcagacaaatatatgtgaacagagcaggtcactgacactaatcttggccataacctagagttattcagaaaagatgtccagagacaaatcttggaggttttgaagaatcagaaagataagaggaaaatctggatacagaggtatcacagaagccaaggaaagtgttttaaaaaggaagacgaggtcaacagtgtcaggtgcagctaaaatattaagtataaagaggactgaaaaatatgtcttgaatttagagacttgaaggttattagtgaccttaacaagcattgtttttggggagttatgcagctagaagtcaaactggtaggttgaggaaggagtggaagctaaggcagttgagctgtgggtacggacacttccttcagattagctgtaaagacagtagtaatagaacagtggctgtaggaggataggggactgaggactaggaaataatttattttagatgggagatatttgaataggttcaaagcttattggaaggattcagctgaagacagaagtccggtaacaagagagaaaatataatagaatagataatgttaagttcccaagatccacaatgacccccaaacgtaagaatcatcttagaatagacttgggatacgaagttcaactgcaaaataccctatttttagacagcctccgaatttaggaaaccatgtccagcccagaggaaaaaagaagagggctgagttactattttctccatgtttgattctaaggaatgtagcattatttggatattacataaaaccttggaaaataagggaaggggcaggccgtgaagatatgtgcaattaaaattagaaactagacatggccagtaaattgattacaagttaatctagctttgccataacctgagagaggtgatgtagtcaggaagttaggttttatctcaggttggctttctaaatattgaaagctgtcaccaaagaaactagcatagaaccagtacgttacctgggggagagcacctagagccacagatgttggtgtgcctgagaaagtccagaattttaaaaataaaattagaatagctgtgaccggcagtaccctccagactcctcaattgcacacagctccctttgtgtccattttgaggactcagcaccaagacttctaagacatgaagcactgggcaatgctttggggacatgacaatgctaattatgctaaatactcatgatatgttgtctaatattgatattgataacctaagcaaagacttactttagctaagctgaccttgctgaattgcctgtgttagctgccaacaatgtcaacagagaggagagtaatggtcaaactggaggcagatagtgttatgatttatgaggggccatgaaggcagtgtttttgtccatgggagctgtgattagatgctgtgggtagctgaatacagttgagatttttcaaaaattggcaggcatgttactttggaagttctccagtgacacatcagagatttaattattacagttttgtattcttgctttctgtgacatctctcccctttgtgcttaatcaatgtttgtttcccagtatgtgtttgtcactattattaattttggaagatacaaggaaatccccaaatcagtaaatgccctctaggagtgattctctagtcttgtagttggacacaaacccacaacataacctcctttgtaggctcatgcaagaggaaaggaattcagcatagtgatggagtaggcccagttccaaggatgccactgggtatcctgtacatccagagaggaacagggcaacttcctgactcttttacgtcactttctgaaaggaaagggaacgtttcaaagtaggaccatgcacagatacctgaccacctatccctttttaaagtcccacctgtcaagtctctacaccagttgtattgcattacctgggtaaaggagtcaagtgggaaggggtggagggtagtcccaagctaatgagaccagcattcccctgggttattttatagtttatcttattaatcctagaagcttgactatgaggcctgtgttaggaggtttctccttggggaaagataatcttaccaacatctttgggctgttttcctaattcttaacactactcctgtatatttcaaactgggagctatgaaatagacaggtttgcctctcgagactttctatgaaagcttttttgatgttactcctgggagcttctcagtgggccaggaaagaggccccaaagccacactgtatactaggctaagtcaccacatgacgtatgtaagattcacagaggatcctcttgttcacctatgacgaggccagacacaggccctccaaactccctttctctgtctcataaatgattagctgaacgtttacccccctgtgatcaatctggacaaaatacttactaatttgatttgaccgctgtagtgaagcttgtctcctcctccacagcctgtaaactttgactcattcctgaagctaagcaagtgttggaactgggaacaacccctccttaatggcccttcctgagactctccattggctgcaaacaaatctttcttgttcagctgtcacatcatcccacgtgtgcatcccccatgcctagctccttctagccatgtttattcctcttcattaaaagagaagccctttcagcctgaccatctggatgtttatagatcttatggtcagagtcttttccctattgcaaaaatgatcctgtccatttggcgtattctttaaaagtaaagtctgtccttacctaagtctaggtttgtttttatttgacactactctctatattttggtatttaatactgtgtacattgaacacgatcttttcttgatgacctagcttcatctttaagactattatcacattgtgctgaagaggtagttgtcagtgaggccaattctgggtgggatattggctgacctggcactaatgctggagccaacttatttctgggatagagcagctacttttgttttatgcattttgagttacattaaactcatttggatagagtataatggtgacctttcacttggccagaagaaaaaaaactacactgtttattttcttatttttttttttttttttcactggggtctcactctgtcacccaggctggagagcagtgggtgcaacctcggctcactgcagcctctgcttcctgggctcaagcgatcctcccacctcagcctcttgagtagctgggaccaaaggcacgtgccaccatgcccagctgattttttgcatttttgatggagatggagtttcaccatactgacactgttttaaaaataatcctagaattcgtaactttctagcgtgtgtatgtataaattacaatctgttatgtttagaaattaacaagaatcaaataatgaagctaattttccaaaacgtgattgagctacaatgcaggcgtctgaccatcttatttttagcccccaaggcatgcaaatgttagaagaaaaagaatctttaaaattgcaattgatagtaaaattgcttaattatatgtataatatgtggaagaatatgtatatacagccatttatcaaaaaagaggtcaggaaagttgggtgcagtgtcacacacctgtggtcttagctacttgggaggctgaggtaggagaattgcttgagcccaggagtttgagtccagcctgagcaacatagtgagacactgtctcttaaaaaaacatggggagtagggtaaggaaagaaccaggtaaggatggaagaaaaccatccagccatgaggacttacagagcaatatgatagagaaattattctcatttcttaatataaataagaaaaatgagatttgaagatttgcaatttgcataaatttacctgacttgtaagtgccagaaccagagttagaactctgttattctattttctggtctatgactgtcatcaggacactgtgaagcctttcctttagtgagttccaggtaacacagaccagaaaacagtcctaattgtattcgttgttgttcatgtcactgtcagactctacaacttgttgcttccattactgatttcaataccaggggctgctatccactcttctcttcctccttttctaggaagccttactgttcaaatgtgtaaaaactcattcttgacttccagccaatcagccagagacatgaccttcatgcagaccatcatctctttgaggctgtgtctatttctgagtgcttggaggctgctgctttgctgacggggtagagatagaaagaaagggactgtttctctgtttctccctgttagaaatgcttgttgcccagtgccataaagaaatagcacttgaacataaatttaatttcctcagcaaggccattttttttactttctgcagaaagggtacactcaccagcagttttgccatgaaagtacaccaaacaaaagaggcagggtcatttataacctgatgcgtccaccctactgctgtgtcccgtttccattggctggaacgggacctcacattctgtatttgtcctgattggctagcaacttagaactttttaaaagaggcaaaggcagaggagaacaaaggaaggaggaagtaacttgtggaatgccgagaaaggtaaaaacaccttcaaataaggaagaggaacaggctaagacctaatgcttgcttggaccagtgtaagcatgccagggcaaatatttaggctaaattgtgggagctaagaacataaagtacattgatttctttattatggctagcagatatttaagaatgttagcacaggtctttgaataatttttgcttctaagagaagttactatttattcctaattagatggggaggaaagtctttgaagaggaacccctactttattttctatactccctcaccttcctaggtcgtctgaaggtttcctgaggttctggaaaacggaaagtatcctaaatacttaaatagtattatatgctaccaattaattgtccactctatcatctaaagatctcacgacaaacagtatatggaagtatatgtttcaccttattctgtaggtccaaattctcttttgagaattatgtggacttcagagctagtttgtttcatggaggtagctagtttgtttcattgacatgctgcatgcctcacttggtaaggctcaggcctcgtccagagcagggtatagcctttggtctagccaaccttgctggatgttgtaaagtattttagctattggattatgctttctataaatgtaaagatgtcacgggacctcaggtgtattcatgcaggctttgccatttatcctagctccaattagttaccgcaggtacagcaaaacaaatgtaaggcaccgcaccaacacgaggaattatcagtcttgttactaagaggacagaggaatccctaccatgtagggtaaatttctttctaggccctttaaatgtgaaatgtaataaggcaatttaaagatcatttcactaacatgtaaaggaaaatacaaacatgtgcacatctaattgcaggtcttacaattttggttctaaggaaaataattaacataagctcaaaatgacacttcctgcctgggaacagttctggcgaaataatgaacctgtagaaataaaattgaagagctaatcagccttgaacggcgctgaggtgtgtgtttctctctctctggttgctgttcatctcttgcttgtctctctgctttcccctatgcctttgatgagacacataatttttatgttgggcgacaaggtgacagttctctctgataattacatagatgagaatatatttggttttggaggaaaaaaatttactttacaaatgtatatatagaaataactttgaccttttggtaaagataaccaagttcttcctcagcaacagaaaaacaggcacattcggaggtgtgtgtttcattttatagtggtagctcctcctaataaaaacctttgtaaggaaaaggacaaagttgttggttcagggggctagcggtagaccccttctcctaacagctcaaagataaggtaaatcaaagtgccccccaagagttaaatgagagaaaacccacatgcagtggatagcattagccgtctgtggtgggaaaggaacagattgtcaatgaatgcatggttaaagagtttgagaacacccaaaactttaatcaaggtgatatgggagcaatctcatgaaagtagaatgggaggatggttgcatttagccattacaacctcatcagttgcattcccacaggaagactgcctggatattaagatgatgtcatcacagagctgggattctcacagtgtggtaagaagacctctagcatgagaatctcctgtaaaaatgcacatcctagggctttactgcatagacaccaaaaatatttggagtgggctcaaagaatctgcattttgtttatattcaactgaattttcttttttatagtttttttctaatttaaaaaaaagtaacacaatatgggctcattgtaaccaggaatgcaaatatgaggaaaggaaaagtaaatcttggttgatccttctttttctcttaccctgaggtagcaatactagtagcagttgttactagcaacaatactggtgagcatgagcatccttccatgccatttttcacacttacaaacatatatacatttttaagaggttttattttttgcttctcttgtttgtttttatatactaggtcatattataaaatttggagatttacttttctcaagtcataatgccaaacactccaggtattttaaaaatgtatgtacatctatatatgtattcacacacatttacacatatacatacaaacacccacatacatatgtgtgtcaggttgcttgaaaatgcagcttaaaacccatttagggctaaatactggcacagtagtccagtatcataaggaaaagttgaaaaaaactttgaagaatgacattcttttaaattctatagttttctatggaatggattattaagatattcaagcgtgtcccataggtgaacattcaggttgttttctattgttgctgcatgtgttttatttcattgccattacaaatgcctttattttggggatgatagatgagcagaaatgggatttccgagtcaaaggctatgttcattttaaattctattagtattataatatgactttcctaaaagcttgaggtaaattacagttgattatcatgattccacttagttatgtcctataaaatcaccttgagcactgaagtagcagacactgactcactgtgttaatgtattaatatgttgtatcaatatattaatattgaattaatatgttgtatcagtatattaatattgaattaatatgctgtatcagtatattaatattaaattaatatgttgtatcagtatattagttattaactctggaggaaatacagggttaggtttctgcaagctccttgtcacacatttttcaacccatcaatacataaccttgttttacatgtgtttctgtttaaatacatcttatttatttatttatttatttgagatggagtctctctctgtcaccaggctgtagtgcagtggcacgatcttagctcactgcaacctctacctcctggattcaagtgattctcctgtctcagcctcccaagtagctgggactacaggtgcacaccaccatgcccagctaatttttgtatttttagtagagatggggtttcacgatgttgtgcaggatgatcttgatctcttgacctcatgatccacccaccttggccttccaaagtgctgggattacaagcgtgagccactactcccagtcagcttatttattacatattattgataacctagcattgaactcatggccagcaatatgtcccatgcctgaacaatgcttatctaacacatggactttctctatcaggcactttacagactaaagtgcctttactaaagtctgtaaagtgcattatggagaaagtccatgtgttagataaggattcagccctgtgcagaaaatgtggcattaaattgaccaccaaaaggatactaatttacattatgagggtgaaacaagaaaggagaatgtcatcttgttctgcctggactgggaacatgcatgctgggtgaccacactgcacgtgaccatgaatgaccacaaatgatctccaaagtgccacaagtattggctttggggttacaaatacatttgagagtgtaggcaaatttgtgaatacagaatccacaaataataaggattgactgtatattcccaccagcaaagtgtttgtcatgttgattattcttcgtcttcactgtttcattttttaaaatatttgtgaaattttaggggaaaactatttcctcgttgccaactaactagtgaagttcagcctattttcttaatttattacacatttaaatgcaatctttgataacttacctgttattatattttgccctttttccaaccaagtgacttaatttttttctcatcaattcttagaaactgtatattagggatatcaatactttgttatatgttatgtaaatacttttttattctattgcttgtcttatttttgttttgggtatctttgctatatgttttaatactcaaatatatcaaccttcctcttgtgatttaaggtctcctgtcttattgtatctccaagactacatagaatttcacatttttattccaatatttttattgttacatattttgcattaaaatcttgactccatccagaatgtttttgtttctagtgttaggcaggggtctatgttcattttttttcttccagacgaacattcctcagttgttccaaataggaagagaggaaatcaacctctccatgtttgcagatagtacgattctctgcctggaaaaccccattgtctctgcccaaaagctccctgatctgatacacaacttcagcaaagtttcaggacacaaaatcagtgaacaaaaatcagtagcattcctatataacaacattcaagctaagagcaaaatcaagaatgcaatcccattcataatcgctacaaaaagaataaaatatctaggaatacagctaaccaaggaggtgaaagacctttacaatgagaattacagaacactgctaaaagaaatcagagatgacagcaaattgaaaaacattccacatgaattttttttttcccatctgaattgttcctggatctacattatccatgcctggtttccaggccctctcagagattctgtaaactacttatatcctttattgatccttttctacttagcctggataaagtagattatgattttgcaactaagagtagtaattggtgctggaaatatttgtacctaatggactgtcaagtaaatgggaacctggggttagctatttaacatagttgagtttgaaggcatgtggagcaaaacatttccgtaaatattggctttggttaattggagtgaagtgcctactgaaggcagcattttgggaaactcaagtggctgcttccgtatagtattttaagaaacgtggctgtactggctacatggaattgtgctaaaaatcttaaggaaagaaaaataaaacaggctcaaggttttaaattattgcctcaatgtagtctcagaaaacaagagaagttttgactggcctaaaagaatatcgtcttttatagcaacaaggttgatgaacttgaacatcaaacatatgctctgattctgtgacttattgaattacaggctgcattgaaagattggctgtgtttcttaagtgaaatttaggacattgggaagaaaagaatgggaccctgagaattagagtagagacatttgggaggattcagatgactcacactcccaacctccctaaatcctccttatcagcagcagcagcccttatcctctgaaggacacaaacctgtctgaagaccttagaaagaccttgcctagcttctaagaggatgccagttcctcatcactcactcctatcttattacctctacttatctatttgaagtcagatcccagtgtgtcccagagatttaatcataaagtcacaccttgggagaaatatatttcttctactactgccactgctattgcaattttttacataccaaaaaatcacaagattttgcaatttatgtctacaaaatttgcataaagttatccattgctcatcctaattttcttcctaactaaaagggacatctgtttttgcaatggctctagtagaatactacatttcccaagcttcctaatatctaggggtggccgtgggacctagtcaatgagacataagtttaattgtactgattattcctaaaaaaaagttttggtatcctaagaactgctcttccttcttctgcattcttccttactgcgtgggcttggtcacaatttctggaactatagaggtcatcttgcactcatcagggaaaggccagaagaattgctaggacttccaatctgacatttttaaacccctgaacaagtgacgacaatcacttttactttttttttctgtaattaatggaagggaaacaaacctaattgatacattcagccaaacacaatcatcagcagtgatgatgcaaaaatgtagcaaagacatagaaagcacctattttccccttgaaaaagtgaaaattcttgagtttcactgattttgctaatttagatcccataccaacactttattcaattagtttggccagagagtcgctgtgtgctagttggcttaggccagtagggccctccctgggagctggggtcaatcccattaaccccacttgtttgcagctccatgggaagaagtgctaagaagaaaaaaggagatgtttggatgtgaaataggtgagtaacatgtccacttcatccctattgtgaatatgtcattaaaatttactactcttattccactttcatggtcactgaacaatctgctggttggatttgacttctcatgtaatttataagagggatatgaactaatcaactaatactagcattgtgatctgattgctggtttagttaatacatttacatagacgattttatgaatcagcatctctgtctgagcttagttaatgtaagtactccacccccacctccaagagatctgctctgcctgtgatgacaagccaggtcttgagtctgtaaggatgttcagggccagatcccagaacagggaattctccaggtaaatggcatcctgcccactcactgcctggggaactgcctttgctgtactttttagcttctccttgaacccttgaaactgttgtagatgtcatgagtgttatttttcttcatgtaagatttcagcagtagcatgtgccctgtctccaggagtaccaaagataccatgcagggtgggacagagccagttcccatcttcctggagtcaacatgattctagaaccttcaccactatagattgtcatcacttcgattccatttaagagtgctgtggcagatgtaactagaatgataccaattgcagaaatgcagggtgagcttgcaaaacaaaaagtcattgattctgtaacccataggctaccaagtgtcatgcaaaacatctggggtatagttaacttgccaatatttattgagtacaataagatgtacatctgactaatagagatgttattagtaatactcaataggataaagagagttctggatgggaagatagaagctacactgctaagtgctaattttctttactatggatgcctccatgagcaaatcacttcaattgaacggccttcaagtttttcacctccaaaactgaatactgtactcacaatagttaaatatttcctgagcagttttatttatctcattaatttactttaaaaggcctttcttcgtatcacaaactccaactggattgtggtttctgagcaaattataacaaattttgtgtttgtggaatccaaattaatgagatttaactgcatgctaattaaaacgccttagaattctgcaaagactttcccttcaagagttcaaatttgttgatgaaattttctcgttagacttcacaatgagtgtggaaaacaaatgatcagtctgtaagccctaaaaaaagaaaaactttaagatattcttcccaggttttaataacacaacctggcagcaatggaacaacctcacaaacctggccttaaggttatcttgcaggttaactccctctcttaaagagattcttgtaatgatttaaaaccaaatggcgacgtagcattgaggttcaattagcggattccttagttgggtcttgatcacatctctgattgtcacctctaatagggcgtattaaaatttccattcattatagtcattagtctctgccagtgataaggttgtgaacaaatctgttggtgttcaacttctaatttgtgtgataatttgtttatgcttagaacacttactggttgtggatggagggggtgtgacccatttagaaactattcatgtagataaatctggaaagtttgcctggaatggctaaggcatggtgatgccacctagtctagtaatagacaagggccacttagaaggtcagatgagtcttattccagagtcaggaagagaagtggtttacccagagatgcaatggggttgcttcaaatgatccagaagggggtttttgcatggaaagaaaggttccattcggtcattgttactctacaaatggggagaaaagcacctgcatcagaatcatctgagaagcttattataaaggtaagctcttgggctacactccagacctctggggctagggccctggaatctgtgtggttagtaagcaccccagattacgcctaggcgtgctgaaattgagaaccactgcaggagacacctgagagcagagacacagaaacaaattaggtatagcaaagacatcaaaacattttgtagtaaagtattgagaaaccattcaacttgcatttatcattgggatttttgccgtcaacagctgaaatacaatatttaagaggaagaaaatttcaaatttgcaacaagccataagaaatggggcttggcaaagtgtcttactcctgtaatcccaacacgttgggaggccaaggtgggcagattgcttgagctcaggagttcaaaaccagcctgggcaacatggtgaaaccccatctctacaaaaaagtgcaaaaattagccaggtgtggtggcatgcacccagtctcagctactcaagaggttgaggtgggaggatggcttgagccctggagggagaggttctcgtgggcaagatggtgctgttgcactccagcctgggtgacacagccagaccctatctcaaaaaaaagaagaagaagaaaaagaaatggtttgggtgtgggtttttttttttatatactttagaggctttcaggttttttcttgctctgtgtggtcttattgagttatttgtgtttgagtttggtacataaaataattttagtacttcttattatatatacaagaatcatggatatgctcaactttatgtctcctatgcctgaaaagttgtgcaccaataactcataagtttttttaggacactgtacactttgtgaatctgatgaaaggcgtggaacttgattcccacaaatgtgtgtgcatcagtatataaagcattacatttaatctctggggacttagagatcagtgctctctctggactctacatcaagagcctctgacctgagcctaaaccacccagcctgctgcttcacaaagtcaagtagctccacctatgactcagccatagcaagcagggaaaggccatggtttgtgtgggaaaaatggatgaaagcaaaactgaggaattcagcagtcctcgaggcctcgactcacacctttaaatctgttggaattgccacaaaaatatttgttttcctacaagaatattagagatttacccatcttgagtggcaagcctagatgccccattcactcatcaaggcctgatgccatatttagcaaaagagccataactgaaggtgcgtttgatgaatttaataggattatgtcttactaatgacattaggctcctgggtcgggcttagcctttatatttacgttttatcactgcaaatgaagatgatattctctggcatatgagttttgcaacctcagggttagtcttgtgatatgtgaagtggcccttggcttgttttgggcccattataaattagatttttaaaaaaacattcactgtgtttattttttattttatttttgagacagggcctcatgctgtcacccaggcaagagtgcagtgatgcaatcacagccctctgcagactcaacttccctgggctcaggtgatcctcctacctcagcctcctgggtaactggggctacaggcatgcatcaccatgcctggctaatttttttggtattaattttgtagaaatgggttttcatcatgttgcccaggctggtcttgaactcctgggctcaagtgatctgcctgcctcagactcctaaagtgtcaggattacaggcatgagccaccacgcccagccaaaaaccattcgctttaggaaaaagaaaaatcaaacttcctataataccaccaccaaagatacctaacgttaataatatagcatgtattcctctagcaaaaattctatgctttttgcaaaaatagggtcatactatatttagtgtaatcaaatctggcttcttcacttatatcttaaatatctatttcaataagttccatctatcatgttcactggctgctaatattctccaatatttatgtatactttaagggtcaactaatagatgcttcagctcattccataaatgagatttttctaacatctttctatgcttatagccattaacatttgggatttttgctgctgttatggttaattttggagtctctgaagaaacaggtgctttgtagcatccagttttcttgcttaaaaggaaattcctcagagtttaagggtgtttagatgtaattttcacttttcactttgttctggaaaactaagaataaataaaaatccaaatctatagcccatgtccacccactcctttgaaagtaatcaacctcagtctctgaaatttcaaaggaaaaaactgaaaataccactgaaatcatttttaattagacatttagcagttcctaaagcaagttataatttggccttcaaaagcagtatttttaaagaagggagcattttaattggtatgttctggcttagcatattttctcagacattaaaattttaaaatctagatgtcatatcaaagtatatgagatgaaaaatatgatttcttctatctaactagctaaactgtggcacataactggacgtgtctatatggatggatctctgggagaaaagaaaaacttttctattagctatggcttgatatatctgggggcccagagctgccaattttatatcatgcatatgctgtgtagtatctcctactcaaagtgtggtccacggaccagtggcatcaatatcaactgggaacttgtcagataaatagaaccatgaatcccagcccacatatcctgaatcggaatcttcattttaacaagatccccgggtgattcttatacactttattgattgattgcttgattgattgagacagagtcatgctgtgtagcccaggctggagtgcagtggcgcaatcttggctcactgcaacctccacctcctgggttcaagcgattctcctgcctcagcctccaggcgcattccaccatgcctggctaattttttgtatttttagtagagatggctttttgccatgttatccaggctggtcttgaactcctggtgtcaagtaatccgcccaccttgacctcccaaagtggaggcattacaggcgtgagccactgtacccatgcatgctgttgaggacaccaaacaaatcaaaccaaccagatatatacacaacattcatctacttctctccactagatatacgacatttctttcaaagaacttgattcttgcaggtgtttgtaaagtgatttaaaatatgaagatgttgtatgtgcattaatataggaatgtgtgtgttcaatcaaatggacataaagagttacatatagtgaaacttctcactttattttgataataggagatttggtgagcaccttcattccttcttttcattttaatattgcatactgtgcagttttttaaaatttgttttagacacaagatctcaccgtgttgcccaggctggacttgaactactgggctccagcaatcctctcccctcaacctcctgagtagctgggactccaggcaagcaccactgcatggggcttggaacattttcttaatctggagacatctaaattaagactacaatattaaaatgatgaaaaaattgaataaagatgttcaccaaaacccctagtgttttgggcaataatgattttaaggctttgaggccccttcccaatgccagtcattctacaaattgttcataagcacaagcaaaatcgtaagttgtaatttggccttcaaatacagtatttttaaagaagggagcattttagttggtatgttcttgtttagcatattttattagatgttaaagttttagaatctagatgtcatattaaagtatatgagataaagaatatgacttcttccgtttaactagctaaactgtggcatataactggatgtgtctgtatagagggacctctgggagaaaagaaaaacttctattagctgtggcttggtatgtttgggggtcccagagcaagccagatacttgactggggaggggggaagagcaatttatgtgccagtaattacaattataaacacatgaatgtcctgggattggagaacctgttctgtatgagggtaccaggagatcttaacagtggaagaacatttaaactgaatcttgatgaataagtaggattccccaaggggaaccaggaggaaccagcacctcaggtaactggaagaatgaatatgaaaatacaaaagtaggccaggcacggtggctgacacctgtaatcccagcactttgggaggccgaggtgggtagataacttgaggccaggagttcgagatctgcctagccaacatggtgaaaccccgtatccactaaaaatacaaaaaaattagccctgcattgtggcgggcgcctgtagtcctagctacttgggaggctgaggcaggagaattccttgaacccaggaggtggaggttgcagtgagtcgagattgcaccactgcactccagcctgagcaacagagcgagactctgtctcaaaaaataataataataaaataaaaataaaaatacagaagtaggttaccatgttaacaaatacgttcatcatcttgttagtagggacccattggagggttttaatcaaggaatgccattagatttgtatttgagaaagataattctggtggttcagtagaaatagagcaaggtgaggtcagaggcagggaaatcaactaggaagccgctgcaaccatctgagtgacagaagatgaacttgaatcgaacattgaatgtagcaatagtagtgtgggactaagttcagagacatgctggaagtggagcaggcaggttagggactgagcaaagaggtagcgtggggagactagaaagacaagaaacactttgaagattctagttcggggctgggcacggtggctcacgcctgtaatcccagcactttgggaggccaaggcagccagatcacctgaggtcaggagttcaagaccagcctggccagctgaccaagatggtaaaactccgtctctactaaaaatataaaaatttagccgggcaaggcggcaggtgcctgtaatcccagctactcgggaggctgaggcagaagaatcgcttgaacctgggaagcggaggttgcagtgagctgagattgtgccactgcactctagcctgggcaacaagagtgaaactccttgtttctgtcttcccttccttgtgaaatcattgtagatacatttgggaaaacaacacaaagagattccactgtcccccaatagtaacgtcttgcaaatctatagtaaaataaacccttctaaaaattgtatgatttatgagcaattttaaattaaaatatcagtatactctcatgctgatttctaactagtcatttctctgacctcccacccctcccctcaccccttggcccctaccaccctcccacacacatacctaatggctctccagaccaggtcctgtccccatgctcccctgatcaagcagatcttgaaccttgtggggaaaatcacgtctctggtggtcactggatgcctggtgtccatcctgaccctctaaagctagggcttcccattgtgggctggtactccctacatgtaccctccatgtcctcttgtagggaccccagcttcagcagtgctctttaccatgttgttaaatatatggcaggttggggtttgattctggccacagctctccccagataactgacagagtcatttagggcctttgtcccacatttctgggaaatttgtttctataatagttaggactttggtatgctagtgacagatgcacagatcaaattaacttaagaaacataaatgtactggcttactgagttgggaagtccagggataaagctcccttcggagattctgggactcaaacaatatgatcaagattctctctcccttgcacttttgctgatttgttgacctcatgctcttcatggtgtggtttatatggccattggcagatctggagatacatccttatatctcagagtgacacatgaggcataagactcgcttctccaccatcactgcaaaaccctactggagaagggctctgtttggcctcatttacatcctgtgccaatcctgtgggccaatcacttgtgcagggcgatgtagtgtattttggatgaatcaaccaatgactcagcctgagctccttatcatctgatagacttggaattggggtatcaaattgtctggcttagtagaaccagatggaaagggaagaaagagtttttcaaaggaggagatattgacgggatgggctaggcagaacagctaatgtccattttagttattcctggatctagcgtcttctcctgtggtgaggagagaggaatgtcacatggcacctatggttgtctcttgggagttatggtcagtgttgacagaagaaggcaaggatggctgtaagcaccaagatgtttatatgtatgaggttggaatttagaggtgttcagaactaatagccttaattgtctttgtgaaattgaaaacaaaagcacttgtgaaaagacaggaaggcagggtggggagcttaaaaagctagttgagggtttgaaggatgagagagagatcacaaggacagtgtagaggactgctaagagatattgaggatccaactaagattggaaactgtagcactcaggattctccagagacacagtaggatggatatatatgcgtacgtacacacacacagaaatttatttcaaggaattggcttatgcaactgtgggggttgcacatctgaaatctctaggacaggactgcaggctggaaactctcaggcaggagctgatgctgcagtctcgaggcaggatttcttcttcctcggggaaacctcaattttgcttttaaggccttccaggtgaagagatgaggcccacctgcatgatcaagggttatctcctttactgacagtcagctgattgtagctgctaaccacatcaatcaaatacttccacagcaacacctaaattagtgtttggtgggataactgggtaccgtagccttgccaagttaacacatacattggagtgtcacagaggcctaaactctgtgagccagtctgcatgacactagatgatctatttttcctcttcagttccacagagataaatacctagcaaatagaagccaagagagtggattgttaaactgattgatgattggaggaatcttcaggctggggtcactggagtctcaaggggagatcttgacgttgctgtcgagagaatggtggacaaagtccctcagggttgtggctggactgagaagttagttccccaagcgtaaagtgacaagagcatcaaccccaccagttaaaatgaataatgcatgaataatacttatgttgggcactgaactaagtatcacattaattttaaattattatcattgttacgatttcatttaattgtcaaggaactgacactacataaagtcagagtggatttagtgggagtaagagggtgagctaaatgtggtatattggagtttatttatttactcaaccaccagttatttaataagcattgattatgagccaggaactgttttaggtgctagagatacagtggcaaacagaacagacaaagtctctgccttcatggggcttaattctgttggtgggaggaggtatctgctaataagcagacaacttcagcaagcaacactagccccaggtccagtggtaagcgtgttatgaagaatagtaaagccaagttaggcaatagagagtgatggggccagacagggctggggtaggatgctagacttataagagaaaccctttcggataaagtgacatttaaacaggaccccgaaggcatgaagggagagcgtgggctatgaatatatagggaagagcgtgttcgagagaaagaacatggtgtgtgcaaaggtgctcagaggctggaggctgcttctccctgtaagtgaggaggagaggggtgggggatgaactgggataggttgcaacaaggagccatgttgggtgtggtgggtcattataagttctctggagttcatgctgagtgaggtggcaagacagtggagagttttgaacacagaagtgacaaggttcttctctaagggccgttttggaggccgtatgaggctgtatgaagggatactgggaggacaaggatagaagaaggagaccagtgggaaactgttaccgtaatccaggcaagaagaatttgtggtctgaaagccatgctaggtatgagcatgaccaggaccatgccacgggtatgcattgctgaagcagcctgccagcgaagaccaagatggcccaggaccctagagcagcatgtctggaggggtctgctgtgttgacatggaacttcttcaagatggagacaggatgggtgggcatggggagaagaactctgacccagattctgaagtcctccaggagagggaagatggtggaggaaagcagcaacggggtagaaagaggagcattagctgcatgcaggcaggtgcttgaggctcctgcctctgggtctttgcatgcacttctttcttttctgaaacattctcttcctaatatccacgtaactcagtctcttccttcccacctcagatctttatttaaatagattggaagactgctgtcaggacatagtttatgtaagaatgaagataactctcttgcctccatccttatgtcacctggcatggggtggcatgagcagccactgcctggaaggtctacttggaagtggtgtcctcaatggagaggcggatctggcttgaggctgggaggtgaggggactctcctgtgaaaggggtaggaatgctggggaccttattgaccatgggctaggggtttcagcaggcactgtggggagtgtctttagggaagtcaggaaaggagggtagaatcaatggggatgaagtaatgagaggaccagagggaacaggtgctgggatgggagctgaggatgccagaacatgggattgactgccctgggagggcctggcaagcctgaggctggcgtgcatgcagcctgtacgcttcctggggcaccaagcagagcatgggtggccacaggagacgtaagggagcgttgtctgaggggatgtgaggaatgaccaggtgctacccacctacagagctctcaggatgcttaactcctgaagaagctgtagcctggaatggcttgtagacctgaatgtataccaggtgtaactggcagagagggagcaggccccagaaggtccttgttcatcctagtcaggtccttcatcctgtcccacttcagggcccaaagtgctctgattctaatgccagcctctttggccttgcatttgtagagaagcgagttccctatcattggaggtatctaagcaatgaagtggacagccacttagaaggagtgtgcaggatggaggcttgggtatttcttgggggctggactcgaagacctttattttccacttggcctggagcgtctgtgagtccttgtcaaatactgcctggcacttacctccatcgggacacagtgcaggcatggctcaagtgggtaaattgtttatggaatgcaaacctcgtgggacttatagatggcttatcaatgtggaaactgtattaaaaataagttgagatcagcaccttccacagcctctgcatatgaaatgtcacttacatttaaacccacatcaaaggttctgggttgattctttgtatacttgttagtagtccaatgcttaggacaccattttcaggtagctgttttttagtgtgtgtttggcagggctggttctatacaaacgttcacagtgagcagagggacagcatgatgtctcctgccatggtttcacaattagctagaagagagagggttgcaggctcactgggccagaccggacgctagaggctgtattcagtaggtggggcagtggcatggacctctctgcccatgatgtggacatcctggcagatgggctgtttcgagagcaagccatggcttcaagaccttggctgtttgtggtgatggggtgaaggaccgaatagttagagttcgtactgagtgtctgtggtgcagggagattctaatcacatcatttgggggtagcggctgtgcttagcactggttaagggaacgaacgggcatagttgtgctatgcttgtgagtatgctcacttcctggagatggggagagtcaaattcttagagtgttgtgtggcttatatattttattaagcacctgtgttctaagtccgataagcactttgcgtacactgcctttaattttccgaatcattccgttttgcttgttgaggaaggcaagcagttaagacaggctcatctcttgacatgaccccacatagtgactgtacctcagaggggtaaccattttctgagagctgggtcccaactgtgttagggtcaaaattctgatttgcataaccagaggtgaatgaagacctgggaaactgacacatactatcttgactcataagagactgatgtataaaaacagaaatgatgccagctgcttattttgtgagaagaaaaaaaaaacaattctgtgaaccagatacatatgttctctcatcagtgcattcaatatgaaggcaaatttatatgaggacataaattaagatcagaaggttgcttatcagcatgaaacagtgtaggctgagtgaggataggacaccttactgacagggttacagagctgtgatcgtcttggctccagtgccaccctgcctgctgtagggctggatggtaaggttacctcacagtgacagggacaccaccaccagtcccagccgctctcagtctctgcttgcagtgcctctaacactgatcatcatcagcccattgggctgattcatcctttctttagacattttcctcatggaccctcagtaagttgtcatcttcctttgagagcaagttttctctttgtggtatctttgcatctcaccactttatttcgttatttttgttttgtggctataagctctacagagaagttgtattgttccatttccaaatttgtgggaaaggggaagaaaagaggagaggcaccatattgtcagcctgatttcccacctcagagacgatattcttgtcctcgttttacaattgagtcaactagatggcatggctttttttcctagctcccattgccatctgacgtggtatttatttagttgtttgtttattgtctatttctcctgttagaatgtaaacttggggacagcaggtctttgccatattcttggcatctggaacggtaagtggcctgaggtaggtgtgggcaggtaggagtatgcgtggattgaagaaggatgaggcaggccctcaatcccagtctctcccacaccccaccttcagtttggtgaggtgacagaagggaggaaaatatgagaagatctgagccaaaatgaaaatcagacaaaaactcagggcatgttctgggggtccttgtgtccctacatcgtcttaaagaaccagcctgggacagtggggactggagctggtgacacacaaggacccaagaatatggaaggcctttctctggcataattgaaataaactttaatgaacaatttgtcctgttttaaatatctttatagataatatctggagctggacaaatcatgtataatctacttcctttatcattcttatttcaattatatccatctacaatgtctcagccaaagggaacaccatttacctggtagcagccacctgaattttaggcattgatatctaagagaaaataagttgctcaatggttgctcctttgtaacgccaaacctaggacttgactatatggttctgatacagtccaacaatgtgctagttgataacagcttgtagatggatatatatgtattctgcatattttgtttggtgaataacccacagcattctaactcaggtgtccagtactgcttatcaaataaggctttaacatagaaatacataaattctagaaattgtcttgcatttattgtattagaaagtgaaattggtttctttaaatctttgtaagggctattaacataatatcttgttccaaatcaaatagagctacttactactaaagacttttgtactttcttcaataattaaagcaagcaagatttgtagacaatgcaattttcatgatgcattgaaaaatgtattcttacagcagctgtgtttatcacacactttcattttcttaatatcttaaaattgcttggcaaaatgaaagggaaggagggtggtcagggatgtttccaacattctattaggatcattttcacacaaacagaaaatctgaagtaattgttcagtgggtcccctgcacccatcacgtacattttacaattaatgttttcctctgtttgcttcatcactggctatccatgtattcatccctctcttcatcttatttttggtgtattttaaattaaattgcagaaatcagtacacttcaccactaaacagttcagcatgcttattattaactcgagttaaatatttaatatatatttcaggtaaaatgtgcgcacagcaacataagcacattttaagctttccattcattgagttttgacaaatgcatacacctgtgtaatgccaatcccaagccaaggtacagacattctttttttttctccaatttaaaactttaattaaaaagtaaactttaatgtcgaaaatgcaaacttggggaaggcagaaagatcacacacaaggctgtcacttcacacttggaaggttgcacagcggccgggcagaggcgctcctcacatcccagacggtggaggggccgggcagaggccctcatcacttcccacacggtgagggggccgggcagaggtgctcctcacttcccagacagggctgcggccagagagaggcactcctcacttcccagatggcagggggcgctgagcagaggtgctcctaacttcccacacgcggtggcagctgcgcagaggcgcttctcacctcccagatgggcggcggccgggcaaaggtgctcctgcttcccagacggggcggcggcattcttaccacccagaatggtgatgctagtgcctctttccagtcgatttccaccctacgtgcacgcagagggaacccatgttctgatttttttctcagcatggattactttagtctttcctagaactgtatacagttctagaatcatatagtatgtactatttgggataagtacatgcaatacatactactttgcatgagactttttcacgcagcacatttttgaaattcatctatttttgtttgcatatgtcagtaatctgtacccattttagtgctgaatcatattccattgtgtgaatatgccacaatttttaaatctatttacttatcgatggtcacctgcgctgtttccagtttgcagctattatgaagaaaattgctgtgcatgttcttatgcaagtctttttgtaggcataagctttctgattacttttgaaactcctggaatatgtagtcttagcacagagtctacacacagtaggtactcaatgaatgtatatattgccctggcacaaaacccacatgacatgttgggttttacagtacaccagacgttttcttcctcatctgttctcagatgagcttcgtaactacctgctgaagaggcagaggcaatccacacaatggaagctgagacattacataatcgctaattgttggagctaaactagaaccctggtttcctaactcctagtcctgtactctctgactgcttgctattgagacgggagagttcccttgacccctttgcaggacttgtgaaaggggtgtggcccacttatttgactgccaccatgctcaaaccccctgcctgagagggagcatgcaggtgagcaggtacaggagctgggggaatgtggcaagaatgaaccccgtactggtactggtcaacggcagcatccagggttgtctgcgacctctggagccctcgagggcatgtgttacaacgctcatagcagttactatctgcagatagctaagtgttaaccagctcagtggcaagtcagggtgacaggcctttacaccctgccctctgggtacctggcttcctgtctggtgtccaggaagaatcaggtcacataggcttgaaggatggttcaaaatatggagattttattaagcagtgggagtggctctcagtggaaagggagctggaaaggggatggtgcgggaagaaggtgctctatctctgaagcttggccgtctctgaggaggctcttctccaaagttgttctctttgaagttaagccgcatctgtttatagtttcggacactcagttgcttctccttttcacgttcagctgcttgtctctctgccagctaaggtctgaggtttatgtgggcacaggagagggggagcgggtaggccaaaaaggtaacatttgggtgggaaaacagggataactcttctcatttagggctgtggtttccaggcttgagggtggggcctttgccaggaaactgccctcttctacccagtacttccctgtctcctgtctgtatcgctatgtcagtgccaaaccgaaggtatgtgtactttacatcctcccttccccccaagcattgctctgtgccacagttacggtctttgagagttttgggtttgtactttggctctatttaagctcctggtcatcagaacttatgtatattttccccttttatatcatcttgttttctcagtgtgtatatattgaggtgaggggaggggcagcagggagggcctgtagagggagttattgaaaagtgacctaagccaatctggtacttttgattggcaatcagagaagtcagccatgaggttcctgagtctctctttctctgccactcccagctgctctgggatcatgaaaaccagcctccaacctgattctgcaacacatgaaaacttttattaacaaggagattcatataccatgcctaaaacactcatacaacctgttctgtaaactcaagttgtcccccatccgtggtttaggcagcccggttgttaccagtggaaggtgtccgagttactggcagcaattccatatggatctgcagcaacttcaattcttgcctcctcagaagaaagaattcaatggaggggcataaagcagaaaaagagactgaagttaagtttcagagcaggagtgaaagtttatttaaaaaggctttagaacagtaaagaaaggaaaattcacttggaagagacccaagtgagcacctgaaggtcaagagccccgtttaacggtgatgctaggactttctaggattcccatgattcctcccttagggtgagctgcctgcatgcacagtgccctccttacctttgggaattgtgcacacacagtgtgtttaggaagttgtatgcatgcccatctgtggctttcttcccttttctggtggtgtgcccctggaagtcatactttgccattttgtctcttaatgcacctgcccaggaagttgcttctccctggagcctgcgtttgattaacactttaatgttaacagatgtgcctcatcaggagattgtctctccctggtgcccttggactggctgctgaattatcatttttagagaggcagtgtgataattgtcagaccatcacctgacattcctagtgggtgggggagaagagccttctcctgccccgctcatgcctgtctaactacctgtaacacagtgagcacctctcttgacaccagtaatctgatagcaggatcaggaagctgcttcttgaggacagagtctttccggaagcagtaggacagtggtgtgaaggaagttctgggcctcagccctcctctgaaagtgtttgctaggctggctaagcccagcacccttttcatggaaattttgaggtttctagccatccctcaaatctctcatagccttcatttgaccattgaaaataatttctaatatccctttatgctaattaatgaactatctgttgcagattcagatgggagagttagaagcttttatgaggccacctctgggaatataaacaccatttgggatctttcaaatgctcactaacaccactgtcttggtacttcctgcttagggtgcttcatatattaactagtaactgttgagggtgtcctaacatgaatctacacacacacacacgcttaaagctcactatggatggcggagtgtttcaacataaaacccaggtcacattggggaggtactagagtccatgtgtccttcccctaacccccaccctctaacggtggcatttccaccagactcttgagttttcagtttgagggaatcctttgaataaatatgattttctgcctccacacttaatgtggttagagctgcagccttgatcctaatctgtctgatctcccatcctcattgatagtaaaccagtgagtaggcaagtcaactgtgagttaatcggggtgggggggatttttaaatgcaagtctgatgtttaaatgtagctctgattatgcctcttggctatcagaagtgagtttcatttggatggagagccattttactgagggcacacagcacagaagctgagctgcagtgtaaagctttcaagtgactcttggagctattaaagtgccactcatttggtaactgttgctgttaattaagtttgtagccccattattaattcttggctctactattattaattatgcttctataaatttatagtaggcagtacctcagggaatttttcaagttgtatattaaaattagagataaataaacacttaagcttccttctcaatataagaagagtttggggtttttatttccggtactaggtaaatttgaaaggtatgtgatggtcattttctctccttactgaaacattttctacatggtttgcagcagaaatttctgtaacatatttaacaatgcggtttagtatttaaatatttaacccattcactgataacttgtagctaattcctacaattaaacttacgcctttggccaggcgcggtggctcacccctgtaatcccatcactttgggaggccgaggcaggtggatcacgaggtcaggagattgagaccatcttggccaacatggtgaaaccgtgtctctaccaaagattcaaaaattagctgggcatggtggcatgcacctgtaatcccagatactcgggagactgaggcaggagaattgcttgaaccagggagtcagaggctgcagtgagctgagatcatgccactgcattccagcctggtgacagagcgagactctgtctcaaaaaaaaaaaaaaaacaaaacttatgccttttatgagagcaagcagacagagaaggaaaagaaaaaaagcctggcattttgtgtataaaaaatcagagctcaagtaatgttggtcaaatatagatgcaaacaagtccatgtgcatattaacaacccctttcaccatgtgctttatttctgaaaatactttaaatccttttctgtcttctgatccagctctccagacaatagttaataaatgggttcataggtaattatgatgcattttggttcttttacctacagcaaattcctttttttctctctctcttattctaagaaggaacaaaaattgcccataattctccaggttatagaaaacgtctattggcattttgatgtagttcctttcagatgcttttccaagcatatatcaaataatttagatcacacaatgttatggtttgattttaccccttaacatttgatgtagcaattctttattattggacatttaagttgtttataatttttgtccttgcaaataatagatatatgatatgttggatagctctttaaataaatatttgagagtacctctaattatctattttaatgcctagaaatataaattttttgcctaaaggcatgaacattgttcaagttcttgatacatactgaaaaattgctttccaggaaatgacgccaatttccagtccactagaaacattccacggtgtctgtcttactgcggccatgccatttaatatagctaatacaattataataatattaacttgctaactttataatttttgaattcggaaacttgaatgagatatgctggaacatcaaatagtgacctattttatctcaacgcttcattttgctttttggagccaaaagagttctttctctctcaaattggattcagtagttgaggggctacacattaactgacagtagccatattaacaagagaaaagacaatatttatttacccatgcatgggagagctgctcagtaatgagtaacccaccgactagccagagataagggtttatataccaacttaacaaaggtgaagggggcaattagggattcagggggaaggcatgaaggtgctcttgggcttttcagtgataatgggaataggaaatatgtcttcatggcagctgaattaggaggaaactgcctttgaggggagttaatggcagctgtatttttgggaggctctgctatagtcagataagggaagttcagataagacttctttctgcatctcctgcagctcaaatgttttcaccttaaaataacctttataaagactctgagggtccaagtgcatccccatactttctatttattttaacatcacaaataaatgtgctcaataatagataaatttttcatcatgaaatgtattgaatattagtaataatggtgttttctgccgtttttgacaggtaaattaccagtaagggatgacacaggaggagaaaaggagaaaatgaagaactgtcataaggataatttttattacagatatgaatatatttgtttggaactaacaactatttttagaagacaaattaggcagaagtggtcactactgtatggacaagggtgaatagtagttgtgattttcaaaaattttttaaacatatctcttgatacagtatttttccaacttcatttcttttctttttttttttttttttttttttttttgagatggagtctcgctctgtcatccaggctggagtgcagtggtgcaatctcggctcactgtaacctctgcctcctgggttcaagcagttctcctgcctcagcttcctaagtagctgggattacaggcgcgcgccaccacacctggctttttgtgtgtgtgtttttaatagagtcagggtttcaccacgtgggtcaggctggtctcaaacttctgacctgacgatccacccgcctcggcctcccaaagtgctgggattataggcgtgagccactgcacccggccttccaacttcatttctttcaagtcacagtcatggaacatgtttacaacttctgagttacactattttggataaatagtcataaatatcagaaattgaaaattagattaattcctccttattttgatattcacctaggaaatagtttttctacagatattattctggcaaatctcagtttcttgaatctcagttccttgaatcttgacttttgtcgccacccttgatttgaacatcccttggcagctttgtggataatacagtgtgagagacataattgaaaagcatgacaagtgagaaaatgggttacatacctcaaaacaaaggctcattatacatgacaatgcaattcatttgggtctctccattgcatatttgctacaggtattgattgccttccaactcttcccacagccttttgctagtcttaaaggcataaatcacttggtgaaaggatatttctatttcagccagataaactctttcctttttgtttagatttaatatgaaggcaaaatgcactgctctcagtgaacagccttgtttcctttcgtttaatggggaagggaacactgaaacatttcctacattctctaggaaaagcaccttttttttttttcttgtctttataaccctgtatctgttgtcactgattcagctattcagtctgggacaaagcgacttttaagttctagagctatgaggaagctataaagggaatacagttcactctgtagagaaataacagcctgggagatcatggaccagaaatgttactctccaaaggtttgctagagctttactttgaattctattcatcaatatttttgttggcctggatcagtgactctaattatgtatagaagatagaaacagcagttatatttagcaagctggaaaagtccctgcagtctaccctcagaacagctaaacatacggagtcaacctgagattctgaatgctctgttcactccctgagagataatgatgactgaagagtgatagcgcagggaacagagtaaagctagaatgggaggcaaggaaagttatcagtcagacctctaggagaagtcccagcccctgccccatgcttttgttttttatttgtctaactttttttttttttttttggagattttccatttcaggcttttgttgcttttctcaaatgtcaaccctacctacctctctctgaacgaacagcccacactttctacttcatcaagaaaattgctaccacagggatgatatcatagcccattactgtatgatgctatctataccttagcctgggcttccaccatttctttgtctcccaaggagaagggacgtgactgcaccggatcttagtgtcatcttttctgcctcccattggggactgtgaagttattccaaggacagttgttccccctaccatagctgctagctccttccctcgtgccaggagccacttagtcacagggtaactgaagagaaaaaagaacgagacctattgctgagcctagagcaagctcccccatacctgcaccccacatgtgtaccaaaagcttgctttctctcccattcccaggtctttgatggggacgaagctaagaccatgtatgccattggccccaggcaataagaggtgcattgtctgcaaaagtcttaaaacaatattaaaatcaactaaaaattggtctttttttttttttgagacaagagtctcactctattgcctaggctggagtgcaatggcacgatctcagctcacagcagcctgcacctcctgggttcgagtgattctcctgcctcagccttctgagtagctgggattacaggcacccaccaccacaccccactaatttttgtatttttactagagatagggtatcaccatgttggccaggctagtcttgtttttattatcaccatgttccagcaattctaaacgatatcagcgttggggaggaaaaacatctcttctttctacctgtcttaagttcattggctggggcccctataacaaaagacagagtaacaagagaaaagcacacacgtttgttgaatgccagttttatgtggcatgggaatcttcacagggaaatgactttgctgagaccagctcagtgggggagaccctaacccagcggtactagaggaattaaagatatacacacagaaatatagaggtgtgaagtgggaaatcaggggtctcacagccttcagagctgagagccccaaacagagatttacccatgtatttatttacagcaatccagtcattagcattatttctatagatgttaaattaactgaaagtatcccttaagggaaaggaagggatgggccaaattaattgcagcaggatcacgcccttaagacacagattgctcatgcttttgtttgtggcttgagaatgcctttaagcagttttcctccctgggcgggccaggtgttccttgccctcattcctgtaaacccacaaccttccagcttgggcgttatccttccagcttgggcgttatggtcattatggacatgttacattgctgcagagattttatttatggccagttttggggccagtttatggccagagtttgggggggcttgctcccaacagacttgaagaagcagttaaactgggagtttttatgctagcttgagtgaagagtggagagtcatggagaaatgtgttaggacagaaaaagtatgagccgaggatagtcaactgggagaaacaacaaggtctgtatgttcacattcctcttgacatccctgtgtctttggagagaaagatgttattttcctccaggcatagggagggtacctttcacatgatctgcctcagggaaggatcagacaatctttgctatacatgctgttttccaaattccttcaacctaaaatattcagtattccaagtcaccatattttggggtagtatgtcttgaaccttatcatcagtgatgtaatattcctccccagaaaatccttttgttggtaagttacaaacaattgctataacgattgttgacccactggcttcctacaggcaacccagctatactcagctgagtgtcaattcataagggttggaatcatttgagtttgctgcctgcacagtttgtgtctctaagccctgtgatactacctagtcctacgtttaaaaagtaggttcaaaataaacaatggtaatacaacaattctaagggtaaagtgacagagcttgccttattgcacttttgtgtgcagatctttctctaaccttgtagcatttattcctttggacgtgtttcttttatgctctccttctcccttaaaataaatacttaaatgtaattaaaaattattaatccattactttgtttccttttttgtactgtgatagttttctaactgacttgaatgtacatacaaaatttaataaaagactatgttttatgtttgccattattttttggcttttattactattattttaagaatattattgaaggcttggcgcagtggctcatgcctgtaatcccagcactttgagaggccgaggtgggcagaccacccgaggtcaggagttcaaggtcggcctggccaacctggcaaaaccccatctctactaaaaatacaaaacttagctgggcatggtggcgtctgtagtcccagctacttgggaggctgagacaagagaatcgcttgaacctgagaggtggagcttgcagtgagctgagatcatgccactgcactccagcctaggtgacagagcaagactccatctcaaaaaaaaaaaaaaaaaattattgaagacaattttgttgtgtagaggaggagggtcttaaatgatcctctctggctgtcagatatgctggggactccctgtgttcctgcacacctgcccaggctctctcctctccttcctccctcattcctgcacctagaatgttttcaaaagttattctaaaagcctaaaataacttccgtgaagacttgctgtgataattccagctctttctttcttctctgaattcttctaacacattgtagttttccatacaatgtagcaagtgatggtatgccagcttagactttttctaatactttttttcccaagatagaatgtaagctccctgaaagttggggttagccttatatttcttcttttgtgtctccccaaagacaacttttggaagtatcccattaaaatgtatactctgtagaaaccagctcaaatccttcaaaaacagctcttctactcctgcaaacttcattatcctctcataactttatgtgatcatttaaaatcaggtttttctaaaacttcggtctgagtgaccaaatgcaattgcttatcttcaaggaaatagtgcttgctttaggcattcactccagaggcacacaaggagagataggtgaaatcaacatgagcagttaatttctggtttcacccgtaaaatactgatttctgtggtttgaatgtgtccctcgaagttcatgtgttgaaaatgtaattccaatgcaatagcattgggaggtgggatcttcaaagagtaatttggtcaagagggctctgtcctcataaatggattaatgccattatcttgggagtgggttagttatcgagagagtgggttgctaatgaaaaggatgagtttgttccattttcctgttgctctcttgtggactgtcttattcttctgcctttcactgtgggataacacaacataaagaccctcaccagatgccagcccctcaaccttggacttcccagcctccagaactataagaaataaatctctgttcttaattatccagtctgtgttattctgttatagcaacacaaaacagactaagacagtgactctacaaccctaaagaggtagtcactgaagaactattaagcattctctcagttgtgtcagtgaaagccatctctatttgtgttccctatcttaagccaacagttctcaaaatatgatccagggactcccaggagtcctagagacctttccaggggttctgtaaggtcaaattatttttataacatgacccagacattatttgcctttttctctctcctaagtgtgtcaaggcattttccagatactatatgacatgtactatcattatagatttagcgtggaagcagatatgagaagccagctgtggtccattaagccagagggtaaagagatttgccaagaatgtaaaaagaatgtcttctcatggagttttttgtttgggaaaatagagtaataattcataaaaatttcctatttatgttaacatatgagtttattgctaattttaaatcaattcataaacacatattttttaatttttcagttttaattttgtatacagcaaataacactctatgtaacccacatatacaaaaggtccttgaggccctcaataagagtgtaaagaccaaaaagtttgagaacttctatcttaggccaaagcagagatttttagaaacatattcttttaattctttctttggttacttacctccaaatcaaagcaatgtgctgcaactgaatccagtggaaaaattaattagctctatgttaattctttggctttgctgtgaaaagcctgatctttgggccattgacatctgttagaaatttaaactcttgagccctgacccagacctactgaatcagattctgcattttagtaagatcactaggtaattttaacctacaggttgagagttatgagcactgctccactttgcctttgtgaatctggctgggatctttttccaactttattgaccatgttaattaactccctcttttttgattctctcctaataaggcttgcagctataactgcagtttatcctgataaaacttatttctgtagggggaaaaaaataatcttctccttcactcttcaagaatttttagctgggactccctgtaacaaaaggtagattaacaagggaaagcaaacaaaagcttaataacatgtatacttcctgtacacatgggagataatgcagaaaaatgagtaaacctctagagtagatctaaaaaagttgtcttagtcttcaggcttaaataccatcctttgctaagacaaaagaaagttatagggaaaggcctggttaagaagaggtggccaggaaaagcatcataaacaaaaccaaggtttgttatgcagatttaagtaatgccttctgcattgataagagtctctagtgatttagacattttcctcttcctggtgcagagagggagacattcctaccaatagggatgtcctgtatagatgtaaatttatgttacaaaagggtaacttttcagtgcttcttctgtatgtgcagtttctcaaaataaccagttcaaaataatcccatgccaaagaggcctatttggatgggcatattctggtttcctacaatcatatgttgggatgacatgtcctgaattccatcacttcctaatgaaatctgataaaggactgacttgtctgacatttattttcatcctacaatgtgaatgcaatgaaggatcaatttgcaattgtattttttatggccttttggatttatgcactagagaggtgctaaagctgatgtgttgattcaagtgaggagtaagaggggtgagaaactgtgagaaaaaaaagtactataaagacacatgcacacgtatgtttattgcggcattattcacaatagcaaagacttggaaccaacccaaatgtccaacaatgatagactggattaagaaaatgtggcacatatacaccatggaatactatacagccataaaaaaggatgagttcatgtcctttgtagggacatggatgaaattggaaaacatcattctcagtaagctgtcgcaagaacaaaaaaccaaacaccgcatattctcactcataggtgggaattgaacagtgagatcacatggacacaggaaggggaatatcacactccggggactgttgcggggtggggggaggggggagggatagcactgggagatatacctaatgctagatgatgagttagtgggtgcagtgcaccagcatgacacatgtatacatatgtaactaacctgcacaatgtgcacatgtaccctaaaacttaaactataataaaaaaaaaaagtaactgtgttttcttctgtttaatgattgttgcactctcctacaaattctctttaaggaaattttcctagaagccttcttccttgaatttgtaagaaagtggcttttcagtgggttgacctcttggcttttacatgtaaatacaccgaaaaaaaaaaaaaaccccaagggatgtaaaaacattgagaagtttctcaaaaaaagaaaaaagaagtccatttagtctggtataactatgaagtaaaataaatcatagtatctgagaaagaaggggaaaatattcaattgtcaaaattagcctgtctcatttatttggccttggagaataatagtcattgatatagaccagtgggtttcaatcttgaataaacagaggatcacctataaactcaagaaaaagcccatgtctgagagattgaattggaatttggtaggtacttatctttaaaattttgacaaggtgattatgaaacacaatgagaattaagaatgtatggtatggtcaaatacgtgagcagatggaacacaaagtccctagtctttaagtgtgtggattcaatcatttattcatttttctttatccagggttagatcctgtaggggcaaagataatttccccctccccctctgaaggttcaagtctgctgaaatgaactgatgagagagattaacagggcaaaggcatacaagtttattaatgtgcataagcatggaagccatacaaaaaaatgaggctcacagaaaggccagatagctgaagcttaaaaagcactctctttgtagaggagccagagatggtggatgcatgaaattgagggttagtagtaaatgctttttaagagagcttaatggacccaaagaggaaacaatagtttataaatgattctctttggaagttgaatttatgggacggtaaggggcagaactgcaaagcaaacgaaggttgtctttttatgcagataaagtttcttgggtaatttcctgaagcggtcctcagaagggtagatgaaaagtttgtctgggtatggtcagaattttgctttcttctcttctccagtggttaatctttcttgttaatttaatgaaattcctagggagggggtttaagactattacaattcttttagaaaaagttttcttaatcagatagggaaattccagagagaggtcctccctgcacttagaagcaaggaaaacagaaagttagcaagtccttggttcagaggcactttctgaggtattccaatttctttcaattcaaaagtggtcagcatgccaaagcactttactttggaatatcatttttctgagccacaacaggcctgtccagagatttgaattaagcaaattaacacaggaacagaacaacagatgccacatcttcttatgagtgagagctaaatgttgaaaatatgtggacataaagatgggaacaatcgacaccagggactactagaggggaggatggaaaggggagcaagtgttgaaaaactacccattgggtactatgctcactacctgggcaataggattgttcattcccccaaaccttagcttcacacaatatacccatgtaacagatctgcacatgaaccccttgaacctaaaataaaagttgaaaagaaaagaaaaatgaataaatcctgtttaacacaagaattttatggccttatacattttctaatgactattagccaagtgggaaacttgttgaaggtgtagagaactaagttcaattcctcatttattccctagatgagctatgccattggagtgaagactctgaactaaattaaaaagaatgtgttagactagtttttgtaccatagataagatggatgcacttgtgctttttaggtacaggaattcagacctgtggaagatccctggagggttaaggaatgcaaatctgcattatctgtaagccaaacatgtaatatgattcactcatgcgtatgcccgccattctttgtcaaatgtatgtgtgggctttattgacagaaaaggttttcaaaaaatcatttagaagcaccactgaacaatgattctttttatcagttagtttagaaattattaatgaccatcaactatgtatcaattacatgtaccctgggatacagtagtgaatctgacagccctaaatcagggagacatacagattaacagatgattaccatctagtgaatttagtgctgatcccattatatctatctgcagtataaatttaggtgtctgtaatcctagaaatactgctttaaagccagcatgtctgctcccatctccctgttagcctgtacaaatctgctcaagtgttaattagtaatcccaggagagaagtgctgtcattcacaattttctcaaaattacctctagaaatagtaaacagtggctcgtaactgatgaatgtgatggttttagccaaaacatattctcaatctatgtctactcaaagtagggcaatagtcatgatggggggaggggtgatagtaaaaatgcattaacatgaaaatgttgaaaacaatgatgcagtccaattatctctttatagaggaggactctataaaatgttaagagagatacaatgacatgttctagattcatggtctattaactcttgatcctaggtttctcaaagggctgaactgactcaaatatactggggactccctctgctcctcacacctgcccaggagggttacttctcaaggtcttgtgccagccattagtgttgtccactcaaactgctcaggaagcgtggtaagcacggtcagttgtgtcagcatttgcacaaagtcagtgacttacggtgcttccttgtggaggagttctctatccaatggtgccaggcttggccatgtgacttgctttggtcaataaaatgtgagcagatgtgatatgactatccacatccgtgcttaggctgtaagagccatcatgtgactcagccatgctcttctctctgccatgagaatggcatattaccataggaaatagtccttcagcctgtggagatagggcaaaacagagccacggcccacctgccactggcatgtaaggtgagtaggaaataaagctttctttgtagtgtacacccctgtgattggaaggttatttgttactgctgcataacttagtgaaagacaacttatatagtaggccagagacctgccaactttttcttaaagaccagatagtaaatattttaggcttgtgggccatttacagtctgtcatagctactcaattctatggcaaaagcagctattgacaatatataaacaaataggtatggctatgtgccaataaaactttatttacaaacacaggtctttggcttgtgggctgtagtttgcccacccctgccataggattttgcttcctcacctccttgaagttggatgtggccagtgaagttgggtgtggcacttgctttgcctagtggaatgcaagctatttaaagaagtggtgtaagtggtggctactctgtcagtctgagtcttgagagataccattagagagctgagcatcggccaacctatgctggacattcagcataactaagaaataaaccttattgtttaaaaccactaagatgtatggggtgtttgttactgcagcatatataactgcgcctatctgtactgatacaggtctatctggcattacgtttcggggcaccacctctgctcactgccatcccagggcacctcacgtggcattctttgttactgacttctttataatgtttgcgttgtagaccacgatgacagaatttacttaacgatgatgttttgattatcatgcaagtgtgggggaggattgttctgttgaaacagcgtgactgcaaatattttaccaatagatcagtgaaattcacgtgcccttgaacattttcaaaggtatgaaatcacctgaaataattttttagttcattttttagtggctaaaatctgttaatagtttgattcacaagcctggcctttgaaaaagtaaaaattggataatgctgcacaagccatgttctccctggtgtgtaagggttaattattggactcttgcttgatgatgacagtgcaggttcattgaagtcatcactttatatcaccagcctgtctgcagcactgttggggccacgcctcttgtgcgatggttggctcagacctgtagcttcctttgccttatcccctttcacattgaagcctcatctgctgcttgacagtgcatgcctgagagttgcttttccacagtccctgttcttctcctaggtctggttaattgcttctctgttaaacagagaacatgttgaacagcagccttaaattattgtccaattttagcctactgggaacccctctgcagctactctgatcaccactgatatttctagaaagttcctattcacaggggactcttttctcccttctttatgctcaagggagaataaatcacagaagcagcaatccctccatgtgtcaaactatcaatcctacatggagctacaaaacaaaaggcagtatccctttgttgccagagaacatccagtccctgtacaagtctgtgcctcaggggctcaggctcattagcaccatagcagtggctcatgctttccatacacttttctctaccaacacctacagttagtctcagagttgttctttatcatgataggttacagagcagtgttttaaccatattaccttgactgaggtatggtgaggccagatgtggatcaagagaaagaaacagggatggattttatggttttgaggctcacagttccctggggagacacagcaggctgtgctgggccactcagcggaagcacagagtgaggcatgaggcagagggagatgggggatggtagggaagcagctttattgtcgtctccagggaaaggaaaaggaaaggcagggtatgcaggtttaggattggctaatttgaaaatgttcttggggctctggggcatagaggctgtccccggttgtctcatacctggccccagggtgatgaggtaggtccacggtggcctagggtgcaagagccacttaagggaagtggtgggagtttaaactacttggttgactcctcaagaaggggaactgactggcctctagctagggcctcaaaacagggtgaagacagtatagaataaaaaatatattacaactaggacagataccaacatactgggggtttgtacctaccacagttattccttacatttatgtttcattttgtctagtaatagtgaagtgaatggagttctagactgaagtctctgtttaggcagactctgaatttgttttctcattggttcccagagatggactgagatacctcagtcctgtggatacctcaggcaggcttaaaatgtggcacaaattctctttaactattcagttgatactttttcgtgagggcttcaaagaggctgattttctattgctaaaaattgcatacctctctatgttcaaagaaaataccatttactttatatatgaaagagcatttgcttatttggaaaacttttatttgcatttcacattttttatcacttcttactaaatagaagtttctcacattctctagggattgaactaagtgataacttagaaagaaagtattgttcaaatacccattttttggcttttatgttagtaaaatgtttcccctttttctagcttttctttgtgatttcagaaacgtgcaacttctttgaacgcatattaaatgtttttaaatttaaataatgaaccacttgcttttgttacagcccagtggttcttcttgcctgctgcacagacagagccaaggcactgagacagtagtgttgcagcgagaaagatttaattattgctaggcagtcaagtgacagaatgagaggcatttctcaaatccactgccccaagagctcagaggctagggtttttaaggataatatggcatgcagggggctagggaataggtgctgctgattggttaaagatgaaatcattgaggtcttcatgcactgagtcagtttctgggtaggagtcacaggaccagttgagtcagttccctggtgtgagtcatgggtccaggtagagtcagtcagtagccagaatgcaaaagtctgaaaaatatctcaaagaccaatcttaggttttacaatagtgatgttatctataggagcaatttgggggcattaccaatcatgtgacctctggctagatggctcctgagcagtaagaaattatagaaaagcaagctaggggacaatggttggttatcatttagttactcctacattttagcagaattcaggcccctcccataattctaaccttgtcgcttttcattagttttacaagggtggttttcagtccctaaacaaggagggggttagttttgggaaagggctattatcatccttgctttaaaattaaactgtaaactaaattcctcccatagttaggttggcctatatccagaagagttagcttgggaggttagaagcagaatggagtgagctattttgctgactagctttctgtcattgtcataatttttagaaaggtggtctcactcttagtaaacagtagtatgctatgctttactcagttgtataatttcatttgaattcaacaaataactacagacagctgtcaacttagtgatgttgagattggggctaggcctgcagtaatcctctgaaatatgtatgtgcaccccaaaaacatgtcattgagatgggtagacacctgcaagaggagtgcttttaaaacgtttttacatgaagatgctttctacttcagtgagacttttgccagtggtgttagaagttgctgtgaaaaccaagataaggagccactgtgtttttgatttgttctagggatttaatatccctcatagttaatcactcaggcaattactgggttaacaatatgtcctgaagaagagtagtttttgagccatgttctttgaatcactaagattcttcaaaactgctttagagtttcccatgaacatttggatcacattaaagcaggctcattatttccatcttcatgtccatgtaaatgaggttgagttcttcacttggttctcagctttagtgttgttagtatatagaaatgcacctgattttttatgttaattttgtatcctgaagcttcattgcagtcgtttatcaggtctaggagtcttttgcaggaatcttttgggtttctctaagtataagagcatgtcactggggaccccaaaagtgaggaaggtgggagagaagtgagggttaaaaaattctctattgggtacaatgttcactatttatgtgatgtgttcactagaagcccaaaccttaccattatgcaatatacccatgtaacaaacctgtacacatactttctgaatctaatataaaataacaaagaaaaaaataacaaaaagtaggctcgttagtaagacaatagctgaggagccctgaggattggtcaccttctagcagagagaggaagggccaagctgatttacaacagtcctgatcaaagaagggtgacctgtccagggcaagtccacaagcctccccctctgtgtcatgaggccacagagcactggagttccatgaagtcaatggaaaagaagagttctactgcttaaacaagtttaaaaaccactgctctagcattgtttataagaaaagaaactaagaataaaaacaatactgaattcaaacagctaattccttaagacctgggaacattgtgtgttcttatgcagttataatttaatccaaatacattggaaccacaccataattcaattctaggtcaagagcagagttttgtatacagcagattcattttggagcactctctggggatttggttacagaaaaatccagaggatttatctgggctgtcttactcataaaactgcacaatggcctagattttagagatgacattacagtgaggtctcctccaggacatgctatggtatacaccactatacaccacttaatctttagagggctcatttgaatcacattatttatgtagtgtgtccacatgttagatttggccagattctcaaactggggtgtcagttccacgtctagcccattaatttgttgccattgtgaagacagtagacttgaatgccttcagaaggagcatgctgtactgcacaagtgcgaggggcctcattcctaaagtgatcacactgtgttttagggaattgtgcccctttacaatgctgtgactttgggtgacactctctagcttctatagtacccaagtctgggttgcgtctgaatttgaaatctctactatgagactgtattgtttgtttttaaagtcgatggagcacttgacttggagccagaagagaaagcttgggtcttcacgcttcttgattaattatcaagccagttaattttctagagcctctgtttattcatttgtcaaatgggacaaataatgtctgtttcacagggcttgttgtgaagattatactctgttgtgttatagaggtttaaagtggacctgtgggtttgtatgaaatacagcaaggtaacataaattaaaagtagatgagggataaaagcggggaaagggtctaaaatggggttaacaagttgtaccttttgtgcagatctatatgcttgctaggaatgagccacaaatttgcttctgtgccctctagcagccaaggagaaaatggaaaccttattttctttaatcatggtgtctacgagattgggaacacagtagggagtcatgaaaaatattccttttcctagtaacttaacagagagagaccaccctcaggggtctgcaaaagaggacattgcatggtacagcctatagtgtctgctacacagagaggttgcaaactggcagtccaccagtgtcaccatttgttgggatttttgttttgttttgtttaggcttgatgtctaaaaagtttgatccaacatttaaaagaatcagattttgcaaaaataacatttttaagttttctttcaaaatcagatgatcagttaatattgtaactatatatcaaaattaattggcactgtgtagcagcttttttttaatgtagcaatgatttcaggtttgccacagtctccaccattccctactgccttacttactacattttatttcctacttggcatttaggcatctgatttagtgactcctattctacagcatccttgtagtaggctcagcagtacgcttcataaggctgagaatccctgagaggattgattgatatgggaaaatgctggtactctgtacaatattgttctacaataaaaatgtagaattagaatattgaagttactgttagaactttgaaatcatgactgagggtttaaaaatgcttaatgagggccgggcgcggtggctcacgcctgtaatcccagcactttgggaggctgaggcgggtggatcacgaggtcaggagatcgacaccatcctggctaacatggtgaaacctcgtctctactaaaaatacaaaaaaaaaattagccaggcgcggtggcaggcgcctgtagtcccagctactcaggaggctgaggccggagaatggcgtgaacccgggaggcggagcttgcagtgagccgagatcgcgccactgcactccagcctgggtgacagagtgagactccgtctcaaaaaaaaaaaaaaaaaaaaagcttaatgaacgagagtctcaaatagctaattaaaacaacctcaacttccaaactaatctcctagcaagtagtttacccagagtatccattccaattgctctttaatcaaataaaaatttcagaatattttatttaaatatttacatagctatatattttcatcagaaaagagtatcacaggaaagacatgttttaagtatgcttttaactgtataaagtttgattgttaggctctatgatctggtgacaatagtcgttactgttagaggtgaatccttgtaaagttgttatttttgtcaaggtccactttggcttctagacttgttgagtttggtaagatgttttgagcgctgagttgctaattttccagaaatgtaatttgcaatgaagatgttggatggggctttcccaattatcagaaggaattctccaaagttgaaaatgagtgataattatctaatattctaaaacatgctgctagacatggatatagagtgtttaataaaagatgtcaaagttgtgttgtggccaccagccaccatcacagctctagccaacattagagatgactggtgatctaggaggagattgtggagggttatctcagtgaagagcctcataaagagtattggggaattttccctcccattgccgtggagagaagagatgagtgctcttaccctttccccaagccaagagagaagagctctgatctagagataggggttatggcaaccatgggagattggcatctcacttcccacttggatgcctgcggagctctctccaggcccatcagaatggagcacagcgatgattttagggatctgtgagcatatatacagatgcttccaacatacagtatttgatagatgcaaagttgctagagcagcctgtgaaagtgaggcaaagaaaaagatgttcagtggttgacaagctcaacttccaccatttggcagagaaagatgtgtacattttcgtggggccaagcaacatcaggaaaggtagagagtttgagcaattgttgctggttccttgtccagaggtggccttttgggttgaggcaacccagactgtgagaaccctgacatgtatgttgaagtagaagatgtgtgttttgggggaggggctcacaaaaggctggtcaaatggttcttccaccatgctagggaacttggaatagagggtccatgtgggcctctgaagaacctacaaatgcaccctgtgaaggtcccaggatgtgactgcctgccttgcacagctgactttggtagccaagagaattgaaaacagcacgacctgatgtaagaagatgttccgtttcctcaccactgatgtcacttccctgtgttaacctgagaagagctacggcacagagtgatggaggagagaatgaaagcagaggaggagggtaaaaggaaaggctacagtcccttccccactacaggtcatacaaaaggaggagggaaaagctttgagttggatatgagattgaagttttgatacgaaattactatacttttagtaagtgagtgagtcttagtttccataaataaggctattataagtgaaagtgatggaaaaatgatggggtcttcctgagctgtccagctgcagggaatggagatccactggaacaagtcaaagataataataatgagaaaaaaaaagattcttaaatccccaccattcaatgaaccagttaccaaacccacacgatacagagacattgagattccaatatgaatctctccacagaaggaggcaccttctcttgccatcttctgtgtattataaccatttttgggggggtttggtgcttcttgttcaaaattgaagtcttgtagccaaaagtcaaaatcatattcttctaaaattcacttgaaaaatatttccttttacagttgaattaaagcaaattacttggttaattaatgtcaaaggtgactctgttctagagataatttctgagtcatgatacctaatatttaaaaattatgttttgatttttatctttagtcatggtgatttcaaatgaggttattaaatcactgtaattcatgatttatataaaatatgaagacattaacctacaacatcttggattgctttttttttttaattgcattagtcactagtaccttctaacagttccagtttttggaaggcagcctctagtttcctattcagcctcatcatagctgttccttttggagagcggtggagaatacaggattgaaggtgaccctcacagcatgacaaattgtcaatctggctccctcagaaaccttatagggagtgtattagtcagctttggctgtcgtaagcaagtaccacagactgggtggcttaaacagcagaagtttattttctcacagttctggaggctggaaagtccaagatcaaggtggaggcctctcttcctggtttgcagaatcccaccttctcactgtgtcctcacgtggcctcttttctgtgcacttaagggagggagagagacagctgtctggcgtctcttcctcttcttctaaagacaccaatgctacctattagggcccatctcttatgaccatagttaacttccctaaagggcctatctctacatatattcacattggggattaaggtttcaacatataaatttgggggcctggggagaacacagttcagtccataacagagaggaagaaagagattcttaaaaagtgttctcttctgcaagttgacatttctgaaaaatatgtttattctccaaatttaagagacttttagaaccaattacctgtgaaattttcttttccaaatgaccgaaactcaactcaaactagctgaagcaaaagtggatattttttggctcacatagcagatggccaagggtcagatatgtcagccacagctggatccagggtcgatgtcatcaggtctttgtcctccccttgagctctgtgtccccccatgttggcccctcctcaggagggtccttttcctgtggtggcattgattacctggggcagctccaggctgatctggcccttagaatttgcagctttaaatggagagaaactgtctcccaagagtcaactctgactgcccccgcctgggttagggatacatattagcagcctggacccagggcctatctgggtggttatgggctggcattcccaacagctgggagaggaccaaatgaaagattccaggcagatcaaactgtaaggcatgtccacagtcttccccttctaagtttctgagctaaaacaacttatttgtcctttgtgacttgtataattgtataattgatagtccagagaaggtccaaattagttcatctttatatgtgtaagagattctatctaaaggtcatcagaacctttttgaaagtcaactgatgtcatgttggcctttgctggtgtttctctgcagactctccggacgacccagccttgtcaccacctggagatttggctccagcctggctaaccacaggctgttgacatgatggctgtggtctctctgcactcctcctccaacctcccccttctctatcctcttatgcatacctattgttgtggtctaaatgtatgtgtcccccccaaattcatatgttaaagtcctagcccccaaagtactagtattagaaagtaggtcttttgggagctgattaggtcatggaggcagggccctcatgattgggattagtgcccttatcaaagaggcttgagagaggtctctcacccctttcaccatgtgaggacacagaagacaccatccatctgtgaaccaagaagtgagccctcaccagacaccaaatctgccagcatcttgatcttggacttcccagtctccagaactgtgagaaacgaatgtctgttgtttatcagccacccagttggtggtattttgttatagcagcccaaatggactaatacacctaatgtcacccatctcatgtgaatgtaggtgctcatctcttgcctgaaattcttggggtcaagtgtgttctggaactcagtttctaatttcagaaaggccatatcgtatacacactgtttactgacacccttagcagagtctgggacagcacccagaaatccatctcattaacatttctgcagagaaacacgtgaacattcatactacgtaggataaagaaaatcaatagtagccttatatcagttcaggtcaggttttgtcaccaaacacattacgagaaaggtttgttctcagggcttttcgtaatttcagaattgtaaacaagggatcccgaatttatattttcttgtatgcattaagtgctacctttgttggactctcagcagctaggactggtctccataaaatttaaaacttaagaaacattttaacttaaagcactttaagcagcactttccaaagtttaaagtatgtaagtaaatctgtgtgagtagataactataaagaacaaactttcagccaatatcttcactttgagtggttactggggggcaaagaattagaaagccactatgtataaaattaaacatttttatttgttcatttctttaaagtacaacttattttccgggagaggaaagtactctcaccaaagaagatttttacagagagaaatcaggtcaacttgaaacttgtttgcaactctctatttgtaacaacctttgtggggttttcataaaaggattttccaagtcttttgtcttcaagaacataaattagaggacactcttaccaggagtacatgcagtttaagtacccaaaaataagtttgtttaccacttagaatcatggagttcaagagaattttcaagtttgcaatcctgggtctctcccagggacattgagagggcagaatcgattctagttttgctaatgcgcctgccaactggtgtcaccatttcccatcacgatatctcagttatcccatctgtcagctctaagagtctttgatgtatttcaacataccatgctttcaggaacctctcggtaccacgttctggtgcttggcagctgtccaggatgaatttgatgtacctctccctgatgcctgccaggagggagttggaggaggggcttaaaggattttctggtaaatccaaatgatcacatatgagctgttatcaatgtgggagaatggaattaggggatagtcttctcattagaattgtgaaaattcaggatggtggaaatactcagtatgaagattttcaggttggctaagtgtatgtgaaatgtcctaatttgaaaaacactttggatttgattgaattagtggtgttaaattagtggggtgtggtgggcatggtgacacggtgctgggcatccttgcatacatgacggatcagaaaaccagcaatccaggcaactctgtggccaatgcggcattttgggtccaagccccttgaccctgtgtctctctccttgcttcatgggaaatcctgccacctggctcagacacaggcctgggggttaaatggagcatgtgctgccaggtactggtcagtgccctcaagggtggagaagacctcttgggaaccacagacaggctgtagggttgtcgtgtttgtctgtttttaagtgacaggctgcttgatctcatcccattagtagtgacgttgctagaggtagagcttgcaaccacccccttcccattaactctaccatcaccacctgccgctaactactgacggctacccaatggccacaaggcacataatattcacggagagccaaagtggcttgcctgtgtcattacagtagctctccttgttaagagtctcttaaccatttccctccttcccacaccccactcttcacacatacatgtacatccctacctgagctagagccctgcttccatccactttcctggccttccccaagctgcctgtgcaaagcctcccttttctgctccctcagcctccggtttcttcctttttctatacctttccccaacaatttcagcctttattaaccttttccttctctaactatcagtcctatcgcttttttgggggggggggcgggaggcaggtgggaggtgtacagctcctcatacttgctgttctgtttatgtatgctctatagcaaactatccccaaatctaacggcttaacacagtaaactgtttccctatcatcactcatgattttgtggatcgggaattccagccggactcagctgggaaattcttttgctcctcgctgtattgaagggggtcgctggatactttcactgggcagatgggtgaactggaggtgattaagatggcttcacatgcctggcgccttggtgggatggctggaaggcatgttcagctgggtgtgtccactggggcttccacacatggtggtctcaaagtagtcagacctctttcaggtagctggcttccacaagagtgagcatttctagagaaaggaagtgtaagtggccaagcctcctaagcctgggcccaggatcctctctgctgtattcggtggttgcacagttatgccgtcctcccagtttttacctagcccccacctctctgtgtgttacaacaaagtctgccaccactattaatcttccacacgtgcctcctccattctcgaatgttcttgaagattatattgctttctccaaacctaaactgtctcataagtttttggcgcttaagacaagtttcaagaaataagaattgaaaagtgttggaggaaagaaagtttccatctctaaccactttctcagaagggcatcagggtttttgcagcaatgtggggatacctcttctgatctcatagcttagggctctgaactaaactgatggccttttctagatttcttcctaggggtgtcaggttggaagtgctgagggactgctctttctccccagggctcagctgtgtcaaggctaagaccaggagtggttcccacagccaggctgggtgagggcaagtttatcctgcggtgcagcacctcagaccagggtctagccaatggtggcctgcaggctgaccccagtccaccacctgtgagcagccaccaccacctgtgtttatactacccatgagctaagcacgattgtcatattttgtttgtttgtttgtttgtttgtgaggcagagtcttgctctgttgcccaggctggaatgcagtggtgcaatctcagctcactgcaacctctgcctcactagttcaaatgatttctggctaatttttgtatttttagtagagatggggtttcaccatgttggccaggctggtctcaaactcctgacctcaagtgatccgcctgcctcagtctcccaaagtgctatgattataggcatgagccactgcacccagccaatttttatatgtttagatgattgggaaatagattttaaaaagaataatatttcatgatacataaaaattataatgacatgcaaatttcagtgtccataaataaagtttctttggaacacagtcatgctcattcgtgtacatggtagctgtggctgctttcacactgtgagagctgggttgagtagttgtgacagcaattattagatgacctgcaaaaccaaaaatacttgctatcttgctctttacagacaagtaacttttttgctgttcttgccaaagaccaaatgcatttttcaaagctggattccaggctcagagttacagcaaagagaacagaaagtatagctcatgattgggtgctgacaggacaagggagagagacgaaaaccattaggagcattagcaacaaatatattttttgccattccaactccatggagcaaatggcttcctaaaagccagcagagaaactaattacctgaactgggagaagaatgaaagactcattgttagaatattcctcagagctgaatcccttctttcagcctactgtattttagtgattcctaataaaagaaaaaaatgtatttttgtcctcacagccaattaatttctgctccaaagcatagaatatgattatttctgtcattattttagtttccagagtcattgatgagacagggaatgacacatacctattaacacactcgcacactcactcacacactcgtgtgggtacatgcatttccctagaagatgtactggaaggatctgactttactttcaggtgccttcatgtcctcgcaattattctacaaatggtttttaagatatttctattgtatttgttgaaattttcctgacattttgacttgtctagacgattattcttgcatccagcacattgtaggaaacactcatttgaaataccccactgtgcttccgggggagctcatctttctggagcatggcgggtccctcatgaggccctctttcgttaaccgaagaacaagctgcagtctgaatgtgagttgttaaaggtatggtattgggagttttctgttctcctgttttcccattctgtaatgttttctttctttctttccttcatttcatttcatttcatttcacttcatagcaacttttgaatgaaaacctccccacagggtttgacaggcaatgaaacttcctcccttgggaggtgtctcagcctgagggaaatggaacagcaccccacagaggattttcctcacttcctccctctctcctttacaaatcaatgttaaagagcctgcatggatgtggttagcaccatctctgccgcatgtgacttttcagtcattttcacccgaaataggatttcattcaccagttactataagctactcgtgccttctaatggactttgcagcagtgattcatccaccctgtgctgggagagagaaagagactttaggtgagaaagaatggttgggagaggggagacaggtaggcagaacagttgtggtaccatcccgccccataagacaataatgatattcagtgttaggcgctttataccaagaaatattccacctgacacattatcctggttgaatcttatgacacatctgcaaatagacattaccaaatacagagggggacttttaggttcagagaggttaagtgacttgcccagtaacacactgctggcaattcgacctgatctctctctttcttccgccttttccatttcagtcagtggcagtgccatctttccacctgcttctgtcaaatgtgttggtgtgatttgatttcttttctgtttctcttgtatcttttaatccagcaataaatccctgctggctctacttgtaagatatacccagaatctattacctccgcccccccaccacccaccttgctccaagcctccatcatctctctcctggagcactgtgatacccttcttcttggtcatcctgcccctgccctgacttccctaaagttgatgcccaacacacaggcagataaaccagatcagacttgtgactgttttcccattctttgggcaatcccattgcattccagataaaagcggaagtccttagagtactgcagtttgcctcctagcccacgttatctctggccttcctttctcactttctccctccattccagccacgttggcttcctgctgtctcttgaatagtcagggcctttgcccatgctactccctctgcttgaagcactcttatcccaggagactgcatgattgagacccttacctccttcatgtctttactgaaatgtttttacagtgaaacctatcttaaatttttttttttttttttttttttttttgagacagagtctctctctggagtgcagtggcacagtctcggctcactgcaacctctgcctcccgggctcaagggattctcctgcctcagcctcccaaatagctgggactacaggcacccaccaccatgcctgattaacttttgcatttttagtagagttggggtttcaccatgctagccaggctggtcttgaactcctgacctctagtgatctgcccaccttggccttcccaaagtgctgggattacaggtgtgagccactgcacccagcctttgtatagctttaatgcatcaaatatgggcttagttcctcatgtaaacaattctcccaggaaattagaggataaaaagttaaaaatagcatatatgtcctgccctcaggaagtttacgttttgaaggggggatacaacaaaaagctagaatttgtagcagcgtacaacacatgccaataaaacttgcaactcaagccctgtgcacagagaaccatttggcagaaattctagagaggcttcctggaggaggtgctagtagaggagaccttgacaaatggggatggatctagatcaaattcccctatgccacgtgctcctctttgcgttcagaatgctcttgtttgcaagatttcagccatgtacaactcttctggcactcagccatggactaaaacgaggttcatgcccacagtattggtctgcagaaaagcatgagactggatgacagtcagaacaaatggaatcctctagggtagggagaagagaaagaaagaggaaataaaacagcataatcccaggaactgccaataggaaaggatgggagaaaggacaactggcaaagactctgatgtggtgtccagcctttcagatgtcacctgaggacgttgctacaattaacatgcagccagacacacacagtgactacacattttggtgtggttggcggcattagttgagtcttaaacaaaagcaatttcagttgcaaatcttgtgccaggctttcagagaaagagaataaattatgctgctgtgacaagctgttccactgtggcaacaatagtttggacttccagtgctgcctgtcaaccaggactgaaaatacatcttcatttgttgctgggcagctgggaagatgagtcattaaagaattttataatacatcaaaggccatgattttctacctttcacgcagttacaccttttcccaagtcctcattctgccacaaaaaacttttgaatgcaccgaaagttaagtagaattccttttaaaatgttctgttctgtgcacatatctctaggggaagtgcagaagacatggggcattcccttttgtcatgcatttcagctccataaagatttattgaccacctactatatgccaagcattatgttagtcagtggggttaaaaagatgagcaaattgtggtcttgaaacccatgccttttgttcagattattacagtgcaagagaagcagcatcagccatgtgtctgagaggccagaggaaggagagagtgaggaaatattgtacctcattaatattgttcctctcgtttcaccactgtattaatctgttctcatgctgccaataaagacatacccaagactgggtaatttataaaggaaagaggtttaatggactctcagttccacatggctggggaggcctcacaatcatggcagaagttgagagaaaagcaaagggacgtcttacatggtggcaggcaagagagcttgtgcaggggaactcccatttataaaaccatcagctctcatgagacttattcgctaccatgagaacagtatggggaaaaccacccccatgattaacttacctcccactgagtccctccacgacacatgggaattatgggagctacaattcaagatgagatttgggtgggcacacagccaaaccatatcaaccactgtagacatgaccaagttcagacttggtcagtagtcaaatgagcctgtgagagaatggtgccacatctttcctgtaagagcacagcattttaacctgcgatggatttgtgagcagtcattccaactctgtattagttttctacagttgctgtaacaaattaccacaagcttaatggcttaaaaccatgtaaatatattatcccacagttctgaagtcagaaatctgaaatagataggctaaaagcaaggggtgacaggctgcattcctttctggaggctctaggggagaatctgtttccttgccttttccaacttctagaggccgctggcattccttggctctttgccccttcccttcttcaaagccagcagcagtagttgagtcctccttaacacagcatcactttttttttttttttttgccttcttcttccacttttaaggactctgtgatggcactggggccactgggataatcgaggataatcttcctattttaagaacagccaattgacaaccttaattctaagcaatcttaattcccttttgccatgtagctgaacatatccaagttctggggattaggatgtggatgtattggggtggggaaattattcttcctaccaccaaccctcatccatctctaaaggcactgatttttttgataaatcagataagtaccagagatgtgtactctgggctcaggagtgaagagggttagctggcctttgccaacagtgacttcatatcaccatactcaatgcaattgaggtgacttaatcaaggggaaaagatggacagcatgttttatggaaatagcacttgcctggtaatcaggagacttggattttagcttctctccttcaaacagactactgagtgtcagtaggcaagttgttgaactgctctgggcctctgtaaaaaatcaaggttgtggttagatgttctcaaatcctctttcatcctctagccttccatggctctcaatttctacagggaatgtactggaaatggagagaggctagcctgtggaaaatgcagtgccattatttcagcatcaaaatcctgaaataagatacagaatgttgtgtaatatacagctcggtgtctgtgcccttttatttctctcttgggcccagccccatcatcctgtccttgatcattgtaatgcagtgttcactaccagtcttttctccccctacattggaaattatgccaaaagagtaatgaatgaattaggtaaatgaattagatgaattagagataaaattatggctctacagttgaaatatcagctttaagagaatcgacttggagaccaggtgcaatggctcacgcctgtaatcccaacacttagggaggccaaggcgggtggatcacctgatgtcaggaatttgagaccagcctggccaacatggcaaaaccccatctctactaaaaatacaaaaaattagcagggcgtggtggcaggtgcctgtaatcccagctacttgggaagctgaggcgggagaatctcttgaacctgggaagctgaggttgcagtgagtggaggttgcagtgagctgaggccgtgccattgcactccagcctcggctacaagggcaaaactccatctcaaaaaaaaaaagaaagaaagaaaattgacttggagatgtacgggttcacatataattgaaagtgagcattccacagtgacttgagaaagttgattccggctttcaaagcttgcattatgggtaagaaacttgagcctaaaaagaacttatatgtatgtgggtcattagacaatctcctccctcaccacctttttttttctttaatcaaagaattatacatatgcaagtaactgaatcacctcttctttcatttttttccctctttaatcacagctgtgtggaaagtttccagctaggcattaaattgggtcaacagctaacacagcataagtgtggacagcaggggcaatcggtggtatatacataggaaataaacgacactgtgctgctggcattgataagctgttgaatagtgcaagggccctattaagatttaaagtaataaaagatgggaggaaatatggttaccagcagctgataaacattcttgccttatgaaggcattagtttcacttaatggcttctagtgcctggagtataagctcttgtaatttttctcccccagagcagactgaaagaatacctaggaattgtcatctttgtagttgctcaagaaagatctttgggtggctgtgagcagatctgaaaatagtaagtatggcaggtacatggagctgcatccgtttgcaaaagctatcaataaagaaaggtatagaaaggatgcccttgaccccggtatgtgcagatagaagtggaatttcctccggaatgtgcatgcaaatgtgcctagctgcaaaagaagaggcattccctgctcaggtgtgtagagtgatttagaaccatttgtttctgctcaatggttctcaaatgaacagtatttcctcactaggaaacagtgctaattccaggctaggacggtccacagagatggtggctgtgcccagatcattcttggaaatctgaggaagggagtcatttcttctcatgccacacccagtaaggggtacattagatactctatttcctccaggcagatctacagtgaccaggaccacgtactaggataggagaggttctggcactattcatcattggctccggaaatagctttcccctctgagctcaaaggtaggctcatcctctgctagagtctattaggtctggtgggattggaactcaggtgcatacccctgggctctccaaccactagtgctgcatccagggcttggggtcctgctttgtgccatcaggtcatcagtgacatgactagggcagctcaacccgcacctctggcatcactgccttcctcccatggccccctagcatgaacccaaagaccacagggccggttccctccttcaggcccaaggctgggcctccaaataatggcctcccaaagatgcccacattcacatgcccagaacctgtgcatatgttaccttatgtggcaaaagagactttgaaaatgtgagtgaattacaatatggagattggcctgggttatctgggtggactcaaagtaatcaataagagggtgacaggagggtcagagtcagagaagaagttgtaatgatagaggcagggagccatgaaccaaacagtgtagacagcctctagagactagaccaagcaaggaagtggattctctcccagggacttcagaaggacctcacccctgccaactcatccgaggacttctgacctccaaaagtataaaataatacatttgtgctgctttaagtcactgagtttgtgataatttgttataacagcagacagaaactaatacagtttatcttattcctttactcatgatcaactactttggggttaacgaacaacagtatatttacttccttcaatgaaacacttacctccacccaccagagtgaaagtttgtcaccctggttccaacaaatgccacaaaccactgtatgatcatctttgggtaggtcagcttgtctgctatggtatttttcttttatattgcagtttacaaagtgctcatttgtcttgtatgatagttatatatggaaggtagcattactatttcacttttctgattttctaaaaaatatctttaatgaacacatattaattttgtgattaaatgacacaataattagaaatgttaaaaggagatggcagttttagtcacttaataaccataatactaacaaattcaggccacatgctatctcagtggatagtccccagaaccaagttaggctagttcatgaggcatttcagatagctgaagggactaagtatacactggaagattgggtacgaagatcaaaagacagctctacaacaaagcttcatgggccattggtttcacagtagggggaactgaaatccaggctacagattcaaaagcttacaacctggcaatttatgtagcatagggaatcaatgtctatagtcttaattacatagaggctaaagcctcaattattctatttctgtaggcaggattcctacataatctatagcatctattggcataaaacattcttagtggccattctgggtacaagcatcccatttctctttctgtccttccacacactaccagtgtctctcgcttatttcctcccaactctaatgttcatatgtgggttatttgagcttctaagttaattccttgcctatatgtaaggaacatattggaaaattataaccaaagtgtagtatatattgcagagtctctacttcccatgagcagctttggagggtacctcacaggagagggttagctggcatctttccattaggaagccagcatcagcacaaggggaaaacttctctccaacgtctagacctctctatcccatgagactttggggactgggactgggtagcagggcagaattgggggaaggaggcacttaagagctttttaatttcaatattctaaccattagtgagggtgtgctgctgggtacatgtctgcccataaataaacatggactgttcattgaaacttgcatttttatgtagaaaagctcatgctaccttatcactttttgcacaaaagttgacacattatgaatgctttaaaaaaaaaattataccttactcccatacactgaacatatctttcctcatctaaaactatccaagcagccaactttttaaaattaatggaaggagagggtctacagcatgtattctcaatgggggcaatgtagccccctaagggagccaaaattggttctgggttgggagtggtgaaaaaagtctttaaaaaaataaattgcagaatatacatgcagcacatagattgatatatatatctgtgatattaaaatttcatatggaggtagttgggaaaaaatgtctaaaaaacctccttagggtgatatttgatatggttttgctgtgtccccacccaactctcatcttgaattgtagctcccataattcccatgtgtggtgggagggacctggtgggagataattgaatcatgggggtggtttcccccatactgttttcgtggtagtgaataagtctcatgagatctgatggttttataagggatttctgctttcacttctcattttccttcttgcctattgccatgtaagatattccttgctcttccaccatgattgtcaggcctccccagccctgtagaactgtgagtcaatcaaaactcttttttctttaataaattacccagtctcagatatgtctttattagcaacatgagaagagactaatacaatattgaaaaaaaaaaagttgagaaacactgatctatagtaaaatttaaatatccaacttctactatttttttggctgtccattcccagtagaatacaagttccatgaaggcagggatatttgtcttttttgtgcactgatttctcctaagtgcctagaatggtgcctgggatgtaggaggtattcaatccatacatattgaattgaatgcatgaatgaacaacttccctcagtgtcccagagtccactttctctcaacactgcaagtggtggcaagctggaaggtttgtgagcagtgctggagctgggctcttccaggtgcattcacaatagtttaaaatagcaggtgcatcagaggaggcctctttgttcctggtactatgctcattgatgtttactatgagccccttgcagactcaagcatccattgtttgccttttaaatatctctactagccgggtgcggtggctcacgcctgtaatcccagcactttgggaggccgaagcgggcggatcatgaggtcaggagatcgagaccatcctggccaacatggtgaaactccctgtctactaaaaatacaaaaaatgagctgggagtggtggcacgtgcctgtaatcccatctcctcaggaggctgaggcagaagaattgcttgaactagggcatcaaaagttgcagtgagccgagatagcaccattgcattccagcctggtgacagagagcgactccatctaaaaaataaaaaaaaaaaattttaaatttaaaaatctctactctccaggccaggtgcagtgagtggctcctgcctataatcctagcactttgggaggccgaggcagtcagattgcttgagttcaggtgtttgagaccagcctggtcgacatggtgaaaccccgtctctaccaaaaatacaaaaattagctagacttggtggtatgcacctgtagtcccagctatttgggaggctgaggcaggagaatctcttgaacccagaaagtggaagttgcagtgagcaaagatcatgccactgcactccagcctggacgacaacgagactatgtctcaaaataataaaataaaataaaataaaaatcctctactgtctacttcccccacccctaatatcctagctatgtggcccaagtacttatttagcccagtccatgaaagtaaaggacagtggacagtgtcctttgataggaggatggggcagaatgggaaaagaaaatggtagggtctggaggtacaagtgggggccagagagaggggctttacagattattcgggtgtttgaaagtcagttggtgttatctttaacatacaaacatgtattatgaatctctgagcatccttcaacgattcctgaattttcaaaacagttgtgtccaaatgacacaccttgtccagaaacaatttggttttgatagaaaaagaggcaaaataaaaacactgatttacaggctcatggtgaggggtttggggaggcagatgagaagagaacctagaaaggatgtcaagagcagacttagctgacctcactttgctttgggcttgctttcctacagacattgacagtgagagttgtttttgctcaccacactgggaatatgtattgcttaggagacacatggcagttaaggcaaacagcacatgccaacaatatgttgcatgatttgatgcctgttttcagggaacttcactaggaagtgtgtgtgtgggtttatatagccacgtacatacatatacatttatatatgttttatatacttagaaataaatacggaatttgttacaggaacgtggccttacacaatcatgggagctggtctgccatcttcattaagccattgtctggtacagatgctggagtttgaagtctgtaggataggaaatcagatgttgtctcagttggcacctgctgcataatacggtaccatagactaggtggcttaaacaacacacatttattctctcatacttccagaggctggaagtccaaaatcagtgtcttgcagggttcggtttctggtgattccccacttcctggctgtgggcagtgccctcttgttgtgtgctcacgtgacctcttctttgtgcacatgtggagagaacaggctctccagtgtcttcacttataaggacactcatcctatccgattgagaccctaccttatcatcgcttaaccttaattacttctgtaaagggcgctatctccaaggacagttatattgggattggggctttaacataagaattttgcagggacatgaattgcagtccatgacagatgtaaactttgagaaacaggaaaaagctggaacctacaagcagaagtgggaacctgtgaggttggactgaaactcagatcagttcttgctgcctctgaccttgatgtatgtatcctggaggagatgctggcatctctcatcatggagctaattgtaggacaggcccagaaatggaagaagctggaagagagtctagtggaaggtggggcagcgtgggcccagctgctgttgcctgccaaagaggtgagcagcagataagtgacgaggtatgtgagctcacacacccaatccactgtggcacttctgccttccagatcctccataagaaggtctctttggcctactctgctcagaaatatataaggcaggagattctgagaaatctagttgagtccagccacgttgacatgctacaaagccaccacagactctaaggagaaattatgtccagggttgggagaagagagccattagctgtacttggatgaacagttagtggcctagaaactgatctagaaagggatctctgttgatgaaaaaggacagtggtgtaaataaaggaagagtgatttggcgatggggtgttggttcagagttaaagacatgagaatgacaaagaaaggacaagggtggcaattgagatagatgcctttattaagtatagggtatagaagtgtagaatagagaagacaaagaaaagcaaaagaactgaatagctagaatgtattaatgcagggcatcaggcatgtggagccagctaaaaagtgagagatcaaacaagattcttagagcaagagaacatcagtaggaactagccacatttatttcacggactcaatgatactgagtttctactactacagggtactgtgtttgatgcacataaaaattattaacatgtattcctgcttatcattattggaggcaggggttgtgaagtcagcatggtccccaccgccacgcccccaccccaggccaaactctaaaggtatttacctgggttttctttcgaaaaaggaagaggtcttattttttttttttatgggagctgagggcagtggataaatttggaaccagacagttgaagtattaccataagcatcagaaaaagtgaataggtttttaaaataatagggaatagagatagaaagcaatcaacaaggcttgttttagaattaaaactctacaaagtaaaagatgtagcctgaatgacccttgaaatcacatgtataatttatagcacctgattccctccaagtcatggtacagaaaatgtatgtctcagctgtgccatgctggccaatctggtctagcctcaggcttgtcacatatgaagtggtgatgacatatttatatcacagaacaattgtgaaaaacaacggctaatgtagttactcaacaaatgtagtgtgcactaaccttatgctaggcactattcccggcactagggacacagaaatgaagagagaaacaatgtcctcattctcgtggaacttgcaaggtagtcagaagagacattttattatttaatctctcactgtctaatatcatagaaatcatacattcacattcatccagagagatagttattattacctttttcacatgctgaaacagaggttacttgtctgagacctcttgctatcaagtgttaaaggtgagactgagtccaggtcttatatgactccatatgcccagcactcttcaaacggccaaatgcctcgtcccacagaaaatagaagcccacagtcctcatatactataaaacttaaatagaatacattatctcatgtggacagatggttatgactttataaactaggaaatcctatgtaggcagatgtttagttgatgaaaagaagtgtaaacatgaccctaatgaatacatgttctgcaagttattggttgctattaatacagagatagttatgctgtattaacggacaaataaggcatatgtagcaagctaaaaagtgagaagtgaaacaagattctttttttttttttttttttttggagacatagtctcgctctgtcatccaggctggggtgcaatggtgcaatctcagctcactgtagcctccgcctcccaggttccagtgattctcctgcctcagcctcctgagtagctgggattacaggtacctgccaccatgcccagctaatttttgtatttttagtagagctggggtttctccatgttggccaggctggtcttgaactgctgacctcaggtgatccgcctacctcggcctcccaaagtgctgggattacaggaatgagccaccatgcctggcctgaaacaattttcttaaggcaagagaaaccactgggaactagccacatgtatttcatgacttcaaatgatactgagtttctactactagaggaatacatgcaatagaggaaataaaagggggtgatgggatcgagtgatggaggagaagatctctttagactggttggtgagggaaggcctctgtgaggagactattgagatatacctgaggaatgggaaggaggcagatctctgaaaatctggaggaagccctttctaggagaaggaacacacaagcaaaggccctaaggcaagaatgagcttggtgtccttggggaacaaaatgaagatcagagtggctggaggttgctgagcaaatgggacctggttaattcatgcatctggaaaggtagaaaggagctagatcctgcaagtccttgcaggccacagtaaggaatctgaattttgttaatatataagacacaaggtattggaagacacaaagtcatcggaagattttaagcgagagtgacaggccattggtattttttaaaaaatcactgtggctgctataaaactatcacttatggagcaactgtaggctttttgctctttttaaagattattgtgcattggatcattcatggatgccagacttgaaatgaacaagatggggaataatggggaacttctggaatatcagtaaaaataaagaagctgctaggatcctggctacagtgtgaacccttgagttgtggcagccgtgagagatggatgtgatggctgtttggtcctgcgagtcacttttctctatcaaatatacttgaccttcatgtgaccctttccatctctttgtgaccaagtaccaagtgataagcgttaattaatttttgggtcactgtgacagatcatcagtgtgctacacttttcaggtaacaggtttccgtgaaccatttgcaatgcccaaattataagaaatcccttaatatctgactctaacagagttgcagtttccaagtctatagcatcccactaacagaggggttggaagacaagatggagccacaaaggtagcagtggcaacccgtccacccctgcttaatgctactcctggtttaagacatgagcccaatttctctttagctggtaggatgacagaaaaagttttaacagcttttttgaggcataattgatattaaaaaggacacatatttcatgtgtacattttgatgagtttggacatatgcaattacctgtgaaactatcatcacaatccagggaataaacatgcctgtcacctccagaagtttccttgtgcccccttgttgtttttgtttgtttgtgtggtagaacacttaacatgatatccaccttcttaacaaattttttaagcgcacaatacagtattgttaattatagggactgtgttgtacaacagatctgtagaactcattcacctttcataactgaaaccttctacttgttcagtaataactccctatctctccctacccccagcccctggcaaccacgattctactctctgcttctatggttttgactattttacaatcctcatataagtgtgaccatgtagtatttgtccttctgtgactggcttatttcacttagcatagtgtcctccaagcttatctatattgtcacgtatttcagaatttccttttttaaggctgaataatattccactgtgtgtatagactatattttctttattctttcatccatcaatgagacacttaggttgtttctatatcttgactattgtgaagaatgctgcaatgaacttgggcgtgcaaatatctcttcaagatcctgatttcagttattttggctatatacccagaagtgggatcactggatcatatgatagtgctatttttaatgtttttaggaatctctgagatggtttggctgtgtccccacccaaacctcatcttgaattgtagctcccctaattcccacaagtagtgggagggacccagtgggagataattgattcatggggatggtttccccatactgttctcatggtagtgaataaatatcatgagatctgatagttttataagaggttttccctttcccttggctctcactctctcttgtctgccaccatgtaagacatgccttttgccttccaccatgattgtgaggcaccccacccccagccatgtggaactgtgtgtccattaaacttctttttctttataaattacccagtctcaggtgtgtctttatcagcagcatgagaatggactaatacagtaaattggcactgcgagggtagggagctattgtaaagatacctgaaaatgtaaaagcaactttgaaaccaagtaacagggagaggctggaagagtttggagggctcagaagaagacaggaaaatgtgggaaagtttggaacttcctagagacttgttgaatggctttgaccaaaatgctgatagtgatatgaaaaatgaagtccagattgaggtgttctcagatggagatgaggaacttgttaggaactggagtaaaagtgactcttgctatgttttagcaaagagactggtggcattttgtccttgccctagagatttgtggaactttgaacttgagggagatgatttagggtatctggcagaagaaattgctaagcagcaaaccattcaagatgtgagtttggtgctgttaaaagcattcagttttgaaagggaaacagagcataaaagttcagaaaatttgcagcctgatgacgcagtagaaaaacccattttctgaggagaaattcaagccggctgcagagatttgcaaaagtaacaaggaaccaaatgttaatcaccaaggcaatggggaaaatgtctccagggcatgtcagataactttgctcccattacaggcccagaggcctaggaggaaaaaatggcccccccacctgctatgtgcagcttagggacttggtgcccggcatcctagccattttagccatggctaaaaggggccaaggtatagctggggccatggcttcagaaggtgcaagccccaagacttggcagcttccacgtgggcacacagaagttaagaattgagttttgggaacttctgcctagatttcagaggatatatggaaactcctggatgtccaggcagaagctttctgtaggggtggggccctcatggagaaccctttgctagggcagtgcagaaggaaaatgtgggattgaagcccccacacagagtccccacaggggcactgcctagggaagttgtcagaagagggccaccatcttccagaccccagaatggtagatccactaacagcttgtatcgtatgcctggaaaagccacaaacactcaaagccagccctgaaagaagctgggaggtaggctgtaccctgcaaagccacaagggtggggctgcccataggaacccacctcttgcatcggcgtgacctgaatgtgagacacagagtcaaaggagatcattttcaagctttaagatttcactgccctgctggattttggacttggatgggacctttagccccctcattttggccaatttctcccatttgggatgggtatatctatccaacgcctgtacccccattgtatctaggaagtaactaacttgcttttgattttacaggctcataggcagaagggacttaccttgtctcagatgagactttggactgtggacttttgagttaatcctgaaatgagttaagactttgggggactatagtgagggcatggttggctttgaaatgtaaggacatgagatttgggaggggccgggggcagaatgatatggtttggctgtgtccccacccaaatctcatcttgaattgtagctcccgtagttcccacatgttgtgggaaggacctggtgggagataattgaatcatgggggcagttcctccatactgttctcatggtagtgaataagtctcatgggatctaatggttttatatgggttttctctttcacttggttctcattctctcgtctgccaccatgtaagatgtcctttttgccttccaccgtcatcatgtggaactgtgagtccattaaacctctttttccttataaattacccagtcttgtgtatgtctttatcagcagcatgaaaatggactaatccaatctccatactgctttccatagcagctacaacattttacattttacatttccactaacagtgtacaagggttccagtttctttacatccttgccagcacttgtctttttgataatagtcatcctaacaggtgtgaggtgatatctcattgtatttttgatgtgcatttctctcatgattggcaatgttgaccaacttttcatatacttgttggccatttttatgtcattttttgagaaatgcctgttcaagtcatttgcccatttttaaatttgtttattttcttgccattgagttgtagtaggagttccttatatctcttaggtattaaacccttgtcagatatgtggtttgtgaatattttatcccatttcataggctgccttttcactctgttgattgtttcctttgctgcacagagctttttaatttgatgtagtcccacttgcctatttttgcttttgttgcctatgtttttggtgtcacatccaagaaatcattgcagagaccaatatcataaagttttgccccatgttttattctaggaattttatagtttcaggtcttacatttaagtctttaacttactttgagttgatttttatatggtataaagtaagcattcaatttcattcttttgcatataagtattcattttttgcagcataatttatcaagggactaacctttctccattgtatattcttggcacgcttgttgaagatcagttgactgtatatgcatgaatttattgctccactgtctcttctgttccattgatctatatgtctgtctttacgccagtaacatactattttgattactctaggttcgttatatattttgaaatcaggaagtgtgatgcatccatttttgttcttctttctcaagattgctttggctttttggggtcttttgtggttccatgagaattttagtattttttttttctatttctgtaaaaaatgcccttgggattttgatggggaaagcatggagcctgtagatcactttgggtagtatagatattttagcaatattgtcttctagtccacaaacacagggtatctttccattttttatgttttctttaatttatttcattgatgttgcctcagtttcagtgaataatcttaaaccttcttggttaagtttatcctaggtattttattctttttgctgctattggaaataggacccctcccctcccctccccttccctcccttctttcactctgttgcccaggctggagtgcagtggcacaatctcggctcactgcaatctccacctctcaggttcaagcaattcttctgcctcagcctcccaagtagctgggattataggcatgtgccaccacacttgcctaatttttgtgtttttagtagagacggggtttcaccatgttggccaggctggtctcaaactcctgacctcaggtgatccacccaccttggcctcccaaagtgctggcctcccaggtgcaaactaccacacctgaccaggattgttttcttaatttccttttcagatagttcagtcttagtacagggaaatgcaactaatttttgtatgttgattttgtttcctgatatttcactgaatttatttattagttctaacagtttttgtgttgagtctttagggtttactgcatataatatcatgtcatctgcaaacagagatattcttacttctttctttcctgtttggatttctttttcttgcctaattgctcggattaggactttcagtagtatgttgaaagtaagtggtgacagtgggcatcattatcttattcttgatcttagaagaaaagcttttatttttcgttagtataatgttaactgcgggattgtcatatgtgaccttttttatttttatttatttttttgagacagagtctcactctgtcacccaggctggagtgcagtggcgtgatctagacttactgcagcctccgcctccccagttcaagtgattctcctgcctcagcctcccaagtagctgggactataggcatgtgccaccatgcctggctaattttttgtatttttagtagagacggagtttcaccatgttggccaggctggtctcaaactcccgacctcaggtgatctgcccgccttggcctcccaaagtgttgggattacaggcatgagccaccacgcccagccaacttttttatattgaggtaaattccttctatacctagtttgttgagagttttatcttggaaggtcagatgctttctctgcatctattgagatgattgtgtgatttttgtccttcattctgttaatgtatattatatcaattgatttgcatatgtcaaactatcatcagatcccagaaataaatcccacttggtcatggtgtatggtacttttaatgtgctatggaattctgttttctagataggtgagactttttacatctatgttcatcagggatattcgcctatagttttcttttcttgtagtgtctttgttttgactttggtgtcaaggtaatactggccttataaaatgagtttggaagtgctttctctccttcagttatttttttaagactttgggaaggattggtgttttaaaaaaatatttggtagaatttgccagtgaatccataatggaaatattgtatataggtaatttagtaagtcaagaattgtccctcaaaaggtactagaaaactcagttcttacttttaagactcttctaattatcctggtggaatggcttctggaatatcaccataatactgaaatttactccataatactactgaatggaagggatccagtgctggaaactttacatttgaccaggtgcagccctcaatactaggacagtttggctagggggctacccccacaggtagcagggaagaaggctgcattggtttgactgggatggaagaagaataagctaagtagtctgtcagagtttgccaggttaaagaggaaagatgatagcacaggctggagggaggtcaaagtcacattctggggaaactagatgtatgttgaccagtaggggcaagcctagtatggaatggtgggtgacagtgaacattgagggccaatgagatttagagaatgaattgaggagtgaggcttaggggaaagaaggccgggcacattagaaggctcagaggtctaagaagcatgaggaagattgtcctccagagagctgtccccttgaaggaggtgcgttggcatgatcttgtcatgaatttctcaccctgtcagaaacatcttatgtagattttttaaagggcaacagttttcctgctcactctgagtacctgaaccttgattctaagacttaggtaaggttcacttggcctggatgtttataaatgccagtaccaaggggagtccttgaaatggcatagaagatggcaaagggctctgcagagccacgaaacccaaatttagaaatgagaattactaacaatgcatatacaacatgtctacaataaactagaaaggatgatatagtttctgataacagtctttgaactttccctacctatgaaatggtattaacccttaatcagcagctcaggaaatagtccacggtagatcctcatctttgtatttcctttactgtctggttacttactgaaaagtggtagctgaggccgtatctcctaacctgcatgctctccctctctattttctttgtctcccatgttctccctacaaagttagcattcattcattcattcttattttctttctttctctctctctctctctctcactctctctccccctccccgttttcctgtggtattgaaagcttattgtcaggatgagccccttattgcttggaacccaatctgtgtccatgaattgcccatttcacagaatcacgaaagccacgctgcttcctgagcaacacagctaagtggcattccccacccctgctcttagcaaaagttcctcaggacattattgttgaattactcaatgcctattatcatagaacctcatgttcacgctgggaggtagttactactacctttttcaaatgctgaaacacaggttacctgcccgatacctctctgctatcaaatgtcaaaggtgaaattcagcccaggtcttctgactctacatccagcattctttatagagctaaatctctcttcccacagaagatagaagcccacagttctcacatacttacaaaacttaaatagagtacattatctcatgtggacaggtggttatgactttataaactaagaaaatctaggcagatgtttagtcaatgtcaagaagtgtaaacatgaccctaattaatggatttgctgaaagttattggtctctccttgtcagaactgttgttttccctgtcacttctcagattggattagaaaaaattaagcatgaagaaaattggcatttaaaatgtgtttattcttcactatcaagacagatagaactttccattcaaaagagaatgaaaagttcattttggcatggtgaatcataaataagaaaaacagaatagagaaatcctaggacgatcaatctctcataaaataaagaaatcgagattttatcgcaaagaattctgcagcacataaaggcccttaggactggactgatctccgagttcaagcgttacacccagtatgctgcataaaccctattcagtgtttgggctcattctcaagaggttgacatccttcccattttcatatcacctccctggtccacctttgctaggtcacaggtttttcaggcactttgcattctgccctccctcctctcaaaagacttcccggcatgttttcgatagcttcacacctagcagatggcagtttttcttctgaccttctgccagccctcttccttcctcagcttccttcctctccacagcttccatttaaggtattttggaagtccctcgaaatgggtccttggtgagtaaacccctttattgagtctcggactttaagaagttcttggcttcatgggacccccttcttctagttgacacttttggggattgatttcaagaatcatctgttgctgataagtcagtgtggcttctattgctgcagaagcaaggaagaaactaggcatatagtggaagaaaatgcgcttaattagaaactggtcctcattagggattcttaaaggaagtgctcaatttgcacctatgttagcagagcctcacacggattaattaaaagctgctactctcaccagcaacacccttcatggctgggttgaattgtttgtagctgtcaactctgtgccaagggcaacaaggtttgaatctgagttctttgaaatgcaggttctttcactcactatgcagaatctagggatccagactctcaagaggcaaagctctggaagaacaggtggagtgagtatccctctggcttctgctcccgccagatgatcaccatgcctctcaactctacactcttttccctgcctgtgctccagttcacactctccacatccctggggccaggctatacctagatccttctgcttgatctctcaggctccgatgtttcaactcgtcattccctaggctattaacttcaagcccttagatggcattcaagctccttggtgacctctctgcgtccgtctccatccccatctgcttccgtgagcttcataggcaagccactctccatagttatatgtccctcaaatacccagcatccccatgccatcatttcaaccagactgtcctttttcttttcccacctaaggaaattctattagttcttcatggctgggttcaaatccacctccttcactctccaggaagactacattattcttttcctaacactcctgaagtgcttgtcctctacagcattgctgcacatattttgttctgttctttattacactagtccatatggctttactccctgctgaatttaaactcttcaagggcttgatctctgtcttattcatctctgtaacctcacagtacctaatcaagttctttgaacaaagccagtgttgaaaagtgtttgttgaattgagaacagcaagccagactttctgatgggctagaaagatatacctagaaagatagagcagagtagcatttctaaagatggaaaggacaagcctggctaaaatcatgctcaaagaaaggttttcttttagggtcctcatcacatcacaatagcaaatttttaaaaaaagaaagggccgagcacgtcagtatagttaccgagcgtacttgtgtactgggcaaagtactgagcgcaatagaaagttactaaaagaaagaacagatgctttttctcctttagagctggtcccttttcaaaataaggcctcaaagtgcatcccattattaaccctgaaatagtgggacacaaacgtccagatagatatgtgcatgccaatacgtgtttaaaaatctggcgtcacacagcacactccagaggaagccaagcctaagagacatgaacacagtaacacggtagggagccgtgtgatccagactgtcctaagcagaagaggccccgggtggagaattctcacactgacagccgcagagcctgccttccccagtgtactggttttcccagggcatcaaacattttatttaataagctacatgtttgagtcacaagcgtagacttgacacccctgtatggtcaactccagctgtcgtttgttctcctcccctctcttctggcacagtggctggaacctgtatctggtgtatcacaacgctccatttcgctgatcacacacagccagaagtgacagtcgcttctctcactgccaaggacagaggagactctggctggacaggagaaattcaggtcgaaccaaggcaagtgaacgatggaattaaaaacggctgagaaatcccatagacttagaattactcatatctgcagactagagggaaatgagttggtcctgatgacaaaacaaccctttcttttctctagtctgttaaacttctattttcccgtcagactgttttaacaatgccctctactgggtattttcaaaactgcagggttctgcaggcctgacctgctcttgttctccttgagtaattctttctgcaagatgaactgaacccaaagttttcttcacataagcaagatgttactgatgtatagtttcttaagagcataaaaagtggaccagtgcatcccctggaaggagggcctcttgccctcttgagagatttctttgtaaaggtgcatgaggaattgaaatctcaccacctcctgaactggcccagagctgtcctggcatggatgacacagggaccttgacatgggctgatggattaagaacaatgttacattttctgaacgcatcacttttccaacagctcttgatctcacatgtgaggctctttctcatccctgaaggctactgacttttccctggatatatttgtattgtgattattctgcatatctaagaatttcatccctttctaaccgctcctctgccaaaacagaaaccaaaaaaagccaaaacatcactctgtgctagttagtttctttgacccctcttaaagaaactctaaacaaaaaatctgcgtccagttatatccaagggggtgttcttactgggtattcccgtcagaacctcccatctgtctattttggttcattctttgccattatcatgtaacaagttcaagataattgtgtttcatctccagttattattcatagtccctctgcatgttgaagattgctgagacagcacagaaaaatagtaaagcaacagatgaggtctgtttgcaaaaaatgtagaacaattcgaggtgcaggatgttcttcaaattgtgatggggtgaggttttgaaaagttcttcggatgggctagtgtttgttttctctctccctctccctctcttcccccctcccctttccgctttcccacttcctctctcctccttccttcctccccatccatttctcttaaatagaaacaaaattccatatattcttagaatccataggatccatatattcttagaatccataggatccagcattgcattttatttaaaagcaaatgccgaccaagtagtcagtagcaccctttcagctccaatagttggtgctatattctgtactcagcagtagactcatttcattattttggagtatggacctgaagaaaatgaatatcagacatgggctaagccaaggccagttaataaatattttaggctttgcaaaccgtatagtctctgtagcaactattcaactctgctcttatagcaccaaagtagccacaaataatagtaaacaaatgggcatggctctgttctagtaaacttacttgtggaaacgggacaggctgaatttggcccacagaccctcgtttgccaatccctgggctaagctattgcaggggtactgctgatggatatgcgggctgtgtcctgtgtgacagtgcctagccaagggggcaagtgggacctgaaatacaacccatgctctgcttctccacgccttccaccacaagaggtcctttttgtaattcagacagaggtaccatttgttcacaggctgtctccaaccagaataagcacatttcctaatggattagggtacttaacatggtttgcataagtgggaggaagagggacctgattttcctgtattaggataagggttacctttgatcccaatggctgttattgaaatgactaaagccacatggttcaaacatggctgccttagcccacatctacagactgggagtaggtggtgggagcaattccaacagagatgtagactgggaaagtgccccaggtaagaggaaccccaaagaaggtgagtttattggttagggggcttgttggatattattaccaaagccatagtccctttatgaagtttgttctgtccaaaaatgtgatttaggccactgtatgagtccattctcacattgctgtaaagaaatacctaatgctgggtaatttataaagaaacgaggtttaattgggctcatgttgctggaggctgtgcaggaagcatggtggcatctgcttggcttctggggaggccttgggaaaacttagaatggtggctgaaggtgaaaggaggagcagcacttcacatggccagggcaggagggagggagagaggggagctatcacacactgttaaagaaccagatctcgtgagaactctatcatgagaacagcaccaaaggggtggtgctaaaccgttcacgaaggatccaccactatgatccaatcacctcttaccaggccctatctccaacatgggggattacaactaaaatgagatttgggtggggacacatatccaaaccatagcagccaccactctccatcttagaatggtagaataataaaattaggaggaaacttggtatgcttttgcatgcattttaacatcagaaccctttgttcaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaagaaccctttgttcaaataaaatcttatctagaactccagtatacgcaactgtgaaaaagggagagtgctctggtgcagctggagaggaaagacaaggagtgccctcagtaaccccctccccagatccggctggcccagagagagctgctgagactcccccaggacccagtttggagccactgatctcatcactgcataggagggagagagagaggggagatatgaaacaacggaggcaaaatgaaataaaataatcttaggtgacaacattttttaccaggttttgttggtataaaacaccctttccttttcagttcccctacctgaaagtctttggttgcttatatatatttaggatgtttttatatagggtaatatagaattgtaaggcttaatataatattaatatttgacattctattggatttaagcagccagtgggaagagagtaaataaaaataactacacaaaggaaactgctattagcgtttgttaccatgtgaatgaaatagcacatcagctgtgcatttaaagatctggatagaagtttgtttcagttatttgtttgttttgaggtacatttacatacagtgaaatacatagcttttaagtacacagtttgatctgtgttgactatacttacgtaacccacagctctaccaaaatcaacaacatttccatcatgcgggaaagttctcttattccccttcccaataaatctttcccacccagaagcaatcacagatgtgatgtctatcaccacacttggttctattctaggactttgtataaatggaatcataccatatgtactcttttgtgtctactttgtttcacttagcataatatttttgagatttatccatgttgcagcatatggccatacctttttcctttttatgcctgagtagtgttccattgtgtgaatgaatatgccagtttatccattctcctgtttatggacacttggaatgtctaaaagctgccatgaaaagccttgttcaaggctttttgtggacatatattctcatttctctaggataaatgcctaggagtagaattgctgagtgataagagtgatgcatatcttttaagaaaaaaactatcagagttttcacaattatccattttacacatccatgcaatatatgagcattctgattgttccacatccttgccaacacttaatattatcagcctttaaaatttcagctattctatttggtgtgtttctcatgtagttttaatttgcatttctctgtaataatgttgattgccttttctaagtgcttattggctattcacctatcttttgtcaaatgtctattcagatgtttgccctttaaaaaattgtgttgtctttttattgttaaattgtaggagttctttgtaagatacaggtctgggaaatattttctcccaatctgtagtttgcttattttattgagattgtcttttgataatgagttttaaattttgcagttaaatttatggatatttttctcttatggttattgcgttctgtgtttgaaggaatcttgccttcctcaaagtcacaaagatttatcttatattttcttctagaatatttatacttttaagttatacatttatgtctatgattcatcttgagttaatttttatatacaatatgtggtaagattcaaagttcttttctttttccacatggctatctagtcattccagctcaatttcttgaaaagatgtttctttttcaattgaattgctttgatatctttgttgaaattgatttggccatatatatgtagggctacttttgggctttcagttttatttcattgttctgtttctattttatttcactaaaaccacactcttgatttgtatgtttatagttaatcatgaaattagatagagtaagtccttcaactttgttcttctatttcaagaatgtttgggctattctaggtcctttgcatttctgtataaattttagaatcagcttatcgatttctacaaaacgtcttcagaaattttaattgagatctattaagtcattagataaacttgaaaagaaccaacatcttaagaatattgagttttctaatccttaaacatggtatatattattattattattattttttttttatactttaagttttagggtacatgtgcacattgtgcaggttagttacatatgtatacatgtgccatgctggtgcgctgcacccactaactcgtcatctagccttaggtatatctcccaatgctatccctcccccctccccccaccccaccacagtccccagagtgtggtattccccttcatgtgtccaggtgatctcattgttcaattcccacctatgagtgagaatatacggtgtttggttttttgttcttgcgatagtttactgagaatgatgatttccagggacatggatgaaattggaaatcatcattctcggtatatattatttatttagatcttctttaatttctctcaacagtattttgaggttttcagtatatatctcacatacctttcattaaaattattcctaagtactttctgttttgggaagctattttaaatagtattttaacatgttacattgatgaattctttatgtagaaggtttttttttgaagattatagaattttatgtatctaccaggtttgctaatttgttttagtttatttatatctttgattaattatagccttgtaaaatattacttaatattacatactggtcatttcctgttctgtcttgcagatgattttatagctgacatcggtcaagaactacattatggtgggataaaattttaatttactagagtattatagtgagggaagttttttctttcttatggagagtttttattatgaatgctttttaaaatgctttttctgcatctatttagatggccatttggtttttctccttttaatctattaatatgttgaattatattgactaattttaggatgttaaacagcctttcattccagggttaaacttcacttggccgtgatatattattattattatgtatgtgtggatacatttgagtttttaatgttttgctaatgatttttgtgtttgtgttaatgagagatattgtcattaatgttcttttttttttttttttttttttttccccccctctgagacagagtctcgctctgtcgcccaggctggagtgcaatggtgccatctcagctcactgcaagctccgcctcccgggttcaccccattctcctgcctcagcctcccgagtagctgggactacaggcacccaccatgacatccggctaatttttttgtatttttagtagagacggggtttcaccgtgttagccaggatggtctccatctcctgacctcgtggtccacccgcctcggcctcccagagtgctgggattacaggcgtgagccactgtgcctggccctaatgtttttataacttgcttgtttcagtgtctgggcaacactggccttttaaataattggaaatgttctctcctctgtttctcagagaatttgtggaggattttactattttctttctcaaacatttagtagaatttgccagggaacctctccaggttgggagagttctttgtgggaagtttgtatttatgagtgaaatttctttaattgacacagggctattcaatttttctatttcttcttgggtaattttgttcttttcagtctttgaaggaatttgttcatttcctgtaagttgttaaatttattggcataaatttgttcatacaatttccatattaccttttattgtgtctttgtaggtttttatggtagcatctttatagagatataactcacatataacacagtttaccatttgatgtatacaatccagtgtttttaaagagatttagctatacagctaattttagaacatttttatcaccctaacaagaaatcgtggtgccataccagtccttcccaccctatttacccagccttaggctaccactcctctcttttcagtctttgtagatttgcctattccagactttttatataaatgagataatataataagtggtcttttgagactggcttctgtcacttagaataatgtttttaaggtttactatgctgctgttaacattcatgtacaaatgtttgtgtgaacacacatttttatttctcttgggaatatacctaggggaagaatttctggatcataacgtaactctatatttaagcttctgaggaactgatggactgttttccaaaataactgcaccattttagactttcaccagcagtgcaggaggatttcaatttctctgcatccttgctaacacttggtgtcatctatcttttttattacagccatcctagtgggtgtgaagtagaaactcattttgctttggatttgcatttccctgatggctaatgatgttgagcatcttcccatgtgcttgatggccatgtgtatgtatctttcttggggaaatatccattcagccttgttatcctttaatgactgtagaatctatagcaatatcccttctcactttcctgatatcagtaatcttcatttctctcgtttttttcttaatgagtctaaataggagtttataaattttattagctctttaaagtgccgacttttggttttatcatttttctcttttgtttgttaattttatatttcatttctcctttttactacttcattcttttacttaccctgagtttaatttgctcctcagattatttagatcaaggatctaaatttctaccttaagaaactagctttttctagcatatgatctatcctagtcaacataccatgtgaacttgaaaagatcgatgtattgatagtagcttttactttttctctatcttttttttttctgatactattgattgcttagaagaactgctttaacatagatttccaaactctatacccataaaactggaataggttacactatacccaatttatagataaaaaaatgaaacttgaggctcagaaaggtgaaatagattgctggtctgaaacttacctagagatgaaagttaggtagactccactgcttaggttggaagaatatgcagacaggaaaccagtgggaaggggacagtacaatgtacctgcagacctgattattccagtatagcaaaagcattctgtctcagcctgtcacactttgataagatatatttgggggaatatcatgagtttttggcttatttgttaaacacctggatttttatggtctaactttagttgttgactaagcaaagtatttgttgactaatgtgactgagttgtgaaacgtctcgaaatggcatttcaattgtcagtgaagggggtggcatagacatatgattccttcatatccactcaactgagtctggcgtctccttgaatgcaggcatgcggaatgtccatgtgcctggcatcttggcggtggtcagtaaatgtttgtcaaaaggagctgaagtgtataccgtttctttgacttcttctgtgagtcaagcaccaggttcatctgagtgaaaaaatgcaatgtggatgagactgtgatgtgtcctgtacactgaaagagatcttgatcgttactaaatgggtattaaatgaggcagtgtggccatgacagaaatatgcaagaataaaagaagtgttgtagttcgcagaactttagagggggaaaatatgatttatttattacttgtggaatctcttgatttgatacactggtggaacatagcattatagtcaaagcagcagtgatagcttggcttgtgtgaaaacaaggtaggatttgtaataccatctgatattcttctccgagtttcagattcagaaagaacagtatcaacatgtaccgagcaggggaaacaatataggaaagatataaaagaaaatatgcaatccttgaccaatgtaaataaatgggaacttttgatttatttgtcatgtactcagattgatgggtttcgtagtgaagtaaatgtgtgtgcatccctggttcaggagagagtgttttgtgtatcattctagactactccagactgacatttcaaagcaacgtatcatcagtgaagtatgtatttatcgttagctcttgaaggatttttttttttagttgatagagtcatgtcttagtttctcaatgtggagaagctaaaactgtgatcctgtttctcattttctctctcaccacataggaaactatcctggtcagaagctaccccttggttgtatcagtttgctagggctgtcacaacgaagtaccacaaactgagtcacctaaacagaaatttgcaatctcagttctggaggccaaaagttcaagactgggatattggcagtgttggctcctaccaagagctgccaagaagaatctgtgccacacctcttccttagcatatgttgttggctgacaagctttggcattccttggcttgtagaagcatctctcccacctctgccctcatcttcacgtggtgttctacctgttgtatgtctccaagtccactcacactggattagggacccacactactccaggacaaccttaattaattacatttgcagaagccctacttcaaataaggtcacattttgaagcactgggggtggggacttcaatatatgaattttgggggacatgataacatgctgcttataggtggaaaataatttctacatatttattaataaggaacctctaagatgaacagatttggaaatctagtttatcttcagtttgttctaagcatctgtgtgacctggaataaattacttcattatcccaacctcagcttcttcatctgcaaggtggaagaggtgatacttgctctcctatgttatagagtcgtagtcaattataacaatagctgctgccatttattgagtggtaataagagccggcactatcacaagagtggacaccttttacaggctaggaaacagtggcacaaagaagtaaagtaatttgcccatagccaattaagtggcggagccaagattcgaacccaagaagaatggctacagtgccaactctttcaaccagggaaccaggagagcatcactatataaattctgtgtaaagtgcaagacacaatgcaaaagttcgttgtcactaaaaggagaactcagggcaaagtcttgtccttcccacttctaattctttttttcctactccagtgtttatcaaacttttcccccttttagaatacttattggaaacccatacaaaactcatatctcctctgatgtttttgaaatttcagaacctgcatcattattgaagtaaatccaagcaatcagaatttgaaaatctagctttccaaacggcctcagaggcccccaacacacacatacacatacacacacacacacacacacacacggacacataacacacagtgtgttaactcagtccttcctgccttcagtttctgtggtacagccatgatatggcttggctgtccccagccagatctcatcttgaattgtagctcccataattcccacatgtggtgggagggacccagtgggaggtaattgaatcatgggggtggatttttcccatgctgttctcgtgatagtgaataagtctcacaagatccgatggttttagaaagggctgttcccctgtacgtgctctcttccctgccgccatgtaagacatgcctttgctcctcctttgccttctgccatgattgtgagggctccccagctatgtggaacagtgagtccattaaacctctttttatgtctttattagcagcatgagaacagactaatacaagccataaaaggccaagatcatcattcctttacctacattctttttttgttatttgcccttgcttttcatcatgcaccacatcatttatgtaactaaaaataccaacttccaggccaggtgtggtggctcacgcttgtaatcccagcactttgggaggcggatgcgggtgggtcacctgaggtcaggagttcaagaccagcctggccaacatggtgaaaccccatctctactaaaaatacagaaattagccaggagtgatggcatgtgcctataatcccagctactcaggaggctgaggcaggagaattgcttgaacccaggaggtggaggttgcagtgagctgagattgtgccattgcactccagcctgggcaagagtgagactctgtctcaaagcaaaacaaaaacaaacaaacaaatgaaaaaccagcttcccttagattcccccatgagtttctgactccactacctaattcaataaaggcatttttaagaaatataaatcatatttattcatggttatatgtacatgatacaaaacatttcacagcagaaatggactcttttttaccccatcctcaatcaactaatttccttccctataaaaatctattatttgttttgtgttgtgtgtttcagccagagatactctatgcatgatgcaaacatattagcatccatatgctactttcatctaaaaagtagcatactctccacagtattctaaacctcttctttcacctattaagatatcatttctctattgtaagacttaaaatttaatgtagtgcctttgagcccaaaagtcttgagtttccctacttctaccagatattccccccaaccttcccaaagagaaaggctccctacttaaatggttcctctatcatctgggcctgctgggccgtacccattcctcaacctaacaggtttcacctcccggccagcccatgacattagtcacatcctcctgtaggaacctgaggacacctctcccccttgttactacatagccggcctcccacagcccttgtggtttgctctgctgtggactgtagcccctgtatggtgaacagtgtcctcctcccccaggctgcaagtgtatgtgactagtaaaccacgatctgtctcttttaagtggtgtggggtgttgtttgtctgaccttctcatattatttagggcagaggatccacctttaccaactgggtgaataggaggtgattagaactagtccatattaccacatagagcaatcctttgcttttcctaataagtgcacagaactctatagtatgaataggaaccaatttacttatcttgttccctgttggtagacactgggtttttactctttggttccacagcaatgctctagtgaattttctattccacattttgcatctgaagtcatcttgcatctgaaggagtaaattattacaagtaaagtatgggtcaaatgctatgcacattaaattttaataaacattggccaggcgcagtggctcacacctgtaattccagcactttgggaggccaaggcgggagtggatcacctgaggtcaggagttcgagaccagcctgaccaatatggtaaaaccccatctctattaaaaatacaaaaattagctgggcgtggtggcatgtgtctgtggtcccaggctactcgggaggttgagacaggagaactgcttgaacccaggaggtagaggttgccatgagttgagatcgtgaaactgcactccaggctgggcacagagcgagattctgtctcaaaaaaataaaataaaaaaattaataaacattgccaattgcttttcatagaatgtgtaccaatttagacccccacaggcagctggacagtctatttccccacatcctcatcaacccaggacattaccaaactttctgatcttggccaaggggagaggtgaaaaatgtcaagtccttgtggttttagtttacagttttacaagaagtgagggcaagtgtcttttcatatgcttacaagtcatttgtatttctggcctttctcttattgactcgaggaagcttttcctttattgaataaattaccactttttctatgatatgaagttgaaatatcacttatcatttgtctttgtttatagtaggttttgctgcctagatttgtattttatgttatcacatttaccttcttttgtggattctagtgttggggttacatatagatgcatcttctccagtctgtgtaggagaatctcattttattgtgcgttctttgttgtgattcacagatatcacatttttttacaaattgaaggtttatggcaactctccattgagcaagtctatcagtgccattttcccaaaagcatgtgtttactccatatctgtgtgtcatattttggtaattctcaaaatatttcaaactttgtcattatcattttttcttttatggtgatctgtgatcagtgttgtttatgttgctattataattgctttggggcaccatgaaccacacctgtataagatggagaacttaataaatgttgtatgtgtactgactgttccaccaactggccattgcacatctctctccctctcttcaggcttctttattccctgagacacagcaatattgaaattagaccaattcataaccctacaatggcttctaagtgttcaagtgaaaggaagagtcatacatctctcactttaagttaaaagctagaaatgactaagcttggtgaggaaagcatgtcaaaagctgagacaggccaaaagctagacctcttgggcaaaataattagccaagttgtgaatgcaaaggaaaagttattgaagaaaattgaaagtgctactccagtgaaaacaggaatgataagaaagcaaaacagccttatcgctgatatggagaaaattttaaaaggtcaatgcctggcttcaaaagacaggctgactctcttgttaggggatagtgcagctggtgaagccaatgctcatttaccattccaaaaatcatacagcctctaagaatgacgctaaatctactctgcctgtgccctaaaaatggaacaacgaagcccagatctgtttacagaaggatttattgaatattttaagaccactgttgagacctactgctcaaaaacaaagattcctctcaaaatattgatgctcactgacaatgcacctcatcacacaagagccttatgaagatgtacaagaatgtgtaatacaaggcatgttgttttcatgcctgctaacacaatatccattctatagccctggagcaaagagtaattttgatttccaagtcttattatttaagaaatatactttgtgaggctatagctcccatagataaggattcctcttggatctgagcaaagtaaattgaaacactcctggaaaggattaacagttccagatgccattaagaacagttttgatttctgggaggaggccaaaatttcaacattaactgtagtttagaagcaattgattccaaccttcatggatgactttggaggggttcaagacttcagtggaggaagtcactgcaaatgaggtggaaatagcaaaagaactagaattagaagcagagcctgaagatgtgactgaactgctgtgatctcatgataaaatttaaacaaatgaaaagttgttccttatggatgagtaaagaaagtggtttcttgagatggaatatgctcctggtgaaaatgctatgaacattgttgaaatgacaacaaagtatttagaatattacataaagttagttgataaggcagcagcagggtttgagagattgattccaattttgaaagaatttttgtgtgcatgtggaggtaaaatgctaccaaacagcattgcatgctacagagacttatttcatgaaaggaagaatcagttaatgtagcaaacatcattgtggtcttattttaagaaattgtcacagccaccccaaccttcagcaaccattatcctcatcagtcagcagccatcaacatcaaggcaaaacctcccaccagcaaaaagattacaacttgctgaaggctcagatgatccttagcatttttagccataaagtattttaaaataaggtatatacattgttttttagacataatgctattgcacactcaatcaactacagtataaacataattttatatgtgctgggaaaccaaaaaattcatgtgacttgctttattttgatatttgctttattgtggtggtctgaaactgaatgcacagtatttctgaggtatgcctatagttgcattaaaaaaaattctcctgatgttattgtcaagattttaatggcttcacttttacatttaaatatttgattcatctggaatctatgctgatataaggtatgagataaagatctataatttgtttttacagttgattatttgacaataattcttttttccattaacatacaatgtcatatttatcaaatactgagagactgtttctgatctgtgttctgttccatggatctgtctcttcatgcacaaaaatgagaatgttttaattattatatatttaaaatgttttaatattgattattatgtatatttgtcttttccttattcttgtttattttgttttccaaatgaactttaaaatcatcttgcctatgactccatgaaaaaattatattgctgtttttggattcttgaaaattcatatactaaagtaagaagaattgaatctttaaaatgacaaattttccaatcaaagactgtgacatgcatgttatttctttaaaggtcttcatgccctgatagtgttttagagtttagtttatatagctcttccacatgtctcattacatttattcctaggtatttaaatagtagtctttccttcctttgagactttctgactagtggtaatttacaaatattaaggctgctgatttctagatatgagcttcccccagccatctaattaaatgttttattattctaattttccaggtgtacagtgatatcatctttaaatatgatgattttacttcccttgcttcaatttttgtagtccttacgtctttctcttgtttattttgggttggccttcagaacgatgctgagtaaaggataaaggatgtcttcatcttattcttgattttaacaaaaatgcttctgtagttcccctaccgcaaatattgagtatccatgatgttctaggcaccaggatgtagcaaatacaactgtccttcaggactcaactcaaatccaccttcttccaaagccccctgtgatcatctcaaacagaaattgtctttgcctcctccaaacttcatattttccttccctttactgtcctactttttatcttgctttagaattatcagtatacttgtcttaaatagtccactaaaaatcggtatgctcagagaaggcaggatctttgacaaatcatctagtcatcctcagaactctgccttgcccacagcaaatgctcaacacagtcctgcttaattaattataaattagttagtatgaaaatttgttcaaatatatttgagcaaatactaagtaagcatctgctcagataaaaatgcaggattctcatacagagcacttggccatgagtaataaatgtaagtccggctctcaaaatatacatgtattcctatttggcactagccaaaagggggtgcaatatttacctttaaattattatagagagaatgagctagaaaggaaaaagccagttggagccagaaagcttggagtctttgaacctccctcagttctctaaatctagatgaaatgatatgaatcatcaagtcatttcatgccttttacacttcactttaggatctttttctctaaaaagcctctctcaacagggataatagggtgagtggccttagtatcagtgtttggtttctttgcgatgtgtaattggttttagctagtgtggaatgtcctcttgattttaaattcctatttttagctcctctgtatattgtgttatgtgttcactgttgctccccacacccctccttgcaagtctatacagaagcatttcatgtggaaccggagctgttctagggaagcctgtcatcaaggctgccctttgctctgcacctccccagcaccctcagaggtcagagcgaggctggtgtacagggcagtggatgtgagagcttgaatttcttgccaccttgttacaagccaaagtaggaagaaagtgtatccagaccaggaaacatgatttgtaatcgtggttgcaaatctagcaccctaaacctagcacaccatttggcacatactcggctcttaaatgtccatttaatgcatgaatgactaagcagataagtgagtgagtggatacatatgtgtcttattgggagacggctcatgaactgacattcaccatgggcttttctaagtttttcagtgggatcaatgttggtagtttgtatatttgcacttggtttagaaaactttcctttacctaatcctcaggcgatactgtgaactttgggttgcttacttgataaatatagttttattattaattcatgcatttgaaataacacatgcattgaaagcagcagcaaatccttttaagctctgtgctcttttaaataggttctttctctcatgctcaggaaaaaattcagtggagatgatggcaacagactggtccctcaaatctctggccatagcccaaggaggagagaacccacaattgcaggccatatgtattgccctgtatgatcagtattaaactcaaagtatgtctttgtaactagagacatattctgggtagtgtggctgttagtttgtcccaatctttattttaaggcactatccacatctctttctcttttcctttgcccctaacattgatatcaactgagttttcagggtgccagctgcccatgtcagctctttgagagagcagcctctctcctccttctgcctctcaatcctttcctctccgccagctcttctcggcatgttggtcattcattattgatgaccctccagcaccttctccaccccggtgttcccatagccctgtgcactgctgagcagagccaggtgcaggatctagtcggggtccaggactgctgctccaaggccgccaagactctttcccttcctggctgtcagagaggatgcctggcactagagatacagcagcagcggcgtcagccgctggtcttgaggagggtttgtttctctcctctgtcttctaggaagcaaaaggttaaactgttcattttaagagcctccctgggtataaaatactgagctttgtctttctggagtgagccgattcctaggccccttgacctttgctccaacatgtctgctgcccatcccttagagtgtttttctttgctttctatttagtcagaaggaatgaggctagtgtctgccgttagcttaattattggggaaaagcgttggaagaaaagaaactgattctctccatttttctaattgttacttaaccaagtcttgacaagatacaatttggtggctaatatgcatggagtgccctttctgaaagcagaggctctgcttgtggattctgcagtgaaggctggagtcacaccttggaaatgactgtccaccttcacatttgcacacatcacttacacacatggagctccttccaccaccagcctcccctgagccttcataagacacaggctgctgctttaaggaacattaacaatccagacccttccagggacccatgtgactccagcttctcccacaatagtcagaaatcgtaattgagagttcagaattcataggtaccaggataatattgcagaaagataatcaggcacctacttcccagttccctgaaattaaaacaggtattcatcttgtcagaataagaaaacagggtcctgctgtgttccagccacctggcaaccttgttcttagaatacagaaagggagggaagcaatgtgtgcgatcactctagccgaagaatgtagagagaagcgaagaccatttttttagtcctaatttcctacaagggacaatgcacctaaagtttttcaagccttgctcagaatcatctcacaaaaggaaaggccctttgcttcacaaaatattttaatgaaagcaaaacagtgactaagagcctcatgtactgctggttctgcctgtttcaaatcttgaaaggcctttaataacctccattatgtgactatgtgatttttatcacacaatctcagattcttacattttttaaataactcaccagcaagaaccaatgtcagaactaaatgctaataagatttggcctgggagagtaacatagtaagattgttaatgtttaatgcactctcatcaaagtgggataatcctacggctgaaggttaagtgagccttttgtaaaaaaaaaaaataatagggaagaaaacattattgtagcttttccattttactcagtcaaatgaattcaacataaacttgttatagccaagcccaggctagacatttcctggtgatctggtaatttcccttgtattgttcatgtggtttgtctctttcctcttcctctttgtttctaatgatgatgatgaacagcatctctgcaataggccacattctcaaagtgctccattcattgtcacttgaaaagaccactgttgggttttattgccatcattgatatacaaggataatttacatacaaaattgtggtttggttttagagccatggcaaccagagtatcacttctgatgggaaaaggaagaatggccttcagtgatggagtaggcaattgcaaagagttctgctcccagttctcttgctaaatcaaaagattgcaagggtcaagatcgatttcttcattttctttaggcagcaatctgaagaggccccagcagaaaactccagccttaggatttctggtaatcagaaaaagaagcaactgttcttgggtaacatgtggtgcccataaaagggcatcagctcttgggggcagcctgaggttaccaggttcacctttgctcattctgcgcaaggatcgctcccctcagagtttctgcaggggaatgtgtactctggtgttcggtattaaagcttctacatgaatttatagagttgcttacattggctgagaaattgttttttttttttttttttggtactcagccctaattttccctggcaaatattgctctgtaactttgagatgaatgtacccatcaaaaactccagaagaaattctcatgcagttctattattgctcatcattttgccaaggaacgttagtaaagagagctatgaagtggctaaagaagttgtgttttttgtttgtgtgtttgtttttccttttcatcgttttatgtcttagtaggagaagaatccaagatgaaaaggacaggctctggttttagctttgccactaatttcgtgtgtttccttatgcaagtgtccagatcttcttgggaattaatttctttatttgtcaaagggagctaataatacctgccctggccaacctgtaacatagttatgcgtaggagtaaaatcacagatgtgaaagtttgcaaaattctaagatccttaggtagctcatgcgtcgacaggagtaatgaattatacacctaccgcaaaaggtgattgtggggatccagtgtcaaagggcttagaagagagtgtgacacataagtagcatttggggatggtagctggaagaccaagcagcaagggtgttaccatcaaatcccttccataacccctctcccatacaaagcaaaggggtctaaatagccccagtgctcacttcaatgctactcatattctttggctttggagactttgcttttttggagcccctcattcctactttccagacatttgcagaattcagctgtgctttctaagagattctctggcattaacacagaatgaccttgcagtgggaatgaccttggagctgcagcgacttgagtttaaattctagctctgccccttactagctgggtgggattgattccaggtaactgtcagtaccttgtgtctcaacatcttcagttggggatagcgtcctaccatctccctcatagaggagttaacgagttgaaatgacacagatgctacagtcaggagatgctacgtaattttctgggcccagtgcaaaatgaaaattcagggccccttgttcaagcatattaagcacttcaagatggcaacagcagagcatgaaaccaaggtctaggtcttctgagctcagggtcttgtgcaactgcataggtcacatgcccttgaagcccaccctggccactgatcccatagtggcagcttgccacttagtgggcactcagtagagaccgcttgcttttctttcttcctctttctctcttcttctcttgatagccttaaatccctgggagggggggcttgcatttactcttacacttcctgccacagtttctccccttatgatcgttccttctgctggttaaattgccgcttctcttttgcccctgaaatcagggagccaagtgattaagagaagctagcttatctacacgagcctcccatctctatgtctgtatttcccaagttctttcaaagataacccaataaaataaagaactaacagcatcatgatacatacaaaggggctatggtgtatgtgtggcaggctggggagtaaggatggagaaggtattttgaggcaaagaagaaagaacaaaggaaaatgaaggtattagaagataaaagcttgcacttcacagaagatattattttgctgccatgtatctaagcacaattgaggcagattagttgtaaaatcacctcatttacttttcccagcttttttcagccactttcactaaatcaaccaaccaaaccttttctgtgcccttatgtcccttgtctctgaacttcatcaactaaatatttgttatgcattattttattcagcattcacagtatctgtgggtttgggtatgctacttctttcttcattttatagagaaggagatgatagagtaaccgtccatagttactgtgttcattggaaatgttttgtctccaagtagcagaaagcccaacttacagtgtctgtgttcggggttggaagttggggagaggttcctcctaatgagatgcttggaggcagaccaccgcctcaggggttagacagctcactgacatcctggctcctgtctgctgctctcttggcttttccctcataatcacaagatggctgctgtgggtccaggcatcacaacatggtcaggagaagaagaaatgagggaagaaacagtatccagcctattgttgtcttttcttgggaaagttacactttctcaggcatccactggcttacagacttctacttatgtctcattggccagaactgtgggagtttctagctatagaaatggcggagaaggtgagtgtttagcttttcccgcctttttcctggttgggggagacagctctagagtgaagcacacaacagtatatactttatagtgacaaagatagcaaggggcaaagacagaacctgaacccaggtcctctaatcttgagtttagagattttgccattctgccacattgctcttcttttaaaaatactttcagcaacatccagcttgtccacttcctgctgagacaagccaacaggtataactccaagttatggaaatttaaaacaggaaatatgtttatactatgccttcccttaaggttcctgagagagaactttctacaagttatgtaaaacagagataatgtggcttatagaaaatttattcctcacatgataaattctgtgcatgtgaagtttcgtagaactcactgtagcgcatttagaaacacacgaccagaaattgtgtgaaacattgctttgggatggatggtgcccgtctgaccttaagctatccttcccccactctgctgctcttcaaaccacagccagtttattttttggtagaaactatttacgtatgaagatcgtatttggatgcctttagtaatttattaaactcactttcctaaagcaagatcagagtttaaaacatatgtaaatatcagctgagagattagaaacaaaagccaagaaggaatttctccactgcaattaccacatgcagttaccatggcagggaagctgtgcgggataattcagtccaaggtagagaaataacagagtctggaaatgtaaatatgtttctgttagagatacttgaaataacgtttacactggcttcttcctttttagctatgggatattgtgcaaaacttttttgttgtgttttctttaaatgctccgggcagtaaattggaagtatatagcacctgctacatgtttagtcagtagtcgaaacattgaataaatcatgaaatctgtaggtgaactgaataatagctgccctggagagaactgtaattcactgttgacaaaataaatccccctgcatttttctggggaatcttttatttttagcaagagtgtttgatactcctaagttaattagtagttttaacagagtggaatgttattgaacctaccagtgttgtttaagagctaatgtttatgtgccaggcgccagattaggtaattttataagcatagatcattacattctcgcccagccctgtagggttcctagctctgcttttccagatgaagagccaagacccttagaggttgtaactagtccagagccacatgggctaggaagaaaggaagacctttcaccacttatttacacaagtaagttcttcccaggcagtgtggcagactcagcagattggcccacttaactcttgttccacccccactctatcttgtctacttctaccacagaggccagaaaccacaaatccccagcctcctgtggcttggcttggggtagcccaaatacacagttctgtccaaccatgcataggcagaattccctggggaacatttctctctccccaagtaggtaaagcttctttgccctttaccgtttgttgttccttttcttccttcatggaaagaagagtcactttcaagacatgcagcaaccaccctctaacaatcagaaggaaatacatggttaagattgttgaaacaagaagtaaaagaagtcaagttgcttgacgatattctcttttgtctttttattttttttattttttaaattatactttaagttctagggtacatgtgcacaatgtgcaggtttgttacatatgtatacatgtgccatgttggtttgctgcacccattaattcatcatttacattaggtatttctcctaatgctatccctcccccatgcacccaccccacaacaggccccagtgtgtgatgttccccaccctgtgtccaagtgttctcatcattcgtgtcccacctatgagtgagaacatgcggtgtttggttttctgtccttgtgatagtttgctgagaatgatggtttccagcttcatccatgtccctacaaacggcatgaactcatccttttttatggctgcatagtattccatggtgtatatgtgccacattttcttaatccagtctatcattgatggacatttgggttggttccatgagcttgatgatattctcaaatagattccctagccctaggctgcctgccattgcattccttattacacaagaataatcatctcttattgtattccaatcattgattggcattattttttttctgcatagcaaaatacatggccaaatcagtaaacctgaacttctcaaagtggccatctggtagctactagcttataaactgttccctaggtatagagaattgaaagcaggtgaagtgtgtgtgtgtgtgtgtgtgtgtgtgtgtgtgtgtgtgtatttcacatatcactcaggtcaatgttcctttgaaaatggagaatgcaactctattaagataatagtgtaaatttggtaactgatcacttacagcaattacaacaaaagatgcaaaagtcaggcagaactgggttctaatgctggctgtagcactggttggttatgtgaccttgagctcattagttagccttgcacacatttcctcatatatgattgaggataagagtagttttatctcatagagatttgaggggcatttggcacaggatcaggcacaaagtaagcactcagtggtattgctgccaataataataacaataataataataatagaattatttaagacttgcagattgagggaatttgatgaaatatataacaactgaggttaaagtgttctaattttctgtctagattcatcttttatggtccctttttaatctcacaccagtgtccttccagaattaaaaggtcaatgattttacttcctagagaagcttccttaggggcttatgaatggtgaaaatgtgcacgtttgcctcgactctctatttccattgtcgaaggccttcgcaaatttacctagtgattctagccaagtgcttcctgacattcttaggggctcgaaggtcaatacttgatttggattttttgttgttgtttctttttccctccagcctcctgtgttgtgttgatttgtaaaatggccattgtaaatgttaaaatggaaagaaaaccgagtctgttataagctttgatgtagtaaaaacagcatggagcatcttaaattttaagatgtcatcagaaaagaagctcttcccagtttcctcttgaaaatcattgtattagtcagggttctctagagggacagaactaataggacagatatatatagaaaggggaggttattaagtagtattaacttacacgattacaaggtcccacaataggctgtctgcaagctgaggggcaaggaagccagtccaagtcccaaacgattttatttgacaaaagacaaaaacagaagttatttacaatagtttttgctcaaataattcagtgggggcaactgtacttttcctccaggtttatcttataaccaaacccaagcagaggctgccccaccccaacaccccattttacacagctgggaatgccaaccagaattcagcagcgtggctccctcacccctcaccaccctctattgctcagtgtacagtggggagggaaagatcccacctcagcccaagaacttggagctgaagaacttggaatctgatattcaagggcaggaagcatccagcacagtagaaagatgtaaggtgggaggctcagccagtctagccttttcacatttttctccctggtttacatgctggccatgctggcagctgatttgatggtgcccacccagattaaggatgggtctgcctttcccagctcactgacttgaacgttaatctcctttggccacaccctcacagacacacccaagatcaataatttgcaccctccaatccaatcaagttgacactcagtattagccctcacaatcataaaacagaaaaatgagtgaaaagcataaattttgctttcaaaaagctgggagattctatatccatgaaccacaatatatgacgtaaggctggccaaatgcagtggaacgaaagctcaggaagggctaagagacaatcactatgatcaggttatagattttgacaaagcaagcaaaaaacacgtctccaaaactggtacttcagagcaggcataccctaaaggatgacgccaataagcctttgtttggaaaatggcaagggtattgcaagactggaagtagaaaacctccctggaccctacctgctaccatgtagtagcaaatgaaactgaaagggaaatgcacagtcatcctgtgtgtataggaagcagtccattgttgtggcactacggcagcctgttggccgagaagaagcagtggctaaaataactcatcagcacacaaccctttgtaataagacttaacagtaaatcaggtaaatttttaccaactcacaacatcctgactcctatcccacaaaactgtcctctaaatatctgaatcaagaagtttccacattcagaggaaagtaacaataaaaaggaaccagcacaggatattgtaatatgccatacatgacactacaaagatattataatataaaaggagaaaaaactggaaaatagatggtaaatgcagaacactcactataggtgattccaacagacaaatcaaaagataacattaccatgatcttgacgacttaaagaaaccaccaaagagctcaaaacagaaataaagaggtcaggggtaatatggtgacgtgagaagagaagaaacatacactgatgtagctctccagagaactgaagggggaaatttttttttttttttttgagacggagtctcgccctgttgcccaggctggagtgcagtgacgtgatctcggctcactgcaacctccacctcccgggttcacgccattctcctgcctcagcctcccaagtagctgggactacaggggcacccaccaccatgcccggctaatttttttgtattttttagtagagatggggttttactatggtctcgatctcctgacctcatgatctgcctgcctcagcctcccaaagttctgggattacaggcgtgagccaccgcacccggcctgaagggggaaaatcatcacagatatgaagatgattttgaagcagccaaagtaaaatagacactagacactgccgaacatagaatagaggatatgatgggcaggattatcaaagcaaacaaaacggaaacaacagcttaaaagtattagaaagaaaatagtatatttgggtgacgaggaagatcccagagatacatcacaatatatccctgaagaagagaattaaacaaatgaaacataaacaaagatataattctacgtaactttcaataaataaaagatttgaatttatagattgaaggagtctactatgttacagaaaatttgctaaagaacaatcaatactactctgtattatagatgtattgatagatcttggagataagaatgatttggtcacaccagcaggaatatcaagtaacctatacaagaccacagtttaaaaaaaacctcaggctaacctaagccttccttacagcaacattccaagattgcagagagtaatgcccatgaagccctcagtgaaaaagtatgtggccttagagttttatgcacagccaaactgtcattcaaatgtaaaaacaataaataaaacgtgtccaacatttaagaacccagagaagatgattcccatgagttattctttaaaaaactattggctgggcgtggtggctaacacctgtaatcccaacactttgggagactgaggcaggtggatcacgaggtcgggagatcgagaccatcctggctaacatggtgaaaccacatctctaccaaaaaaattaaaaattagctgggcgtggtggcgggcacctgtagtcccagctacttgggaggctgaggcaggagaatggcgtgaacccgagaggcagagcttgcagtgagcagagatcacaccactacactccagcctgggcaatagagcaagactctgtctcaaaaaaataaataaaattaaaaaataaaaaataaaaaactattaaagactttatctaagagatgaatgaagaaaccatggcaaaaggattttcagtgaacactgagtctgttttgcttttagactgggtctaaataagtgcagaaacttttgttatagaaaaaaaaaactaagctctgaatgttcataaatattttaactaatataaggataaggtggaaggtggtatgtagattcattcatcatctcatttaaacatgataaatcaagtatatttaaatatacttagcatacttactaaagtatattagtaaattaatatatttactgaagtatattagtaaattaatatatttactaaatatactaagtatatttaaatatacaaaaataagtgtaggaatgaacatatatgttagtttgaaatatatatgtaatatataaggtacatgtttaatatgtaaacatataatatatattaaaccaatgtttagtgcctattaaccaaattcaagtgatagaaggaagagaaaataaagaacaatttgtattgcttttagtggaaagtaaaatgtcagtgtttcaagaaacagagaagttaaatagctaaataagggttagttacaaaggtgatcactggaaaaattaaccataatacaaacctgcccaaatagcacaaggaatactcacaaaaagaaaatatagaccaaagagtagaagatttttttaaaaaagcaatagaaacagaaatcaaaatactataaagtaagaccaaacctgtttctcatatcaacaaataaaagtgggctaaactcccatattaaaaaaaaagattctgaaatcgagtaataaagtaaaacttaaccatatgctataccccatatatacctaaagcaaagtgtctcgcaaacttgaaaatagaaggatgagcaaaggaatattatcaaatgccaacaaaaaggaaagtagaggccaataatcttagaataaaacaaggttgaatttagaacaaaaagcattaaacaagaaacataaagacaattgtgtgataagatgtatcattcacaaggaagatctaatagtcattaagtgtttctgtatcaacgtagcctgaaaagttaagcaaaaactaccaaaaagataaggaaaaatagaaagactttaattataggaggcttaacagacaaaatagacccaaaagatgacatagatggcctaaataacataagtaagtagtaaagttacatatatcaatctatccctgaaaactaaaaatatgtcatcctttcagatgtccataaaacgtttcccagaactgactatactttagaccacacagaaaacctaaataaactccccaaatcagaaatcacactgatattgtcctctaatcactatgagtcaaaaaggaatccatgtgaatgtatagaatatttaaaattaatgataatgattataaccacattacatatcctatgggctcaactaaagcatttgctcaaaagaaaatttgtatacgtaagtacttaaattaatgaacaaaaaataaaggaaatcagtgcatatgtcttctactcacgaaattaaatataagaaaaataaagttaacctcaggaaaatataaggtagctatgataataaaagcagaaaataggaaaaaagaataaatctttaagttagctctttatgaaaaatcaataaatcattagtaaacaaaccaaaatggttgccaataagttattttctaggaaaatataaaattaccaggcatgaccccagatggagagaaaacaacaatctaaggaaatgaattagtatagaagaaatacagaatgtggagaaaaagcaaacctcttgaaagaaaacaccagtcctggaatatttcacagattacttctaccaaacctataaggaaaaaataggtccaatattatttaaaccaagtgaaagcatccaggttatttttctgaagctagcatgcatcatgcatattctgataaatagagcacacaaaaaagcaaactaaggaccaatattgcttatgaatatcagtgtaaataatcctaattaaaatattagaaaacaaatctaagagctcacaaagacaagaatttgctatgttcaaatgggatttagtcttaaaaaagtaagactatttcaaaattcacaactgtattaatttaattcataaaatattgtcaaaattaagaatcactttatcatctccataaatacttgaacaggtgtttgataaaattctctaatcttgatgaaaaactcataataaaatgctattttattatacagacagagacatacacacatacatataccaatacatacttagtaacatggtcccaaagctactgatacaactgctgaagaaagtgtcattaatgtcggctacaaggaaagataccttaatcaatagcattaattaacattattgctccagagagcctagctagcctaagtaaacaaaagaaaaaaataagcagagtaattttaaccaggagttaaaattatcatatatgcagatgatatgattatgtactgtaaaacacaaagaatcacatggaaaaaatagtataaacaataaggaaatacacttaggtgattgagtacaaaaatactactcatgttaatctttccacaaacagaaactggttagaaaatataactgaagagatcccatttacaataagaataaatttaacaagaaatgtgcccaaattacacaaataaaatttttaaatgctactgagaaacatgaaaaatgacttaaacaaatggaaaggcatactctgtttaacataaagatgtcttatctaaattaagttatacaggtaatgcaatgcaataaaaaaaaaaacaatagaatctacaggggtagattctaaagttcaagaacaaataaggaagcccaacccaaaagtttctgacaaaggaaaattaagaaagggggattagccctatcaaatattaaaatgtattgtagtccgggtacctgaggtcaggagttcgtgacctgcctggccaatatggtaaaaccctgtctctactaaatatacaaatattagctgggtgtggtagtgggcacctgtaatcccagctacttgggaggcttaggcaggagaattgcttgaacctgggaggcggaggttgcagtgagcccagcggcgccactgcactccagcctgggtgacagagtgagactccatctcaaaaaaaaaaaaaaaaaaaaaaaaaaaaaaaaaaaaaaaaactattgtaaaactacagaagttaaaatatatatgtctccatatctttttttatttttaatttttatggccacatagtaggtgtatatatttatggggtacttgagatattttgatacagacatacaatatgtaatcatcacattagggtaaatagagtatccatcacttcaagcactcattacctctttgtgttacaaacattccaactgtactctctcgttattctaaaatgtattacaaattgtcactgactgcagtcaccctgttgtgctatcaaatactagatattattcatttatatctctatatcctaacaaccaggaagctctatgtaagtgtctagaaatagaccaaactacatatgacaaattttttatttacatatcaataaaaaaatcagtctattcaaaaatgttattgaaacaactgaatacctctttagaaaaaaattaacaagcacaaacaccataaacaaaatcagaaaatgatatactgagaaaaatcatttacaaaggactattcttttttttttaatttaagttctagggtacatgtgcacaacgtgcatgtttgttacatatgtatacatgtgccatgttggtgtgctgcacacattaactcgccatttacattaggtatatctcctaatgctatccctcccccatccccctaccccacaacaggcccagtgtgtgatgttccccaccctgtgtccaagtgtactcattgttcaattcccacctatgagtgagaacatgcggtgtttggttttctgtccttgcgatagtttgctgagaatgatggtttccagcttcatccatgtccctacaaaggacatgaactcatccttttttatggctgcatagtattccatggtgtatatgtgccacattttcttaatccagtctatcatggatggacatttgggttggttccaagtctttgctattgtgaatagtgccgcaataaacatacgtgtgcatgtgtctttatagcagcatgatttataatcctttgggtatatatccagtaatgggatggctgggtcaaatggtatttctagttctagatccttgaggaattaccacactgtcttccacaatggctgaactagtttacagccccacaaacagtgtaaaagtgttcctatttctccacatgctctccagcacctgttgttccctgactttttaatggtcgccattttaactggtgtgagatggtatctcattgtggttttgatttgcatttctctgatggccagtgatgatgagcattttttcatgtgtgttggctgcataaatgtcttctttcgagaagtatctgttcatatccttcacccactttttgatgggttgtttgattttttcttgtaaatttgtttaagttctttgtagattctggatattagccctttgtcagatgggtacattgcaaacgttttctcccattctgtatgttgcctgttcactctgatggtagtttcttttactgtgcagaagctctttagtttaattagatcccatttctcaattttggcttttgttgccgttgcttttggtgttttagtcatgaagtccttgcccatgcctatgtcctgaatggtattgcctaggttttcttctagggtttttttggttttaggtcttacatttaagtctttaatccgtcttgaattaatttttgtataaggtgtgaggaagggatccagtttcagctttctacatatggctagccagttttcccagcaccatctattaaatagagaatcctttccccatttcttatttttgtcagttttgacaaaggactattcttcttaacatgttaaaaatctcttgaataaaattaaaaaacaacccagtggaaatagatagggcaaataatataaataggtacttcccaaaaagaaagaaacatgatgtaaaccattgaaaaaatgcacagtctcactcacaataaatgtatattaagactactgagagatgctgatttaaaaaaaaaagcctgccagatttcacattgacaaggatcaaaaagtttaatcacacattgttggcaacactgtagggaaataaggtaccctcatacatctttggtggacccatgaattggtacaatgttgattaggagcaaattgccagtatttatcatgcaacttgcatgtatctcctgactcagaaatttcacttctaggaattcctcctacattacacttgtgcaattgtgtgtacttgcacttgtgtgaatgatgtatgtacatgaatatgctttgtcatattgtttgtgagaaccaaagattacaaaccaccaaatgctggccaatatacattcattaccacaaaggtctggtcaatttagagaaagaaatcctatgtccacgaaggatataatctctaagaaaacaaagtgctgacagcatcatagagtatgttaccattattgtaaaatggcaatagtaataattattatataaatatatgcttgtgtatgaataaaatgccctgaaagtatactgatagagtttggatatttgtccctgcgcaaatcacatgatgaaatgtaattcccagtgttggaggtgtttgggtcatgggggcagaccccttatgtcttggtgctgtccttgcaatagtgagtgagtgctcacaagatctggttgtttaagtgtgtggtaccacacactcctccttgcttctgctcctaccacatgaaatacctgctacccgtttgccttctgcggtgactgtaagcttcctgaggcctccccagaagcagatgccagcactgtgcttcctgtacagcctgaagaaccatgaaccagttaaacctcttttcttataaatcacccagtctcaggtatttttttctttcttttgagatggagtctcgctctgtcccccagactggagtgcagtgacgtgatcttggttcggctcactgcaagctccacctcccgggctcacgccattgtcctgcctcagcctgccgagtcgctgggactacaggcgcccgccaccatgcccggctaattttttgtatttttaatagagatggggtttcactgtgttagccaggatggtctcaatctcctgacctcgtgatctgcccacctcggcctcccaaagtgctgggattacaggtgtgagccgttgcgcccggccaggtatttctttatagcaatgaaagagtggcctaacacgtatacattagaacctgattacagtagatgcctcttgggaggggacttaaatggccagggttggtgataaaaagtattttttaatgtatccccttttttatctgttaatttttttatgtgtatatgtattacctattcaaaaagttaatcaattttaaattaacttagatcccaattcaaactccacatctgctacctccagctttgtgacctagagcaaactgcaggccagctgccttctctgtggagcagggactgtcagaactcccccatcccagggtgtgatcagagctacatgagataatcatgggaaagtacctggaaattacatgtaattgcttagtaaatgccctccgcttctttccccccagaattaaagtaagctgcatctaactattacaacttaataaggtgcattattgtgctttgctgtgtttttaattttcttgtcatacctgaatggtttaaacatctggcttccttaaggcataattaagtaaaagagagagcagcgtacatcaccagtcaggtgtacttctttccctgttgtaaaagtgatgctttttattcagagccaagtctagatattcaccagtccttggcacgactagaaaaagatttgaaggactaaagctgctagagcataattatgtattggctgtggacttgagatgcctgggttctgtccctcctgactgtgacttagcagccgtttgtcactggagatgttttatgacttctgcaggcttccacagtatcacttgtgaaatgggaataactatttaatagctcacagaggtgctgtattaggttctccagagaaacagaataggatttacgttatatataacaataggatatagcctagatatatagatatatatatataaggatttattgtgggaatttgttcacgtgtttgtagaggctgagaagtgccacatatgccatctccaagctagagaagcaggaaagccagtggtaaaattcagcatgagtccacaggcccaagaaccagcagctctgatgtcccagggcaggagaaaagctggatgtcccaggtcaagggaaggagggaatttacccctcctccttctttttgttctatctgaaccctcaatggattggaagatgcttgcccacaccagtgagggtaatctttactcaatctactgattcaaatgctgttctctttcagaaacacactcacagtcatacccagaaataatgttttaccagctatctgggcaccccataacccagtcaagttgacacataaaattaaccatcacagacactgactagaatgcataaagtccatctagaaaagcacccagtacataataagcactcaacaaatatttttggaaaagtatcaaacactctgtgcaaggagcaagaaatggttcctactttcacggtctacacaaattaatagggagatgaaacaatggcccaaatcactagatcaccaagccatttaggagaagaaactgaagtgaagggggtaggcatgactcataaagagtaatttcctttccctctctaaggccccaccagtgaactggtggccacgttgactaactggagacaggataccaaggaggacagacatcattgtgaggtcccattctacgtaccccaaaccaacagagtcctctggaaggcctgagagctgttaggaacaagacgaaatgggtgtgagattgaagaagtcacaaaatgcagacattttaagctattctcccaaaatacattaaaaatcttactgagaaaaatgtgaaatatatacaatactcacttgcatatactatttcttattttattttatttatttattttttgagacagagtttcactgttgttgcccaggctagagtgcaatggcacgatcttggctcactgcaacctctgccaccctagttcaagcgattctcctgcttcatcctcccaaattgctgggattacaggtgcccaccaccacacctggctaattttttatattttttagtagagatggcgtttcaccatgttggtcaggctggtctcaaactcttgacctcaggtgatccacccacctcagcctcccaaagtgctgggattacaggcgtgagccactgtgcccaaccaacactatttgttattttagatgttgggaagttttcatgaaaattctcttgtccattctcatttacatgcacacacatacatatgcacatgcatgaacacatgcttcacggcgcttcttattaatccttattgggtaaaatcttattgagggacaataaaccagataaaatctccaaccactccctggtgccaagtctcttgggcccctcacactccaggtgggcaaggcagcatgccagtggacacagcatcacctgctcagagggagtggttgtggaaagcacagaggcaggcggcctggtggccaaggtccacaccacatcctcccaggtgggcactgtcctgagtaggcttaaactggcattgtctgtccagtaagtccttttctaaggaaagcaggtatcaactaattagcaacatgcaagtgttttcattttaggaaaagagaagaactctggaattatggggcctggtaaaggttcatttaagcgtcaagatcaagttggctaaacccatagtgtggaagcactctttgcgtagggtgagccaggtggagcagctgtgtgacagatcttggaggcagtctaagggcaatgagcacctggagaacaaagagggaggggctgcccacctgaggaggaagggacatgtgcaactgtctcctagatggggccctgagaactgccgggagacatcacagggcagcccctctccccacctctggctacacagtctcctgcccttctctactcagtgaattctgaggtcaaaggctactgtgccaaactttcaagtagagtgaagcctcctccgtggtgaactataaacttggatggcatcatgtccatttttgtgttcttcacagcacccaacagcaggttcacagtcaacgttagtgagggaccgagattgtagaagcaaatatttctccagcatcaggggtgttgcctcactaggatctaccattgggatcccaacccaggatgatggtttgaaaccttccggtccagttctcccccatttgtcagtctttgtccttgacaattaatgctgtaaatgcatgtactaaatgcccactgagtgtgtgtaacacacaagccggtgatatcagagtggcaccggacagggagcaacacttctgcaaaggagcaggtattccaagtccttctcatctttcctgagcatctgtcatttgggtggacctcactgcacccttcagctattagcagtgactgtaaatggagaagaagttctcgagaaccagcagcaccctgaacactcattaactgagaaaaattggagactcaaggaggcccaataccctcttactgaatacccaccttccttgtgccagggaggtcatagggaggttgaaaaatcaagggttttgccatgtgtctgagtttgattcctccaaaagggcattaacttttcatattacctctgcagagtgggatttaaaatctgtgttagtgacacgatatttcatttcagatccacagggcccacatttaaaattaatattgcatgcttgtcagaatgaattccaaaccctctcacagcaggccccttgtgggacctagagaaggagtggccaattcattatcgtaacactgggatgagggttccatcccagcttttgactgacacctgcagagattttttttttctgagacattttaagtttttggtgtgccccatcttcccagacaagctgcacgtttctgtcactctgtgctgtttccaaagcccagtggtctgcagggtacctttgaggggcctcctctgatccagttaatcagttcctcattgacaacatagacagagcatctggcccaggccagagagggctttcggccgagtccctctggaggatcagtctgtagagggatgtgactaaggcagcagattccgccaggattctgttagacacagaggacacaaggtcacctggccaaaagtggaggtcaggaagactcaagatctgggtccacctgtttcattttctcttagcatctgccctggcctgctgtcgtaaatcatcatcaccgagcttaaaaccaccctgtcgttcaaaaaaaaaaaaaaaaaatgagctatttggtttttgaacactttccttacagtgcgtagcagtttgttagagaggtgggcaggcattaggattttgtttataaccttggaataaactaagccaacagactgtattcttgcagggttaatgtcccctgctttacagtatgggaatgcccaacgaagtttttattatagagggtggaatatggtgcagtattcagtggagacaattgccccgggagtgcagcgcagaaagccacagctgcatctccacttggtgtcggccgggagctgcctcacctggggctccagggtccctttgagaccgcagttccatagcccgtgggtactgtccttgtgtcatcatcctctctctctctctctccattccagtcattcactctctccccctctttttctctgactgcctccaggcactttctttagcacagagctctggtgatacctcccactggccttgggcacccttcttcaaggccactcaccctgcatggaggagaggaagggaaggagtggccaattcattttcgtaacaaacacccaattttgtttttctccgtggactatccagatgcatgcttcttttacagttcatgtctgcgatactttgtcccttagagaaaaaagctgtatacaaatgtgaaattattccaattatctaatctctgttgcattcctcagccctgcaaagagttaaatgatgtgtaaaatcacctgttagcccgcattagacagggctgtatttacacacccagaggtggcctgtgaattatttaaccgaagggactcttggctcagcatctggctagacactgttgagcccaagttccttaggaggtgcagcctgtggccccagagcttcctcttggctggggaaaccgtctgacagacacggtgggctgctgccagaaccaggtctccttgagaacaacttgaactaagctcctcccagctccagatggttcacaaactagagaggagttttgcagagtcctgaacgctttgccaaaaaagagcgttggccatcttccaggccaggcggtaggtttgcctgcatgctgtgaatgccaggattattgttggggttttagagagtccatttcataacacccccagttcccatctgaatttggaaccaatgagagaaaaagggaaagcagtgagatggatggagatcaaaacatcacttttgtcaccaactgacctctcagagaacagggggagagtgacactggatgtcccaactaggaaccccagagtagagacacacttccatgaccagtgctggaaacccatctgcctcatgccaggaggcaggatcttgggtccctgtaccctggtgcagggaacggaaaggagccataccttctgcaagcacccagctcctcacaggaagccagggccaattcttccacctctccttgtctcatctcacttttcaggtgagcttcctttctctcctaccaaggagagggtgggggctgtggcaagagatggaggcatctggggaaaagccttcctcggggaaaacagcattccatatatctcccagggagatgggacctgcatatatttggaggaagaagtcatagagattgcaagagctggagaggattttagaagccactggaatcctctcattttactgaaggaaacagaggcacacgggtgcagcgaaaccctcatggttatatagctagtcaggggcagggctgaatttgtgtggcagtctgcagtttaaagccggtccctcatggtatggagaacacagcagtgggcatttcacacgcataatctcaccacagggggccaggctgcctcttggtctatgggactccaccccactgtgggtttcagggcaggttcccactcctacctcatctatcccttcttgggaatgggagatgcttggaggatgcacagtaattgaaatgctattcctggcaaatgatcatttccgggggaaaatgtgaatatcatgatatcaagtcaaataaagctgttaggttgaggctttgtccttgagctttttagactctgaacaggcagttgggaaggcagtcagctcctgcctgagtcactgggcaggacagccagcccagggaaagatgagggaagtgggggacctgcgttggtatctcactgggaggatgctgtggcctccccattcgatggagatccttgtcaggcctgcttttgcaaatgctcagaactccaggcagctctctggccctcttctttctgtcctctccatgcagctcccactgctgtatttactcggttggcactttccgctgtcagaatcacatttctcccagccactcactgtgttgcagaatctgtgtattgtcttttcttcagctggtgttttgggcttaagccctgaaatgctttgttctgggccccactacagcacccatactgtgtgctagagaaaacaggaaagggccctcaccatcacacccatgaccttggggaggccagcacctttgttgtcatacttcccaaaaccctccatcccctccctgccagaggagctagcacaatctagatgcccactggctgaggtttatttccagcactgcaaggtaacaggtacacacatacgcacaccagatttccattcccattaaatctctgcatccccaaatgagctacctgttggcaaaagctttttatctgtcagaagttctcaagtggaagttgtctctctctctttgctgcacgtgtgttaccacaaatgcggattgtgccggcctttctccatctcacccacaacctccccttaaacctccatctccaacacccccgagtcttcaatgcctcaggagaattctgaagccagcatataattgctgtccagaaagaggccccgtgggaacggaaaggattttgtgtgtgctcacccctacatttaatggggccatccttccccataaggctcagtgctgcaaagccaggagcccacccccaaggctcatgccaaaccccaattatctggagggcaactggccctgggagctgggccaagcacagcccctcctagctgcggaaagagccttcctatatgtctcgtttgacgcctacaaaaacctggggaagctggcagggcagggggtggggaggttaagcccatagggtggacaagccacagggctctgctccctcccttccccctcatttcttcacccctcccccatgaaaccatcaatcaccttgatggcaggagggaggggtgcttggctgaattgacttgaaaacactcagaaacccaaattgcacccacagaggcactcagaattcagggagatgagggatgtccgcctgaaacacttttttgcagtaatgtgttccgtgatggaagtcatctaattcattcatgaggggactgagacctcagaggaaagtggtgtccctgaaactagcaagggtcagaactacttgcagagaagccactaggaaggctttccagatgagactctccccctactcccactaatattagagggactcccctccctccagcatctccccacagggtctggctgcctcaggcttcccttggctctcagagatgcccttccactcaactgctacccacatgcttctacctgctgcacacaccctttctgtctgcagcctctgatatggtttggctgtgtccacacccaaatctcatcttgaattgtacctcctataattcccttgtgtcgtgaaagggacccagtgggaggtaattgaatcatgggggggcaggtctttcctgtactgttctcatgatagtgaataagtcttaggaggtcttctgcacaagctctctcttgcctgccaccatgtgactttgctcctcgttcgccttcctccatgattgtgaggcttccccagccatatggaactgtgagtcaattaaacctctttcttttgtaaattatccagtctcaggtaggtctttcttagcagcgtgagaacagactaatacagcccctcccctaggctttccctccttagagttcatgttgcagaccacttttccttccttctccgctactgactgcccccatccctgtttgtccagggttctcctgttttctgggttccctgatgagagttagttccttttagggactaattcgtcctagggaggactagattaatagactaccaagtcccctttccaaactgacttgcattttaagatggaaaagtgactcccagggacagggcattggctcaacaggtgcttctacagcttggccgtgacagcctgtctctacatagaaagggccaggggctgcagtctttgcttggagctgtgtttgtagaacaagcacactgtttttaacgtggtttatggttttgtttaaatcaggagtgtcgaatcttttgtattccctgggccacaatggaagaagaagaattgtcttgggccacacataaaatatactaacactaatgacagctgatgagcttaatgttttaagaatgtttacaaacttgtattgggccacatgtggcctgtgggccactggctggacaagctcggtttaaattgataagatattcgggaagaagatctaatcactctcctgccagcctctaccctgctgctaaaatgctttcacaggatctaggtcactggctttgataatcaccacagcttgtggatgtcctcctaagtctagtgccggaagggaactcggtattcctcagtgtgaactggaagcagatgaaggaactccacctctcactcaggtcatcatgtttctgttaatgcatcctgagatcaaattcacctttttcttttgctgccatattatattacaatttttcagttgacttaattgcaaagtatcttctatttgggctactgagtcacttatctctcaaattgtgtgttgttctaactatatatctatgccataagtataagggtttacatttattccttactttatgtcatcttaaaacaaatgaaagactactctaatcatgccacttctcactcctgattctagaaaacagtgtctttcttgaccctcctagttttaaatctggactatgaatctggcattcattcttatcccctaacattagacagagtattggctttcagaaagctaagctttgaagtactatatgttgtgtggcttactggagatcagacaatatgcaagaagtcaaattagttagtttggctcatggaaagctgtctaatttggaaataattaggtgtcatctcctgagagagagagagagagagagagcgcgcatagggagaggcagtggggaagaggaagagagagaggacagaaagggaagatgagagaaaatagttttcattacatgttaagcagaaagagttggaaaaaaataatttctatgatctgcaaagtcatttcaggagtacattagcttgctagggctgccatagttaagtatcacaaagtgggtgggctaagtaacagacaattattaactacagttctggagaccagaagtctacgatcaagacagggttggttccttctcggggctgccaggaaaggatctgttcccagcctctctctctggcctgtagatgactttgccccctgtgtttcttcacagtatcttccctctgtgtgtgcctgtctgtgtctaaatttcccctttttataaggacatcagtcattttggattaagatccacactaacaacctcattttaactcgattacctctgtaaaggccctatttccaaatgagatcacattctgaggtactgaaagttaggacttcaatgtctcgatttggagtggggcacaattcagtccataacaaggggattcccaaagagttgtcataggaatatcacccatcaggcaaagctcctggaagcagatggagccaccattaggaaagtttcccatgagactgtggtgcttctgatgtggctcagctctggaactgactcccacccccatcacccatttcaacctctaacccccaccacctaaccaacaccccctcccctgtaaaagcctttcttcttaagtcaggggtaaactttccacattattatggtccgtgtttccaatgcagtggtttctcagatctgcatcgctcctctctacctcctggttccctgcaactccttaacccacaagcagaggaaggagaagagaaggaccctattgtttagagcagaggtgctgggttctccctctacttacaaccttgccctctctcatttctcctgatgaccaggtagggtagacagcaacatccccatccaaacatgagcagtgaggtgacctggccggttcgatgagtggtaggcagcacagccacaggccatctccctcctaaatggggctgggcccaggggttttcctaggccctgcctgactatgctgcaggctctgccttacacttgctcatcctcctgttgcagaagagctacagggagacaagctacaaaaaccttttaatctgtatgattaacagaagcaattggcaaatgaccctgctgctctcccaaggggaataaggggtttattttcagatgctggtatttatcccactgaatttcattgtgcagcctacagtccatcaaatgcttcccagagtcacccagggtttcttcttagattaaaatcagaattaaatcagatagatacatgctttatcaaatctcattttcttggggatgaaaaataagtttctctttcagtctgtgatttcaggaacaggaagcaaagaatttggaagtttaaaaacacctttgcctgagcctgcatagcttattttttctccaggcagatatgggcctccccttgacaaggtgctacctgtaggcaggaaagtcctgctgcttgtcctgccatgtaatggaacttgggccataaggtggataaagataaggctgctctgagaagctgtattagttttcacaatgctgataaagacatacccaagactgggtaatttataaagaaaaagaggtttaacagactcacggttccacgtggttggggaggcctcacaatcatggcagaaggcgaaaggcacatcttacatggtggcaggcaagagaaaatgagagccaagagagtgagagccaagcaaaagaggaaacccctttaaaataatcagatctcaggagacttattcactaccatgagaacagtaggggggaaacccatgattcaattatctctccactaggtcctcccgtaacatgtgggaattaagggagatacacttcaagataagatttgggtggggacacagccaaaccatatcagaagcacagaattagtgcagagttggttaatgaaataatcattttctacataggtaggggagttaaatgatcatattttgccttttaagagtatcatataggaactcttacaaacctatacaaactggggcttgttatgtgagaagtgacgttggtgatacctgcttggaaagcataggtctccaatcccagctgctgtcctctgggagctgcacaaaagaaggtctatcacatgcttctgaagggagctgtagaagcttctgtggttattcatttgctacagatagaagaagaaattaaaaccaattgtgaaggaaagggaaatgaacattattgaggagtgagtaactgtgtggcaggcactgccctgagagattttgcctgcatgctcacctaaattttagaaataggactagctttaaaaaaataaaaaataaatttgagaaataaactattatcctttagaattgataaaaagtagttcatggatattagagatattttggtaaatatcactgtaaagcataaagaaaagaataaaaagtacccatttgctatgatcagaatgttgtgtcccaccaaaattcatatgttgaaacccagcccccaatgtgatactgttaaggggtggggcccttggaggtgattaggtcattagtgttctacctccatgaatgagattagatttgaggaagcctgtttggctctgctggcttatcaggacacatggaaagtgccgtttaagaaagcagaacaagccctcaccagacaccaaatctgtcagtgacttgatcttgaacttaccagcctcctgaactgtgagtaataaatttctattgtttataagttaccccggcaaagatattttgctgatagtagtccaaaagaactaaagaactaaaatgccattgtaccttagcccattctgttgaatcctttggtggctggattgaagagctgggcagtggagagaccagccaatttagaaagactagggggtgcctggtcatgctgccttctatgtaaagagtgggaagtggggcaatgcagaggacattttttggtgcaggaacaccatgaggggaaggactccaagtcttcagatgagatgatggtctctgggcagtcagttacagagcaggaacagcactctgatgtcacttggaaaggcactcatgaaagcagcagagcctgagctggtgtgttcggaggcagcattaaaaatcagcaggaaaggcatgagacatgaaaccaaaaaagggatctttgctgctgggtctcaggcaacacaaggaagaggtttgtcctgggaccccctgtgaggttctaggacctcaggtgctgttgggatcaggcaggaatttcctgaagtcagccttgtggttgcacctccttctttgcggccctcctggggactgttcttcttttttagactcatttaaaatcctcaaggggcccctctgctataagaaagcaccaagggaagggccctgcctttccagtttcccagcacctagcatgcagtgagtgctcaaatataatttatatttggaatgagtgatgattctctctgcttcccctttgggactgaccttgatgctcatttctacctgattttgcttataaattgtgaggagagttctctacactacaatttatctcagtatccctccccagctggtggctctcatgtgctcactggagcagtctgggacatcaaacatgaacaatgacatagtgaaagaagaaaatgcctggggaagataatggcactatctggagcagggagcctgccatctaaggaaatggtaaaaagaaggaggctccttagggcaggtttcaaggggccagaggaagccccaaatgcgtagaatcacagccaggtgctcaggaggggcagcagaagcagccctcaggacgaagggtagtggtcatcgtgcaaggcagacaagggccctagggtgcaggcaggctgggaagatctccagagaatgaggtgggccatctgggggcatcactttgacctgtagacaaagtgaagggagaggggagggtctggtgatgacagcctcagatgcagactctttaagccttctcaaggctttccagtttttgcagctgctgaggaaacttcattctcacccttcttgttccatctgaaaatgcacttctctccagagctctgggagactgtgaaaggctctctcattgccctgaaatatttttttaaggaatgagtatgatcttttctattctctacttctgtcccatgcagagcagatgtagaggaccaggagtgattcagagatgagaactgaatcttccctccagaaagttatgttccagagggaaagaagcggaacttcagtaacagagaatatgaaattggtcctaagtagaggtatgtggctctcgtgactggagcagagggagaaagacttgattcaggttcttgcctcgcagccttggaatgggaaaaaggaataaaaaatatagaacatgggtattagttcattctcacactactataaagacatagctgggaatgtgttatttataaagaaaagaggtttaattgacttgcagttccacaggccgtacaggaagcatggctggggaggcctcaggaaacttacagtcatagtggaaggcaaagaggacgaagtcatgtcttacatatctgcagaaggaggaaaagagcacaaagatggaagtgctacacacttttaaacaaccagatttcatgaaaactgactcactttcatgagaacagcaaaggggaggtctgccttcatgattcactcacctcccacgaggcctctgctctaacactggggattacaattcaacatgagatttgggtggggacacagggccaaaccatagtaacatgtataatacatatgtatgcaagtactggaatatcaagtttcctggaggaagtagcttttgagcagggcctagaagcatgccaaggatttggatgtgtttgttgtgggtggatgaagtccatgaccagcaagcagactcaggagagttttgcagataagtgtgtccagaagcaaaacaggctgggaggagtggtggtgctggaaaggtggcagatgccgaatgatggaggaccttgaattccatagtagggaatttggcatttattttgtagctgtgggaagccatagcagtttttcaccaaagagataatttacatcaattattccaagccctcagattcactccagttgctagttcagttgtttggttcaaggaagcgtcagaaaggaaatgaaccagaaaggatgagtgatcctagagtccagggtgtccttggggtcagagggaggacaaggccttatgttccctgccttttccaggaggaagaaattgtagtaatattccaggacactggatggacttgtttttctttggaaacaaggttattgacctctctgccgcagtaagagaaaaatgatatatatgttagaacttgaatatttttgtagaaacttaatattaaaggccttatgttcaaatatgcagcatttcacagtgctggttgaattatttgggctaggttgccacatggtgttccatgtacaattctccttggtaggctgggttaaaaaatgtggctaggtaaaatgtgagatgagaaataaaaaaggatctttgttttttcatgcttgtgatacttaaataggctactgtgacccaattaagaagctcccagaggccaggtgtggtagcttatgcctgtaatcccagcactttgggaggccaaggcaggcagatcacttgagttcaggagtttgagaccagcctggccatcatggcgaaactccatatctcccaaaaatacaaaacttagtcgggcatggtggcacacacatgtaatcccagctacttggaaagctgaggcaggagaactgcttgaacccaggaggttgcagtgagccaagatcaggccactgtactctagcctgggtgacaaagtgagactgagactctgtcttaaaaaaaaaaaaaaactatccaggcgtggtggtggatgcctgtaatcccagctacttgggatgctgaggtgggagaattgcttgtacatgggaggtgaaagttgcagtgagccgaggtcaggccactgcactctagcctgtgcaacagaggctttgtctcaaaaaaaaaaaaaaaaaaaaaaaaagttcccagaaataacctctaagccacccatctaattggtcccagagagatcaaaaaaaatgcagcattgaaaatggcgtggaggcaatgacttagggtttatagacaggcatcttccctgtcgtcatccctgacatcttccccaagtgggctaccacaggtcctaggtgatgactggttaggccatgaagctgttcagagggacagagagctgcagagtttggggaaatccaccccctgcttccccagaaggagaagatgcatactaatctgttttggagacaatgcagaatactgattagccaaatatttgctggtgatggggatcactgtgtgtattcgttttctattgctgctataacaaattaccatacacttaatggtttagaacaacataaatccattcattatcttatagttctgaaggtcaggaatctgaaaagatctcactgggctaaaatcaagttgctagcaggactgtgtttctttctggaggctctaagggataatcttttttcttgccttttccagcttccaggagctgcctgcattccttggcttgtggccccttcctctattttcaaaatcagtaaagtcccatctatctgaccccttttccatcatcacatctgtctctaaccaactatagctgggaaaggtcttctgctttcaaggacccatgtgattcactgagcatacctggataaccagggtcatctcccatcttaagatccttagccttaatcacatctacaaagtcccttttgccatgtgaagtcacatattcacagattccagggattaggacatggatctcttttgggggaacatttttctgccttctatagtgtgtattaaactttgatgcttatggcatggccccgttttcgtatcttcttccactcagctaaagccttaggtgagcccgggccaccctggcagctgccctggccagctgatgtggtgatccatggagccagctctggttcatgccaataatctcatttatccagcagtctcacttggccttgaacaatttaccgttcccaaatatcagcatgtttttctgtaaaggagtgatggttcccaacaagaagaggttgacacactcaaattcaggtaatttgaggagattagaataaaaggattttaggtcttctgcggttgctagaatatttcattggccagtatctattgtcctcatccgcactgttgctggccatctgcggtcagagattcctcagtccagggcctgaccaaaaggacttgctccacttacattgcaaagcaaacaacagattcttaaacaagaaagatgatgccttctaaagcttggctattccagccaagctcaggggaaagacattttccctaaagtatcaacaagccatttgatctcagacttagaaggtcattcttgtctgcttttttctcccattagatgaaagaaaatgaaatgttttccgtaaaagtaatttatgaagcactccatatggcaatattaaaactgtaaaagtaagcctccaggggacaaaacaaataatgctgtgtcatccgtctgccctggtactgtccctgggtaatgtcaggcacagaacgttggggaactggctccccactcaactggtacttggatgcctttggagcttttccttgaacattgttgctaaggttcatgaaatcttcagatttttgttatggaatccattcgcaaagcaaaatgatcttaagtgtaaatactaaatttactgtaaattgcagacatcactacctccaagacccttttaatatattgagtcccactgaatgctggaatccaagataaagttctttaagaatatagcactcatgtcattcatgtattcattcgttcattgatgcagtcattcaagaaatatttactgagtacctattaggattcagtggtgagcaaaccactctaatgggtgatacaaatgcaaattagagcgatcgttgatatggagaaaagatagagggtttaataagagcttataacaggataagcactgggacaccatggacagattttaggtaggggagttaaatggtcatattttcccttttaagagtatcatataggctgcagtgtgggaaacagatcagagaggcttcagggcctgcccaaccatcctttacgagtgttgtttaacgcaaggtctcgtggtagacagtgttacatggttaaccccatttccattctcctcttgccctgcttccatgtggtatagaggctggaaaagttaaacaccttcttccccacctcctgtgcagctcagtgtagtcatgtgaccctgctctggcctgagacttgagcagtgatctgttgaggtcttctgggaaggaatatgcttttcctgataaaaggaatgagtgcagctgttccccctccccctccttcccacctttcacagagaagggatgactagagctgggcagccatcaggcaaccacaagggaaagaccaagatgttggtgttcatagaatagagcctctgcagcaatgtcagcaccacacacatatggactgcttgttatgtggaaaatatcagcccccatctttggagattggatttttttgttgtggttactttccatgaaaagcattctaaacagatacagtgattcaaacataggcttagccgaaaacaaattaataggcattttgatcattgtcatagttagcgggtggaatccccaaattccacttgtgccattgaaattgcagcctttgaatgggatgataaaagagggttggaaagaagaagggagccgtgatggttttcttccacaggcctgtggtggcattcctcagtgtttcacttccaacctccttggaacccatgcttatcttagcttcagcctccaacacagccttaactgtaagcctagttccctgagtcactctgaaatgtattagtccatgaggaaggagaacagattctgtcttctacctgttttcataactgtagaaatgaacacagtgcatggcacttggtaggtgctcagtgaatgtccactaagccagtacgtacacacaaatacatgcaaaagttgaaaatcgcaatgcattgtgtctttaaaaataaaaaagagaaatagcctgatcttttggaacacatatggggcagagcctgctcaatgaagcatgcacattttggattaagaaatatgattatcatttgtcagctctgatttctgcctctgggctgataagatggtgtccgaggagtcattttcactcctttgcagacaccaaaacagaaggggtctttgctgaaaggtagactctgacgtgacagtcattagtagctagaaacaggcaactgattgcaaagtcaagatgaagtgcttcagtaaaaagaaccttcatgcttgaggcatactctttgcttctttgttgaagttgtggtagatttttttaaaaaacaatcacaatatagtttgctatactttaagtttttaacatctccactggggaaaaattgaaggagctaagtaaattagctcattggatcatgaatttatagaaaaaaaattaatattgccctttgtcgtttctgttaggagtgtcacgggtcaaagcagagacaagaggcatggagaaggagcagtgtgagggcctctccgggtcatttctctgtctggcttctgatgctatctgcccaacacagtttctgaaaacatcagaaactccccagttttgcccaacatgcttcccctaccttgcacctcttagtgcagagacatgttctgtgagaatccacctggtaagacagacaacatggagaggaagatctcagagacctggcttcctttcctgcccttcccttgcagacagagttttactttgtgaagtctccagtttcagaatgagaaacctctgttaagcaaccaggcctatcactgtagggatgagaaaagtgaagtccagataggtgaagcaacttgtcccaggtcaacacagcatgtcagagaagctgaggccagccagtctcctgggttctcccccatgttcttcctactgcccctctgcggcttccatttgtaaagagaggattgcttctcctcactcctctcgcacactcttgaggctatttcagtgaattgtgtctatctttttatatttcccatttaaaagaaaacccactctatggcataatggtttccagtgtcctgctgtttggaagaatgttttacctgcctgtcagtgctgagctttgagctccttgaagaaggacattctcgtggctgtggcccatccaggcagaaccagcctagctggccaagtggtttctctgcatcgtttggctgtcagataagggccacctgcttattgattggcacagtgacgcttaagtccaaacatcctccctaatgacacagaacttcatattaaaggatgtcagggaattgattttgctcttctttaggaacaaaagatgtcagaagttagaaggaactgaacagtcaggaaaacgtaagtctctataccttcccatcaccccatccctgacccacaagccatgatcggccagtggaagataaatctaaccaatcccatgggacaaagggagagagccctgcacagcaagacagcagcagtcattgggcagaaataaatcatgagatggttgagaatctgattctctgggtcaatttctctgcatcctcctctgcccttttaggcctgtgctaaactttccctttgatgcaaatggtattaagtgccttgtgtctgaaaaggttgttggcaggctttggttgagaacataaagatgaatctttgttctcttgtctataaaatggggatataataatctacctcctgtgagaattcaataattttataagataaagctcttagagcagtgcctggcccagagtggatactcaactaatgttaactaagaaaatgaaaatgaaaatccaggaatagtctctgcctgcaaaatgttttgaatgtaaggagggagatgagacgctgtgtatatatgcctctgttctgtatttttaatcaactactaaggccatagagaacaaagagttacccctttttaaggtaaaataaattatactcattgtccagcaaggaagaaatgaattgaaaatcctagaggcagaaaagtgcagagtttggagactaccaggtggcactgagactaaaagctttatttgccatgttcagctcaagatttaatgggttgtatagtgtaaggggctaactccaggatctgctggaactcactctgggatccacagcaaacaaagcactaaccttggcatatggcgctgcgagaagtttcctaggatcagccaggctctgggccactcactgggttcatgcctctgaacattaccttccaggagctgcccccattactgaacctaatacgctactcagaagttttgtaaccaaggttttctaaaagtctgagaaatagaagatgaactttagatttgataaacagggctgtacactggagtcaggtagaggtgagtaggaatcctggccttgccacttactagctgtttgaccttggataaattgcttaacctttctaagcctcaatttcaatgtctttattaaataacttttatgaccgggaaatcaattaaataatttatttaaaatacttagggcagtattgatcatgaaatagatgttctgaaaatacttataatgattttgatcagttcctgagagcccacttgtaattttcattgggtctgtactcttgggacttctccagaaaccatgacaaggaattttagagagtattacccgatattgtagtggactgtgctcaagaatcaaatacaacaatgtcaaaaatttgtctgacacaacaaagaaatggactacctgaaatagtatatatagtccctaagagttttaaaatagatggtggatggtaataaattgaatttctgcgttcttagaaagggtgattcagagataccccaattctaagagtcactgacactgaatgtcaagtattttttgtggcttcagaaatttctgataaatgcattttttcagagtgttgttgtatcataactttgctgtagagcaaaccacttcaaacttagtgatctataaaaataaacatttatggccgggcgtggtggctcacgcctgtaatcccagcactttgggaggccaaggtgggcagatcacaaggtcaggagatcgagaccatcctggctaacatggtgaaaccctgtctctactaaaaatacaaaaaattagccaggcgtggtggcaggcgcctgtagtccccagctactcaggaagctgaggcaggagagtggcatgaacctgggaggtagagcttgcagtgagcctagatcacgccactgcactccagcctgggtgaagagtgagactccgtctcaaaaaatatatataaaataaaaaataaataaacttttattgcttgctcatgagtctataggccagcttaggtttggctgatctagcaatgggttcagtaccatttgctccagatgtctctcatcttccttgaaataacaactattctgaggcgtgttcttctcatggtaagagggcaagagaagggagtaactacagccatgcaggtacatagcaagtccctgttcatatcacattcaataacaccccagtagccaggcaaatcatatggccaaacccgaaagggaaaaggtagacactgctcactatgaggccaaggcaagtattcaggtgtatattaataccatgggggagtcaggaactggggggcaataattccttcttccacacctgtgatgttgcagactgttgctggagtgtagtcttctttctgttagttgaggggattgtttttttgatctagctgtaacccctgatgagtgatgtacctcttagtaaattgtgggcaaacataaggaaaaaggacctctttagtaaatgagccttctaagattcagtcgtgtggtgaaataactaaactgagtggaggacaaagaagtcacagaaccaatccttcaaatccagcccgcagcagcagaggtgtaaacagttactatctaatgtccactccggggtctacctgaattgaattgttggtttccttccaattctcaatgattttctggccattttcatagaaaccatcaatgtaactgatacttctggtttcaaataatatgctagatcaaaagcataaattaccttgaaaatgtgaccatttttctagctctccttggctatcaataaataatactcaaattgctctaaattgttggattgagtttaggagacaaaggccagcagtaactgagatgattaacatgaattgggataaaactccctcttcagttttcatctaacagaatgcaggtcttcagagaatgattgtcttttctagcataatactcatctacctcctgaagggctgggagcttagaattctttctcactctcagtacttcttagagaaacccagaagagtccagtgagaatggtttccctgtttggctgattttctgggaggcagaatggctcaggggttagatgccattctgggatctatggctggattcaaacttggctgcacacctgggtagctgtgtgaccctgcgaaagttgcaaaggttggttaacctctgcagttgtccctgatgttgatcacagatcttcagttcccctttcctcctgtcacccagaggactgagtccctggctcctttgtggttgggtggtgctatgtgaccagttctggccaaggattgtgagcaaacatgctctatgtaacttctggattacactatttaatacccagtgagaaactctccagaattctctcttgtccccctggcacattgaccagcaacatgcaaggtgatgtaactccaatgagtagggttcccttgttgacctacactagacatgtagcatgacagagaaataacctttgtgctaagccactgacatttggggggttatttgctgccataacttaatccaccctaccctgattgatgcacctcactatatctttgtttctttatgtgaaaaaatggagataatagtagaatctatttcatcaagtaattatgaggactaaacaggataatgtgtgtataatacttagaatagtacctagcacataataaatttttaatatattttagctatttatgatgatgatgatgatgttatgccgtgctctaactttgcctctaacaagttatctatttctatcaaacaagttattagtcatgtgtcttcaagaaaatcacttatcatcaagttgcaatcatagtatgttagaataagtgagctgtaagactaatttctagccttatgatgtgagcctctattaagaactcactcagagactccatcctggtgtttcaaagatatttctattggttaggaaaataaaacgtgataatactaaacattattttctccccttcagttgctctcccttccccaaacaaaaagatgtatccttattacagaattctttctgtatcctgttctgaagatttctgctcaggaaattactctggctcgtaaattattaactacaaattggttttccggtttaggcacctacaccctcatcagtccatccccattctctgttctgttttcaccagtaggatgtcaacagtccactatgatcttttttcctgatagcatggtcttaccaaaaggagaagttcctgtccttgaccaccttagtccaggctaaaatagctatccacataccaccactcatgaccactgagacctgttttccaacttcttcagatcagagctttccatatctggtttttctctcatgttactctagatgtatccttctctagtcccaaaggtagccctgtctgcaattcccaatagcagcatgttaatctatgttaacatattatattgaaccataagaaattgcctttgtggaaggggtgggggttgaatatagaaatttcatatggttcaacctatatgtaaacccaatttggaaaagaaggagactgtgatcacatacctattaaattacatgttggatcccatcaagaatcctaatgtatttcttcctccataccttgttgaactgggatcttgttccaggacatgacttatgctctgtatataaccttcagacctccctatacccagcacttggtagatagcagatactgatgctgtatttattgaccaactagatgggagctttttgtgatatctattgttgacatccatgtttatacatttgggctgtttaaaaaggtaccatttataattacattatgggagaaaataacacttcttttctttaacctctttcagattgaagacatcattacaaagatgcaagatgacaagacagggggtgtgcccatcagaacagtcaagagctttctctccaaaatccccagtgtcgtcacaggtaacaccctccttgcaaggtgttggtaacagtcagaactaccaaagagttataagtctagattgcggcctgaggggtgtctgaagatctgtgaatagtaaaaatgaaacattcagtgtgtttcttgactcaggtcccatcctagtcttagtttccaggaagaagctacttgttgcccatcattaagaatgaccttaccatgaccagcccttcaagtgcatgtagattgaggctgctgggaataaataaacccattaataaagtggcgcatcagcaactttgcctgtgggatacacacaagcacagaaatattaaagaaattaaacaggtttttaagaaagtgttatattcaaattctacaaaatgcttttattttcagttttttaactcagtgtacttgacctcctgaaagagaggttttaaactatttttcttcattccttatattgtgctttgtgtgctcatctttcttttaaaatattttattgtgaaatatattaaaacacatgggtagttcaaaaataataaaacacagtacatgtacctaccatcctgccttataaagaacattattatcaatatcttagagcccccttgggtacctactgtattgcatccacttccctaaacactatctgcttgtatactaatcaattcattgtttttcttcatagttttactacctaggtatgtatcttttgctatccaaacaagtaaccaaataaattaagataaaattttagatgattctcttaatctgcctatatgcttttcaaaattcgggaaccaaaggacttagttttcactatataccttttagaatggctaaaaataaaaatattgacagtaccaagtggtggtgagcatgtgaagcaactggaactctcacatattggtgatacgaatggaaaattgtgcagctactttgggaactagtttggcagtttcttacacagttaagcaatgcttaccatatgaaccagcaatcccactcctgggtattcacccaagagcaatgaaaacttgtgtttatacaaaaacttgtatgtaagggtttatagcaacttttattgaagtatactgaagaatatagcaactttattcatcatctccaaagactggaaacaacccaaatgtccttcagtgaacgggtaaatggataaacaaactgtagtctctccacaatcagcaacaaaaaccagggaactattgatactggtagcaacttggattaatctctaggtcatttttctgagtgaaagaagcagtctcaaaggttacatgctatgtgatttcaggtatacagcattgtatacatcacaaaaccgtagtgataaagattagatcagtggtttccagcaactggcatttgcagggcgagtgtgactgcaaaagacaacaggagggagttttatgagatgatgatgatgaacagatgaacagttctgtatactgattatggtgatggtaacatgactctatacataggccaaaattcatggaacaggccaggcatgatggctcatgcctgtaatcccagcactttaggaggctgaggtagggggatcacctgaggtcagggggttgagaccaccttggccaacatggcaaaaccccatctttactaaaaaatacaaaaattagccgggcgtagtggtgcgtgcctgtagtcccagctacttgggagactgaggcaggagaatcacttgaacctgggaggtagaggttgcagtgagctgagatcgtgccactgcactccagcctgggtaacagagcgagactctgtctcagcaacaacaacaacaacaacagaattcatggaacagcacacacacacacgcacacacagggtcaatattactgtatattaacctaaaaaataagtagacccagttgaagtaagtatcccagctcattattgagactgtcactctttgaactcaggtactgtcttactcagctcaggctgctagaacaaagcaccctacactgggtggcttataaagaacagaaattcatgtctcacagttctggaggctggaagtctgagatcaggtaccatcataggttctggtaagagcccattccaggttgtagactgctgacttcttcttgtatccttgtttggtggaaagaaagctagatagggggccgggtgccgtgactcatgcctataatcccagcactttgggaggctgaggtgggtggatcacctgaggtcaggagtttgagagcagcctggccaacatggcaaaaccctgtctctactaaaaatacaaaaaaaaaaaaaaaatagctgggtgtggtggcacgtgcttgtagtcccagctacttgggaggctgaggcaggaaaatcacttgaactgtggaggttgcagtgagcagaggtcacgccactgcactccagcatgggcaacagagtgagactccatctcaaaaaaaaaagtaagctaaatagctctctggcctctctgtaaagggtaataattccatttgtgaggggccctccttcataaactcccccaaaggactcctaatgccatcatgttggggattagatttcaatatatgaatttggaggagacacgttcagtccaaaatagagcccagatagatttgggtaatgaaggatacttgtattgttagtgttctctaattttaaaatttatgtaaatgaaattttactatatatattattcatgtataatatacagtataatatagactatgtatgtaattttactatattatttttcacattcctggattttgttcaataatgtttaagatgtttgtatctatttcacaggccacactgatctgttgtttttcttaccattgttgctggtttgggtatcaaatttatgctagcctcataaatgagccatgaagtatctctcttttcttgatatcctgcttttctttgaaaaataattgtccctttaatccaggttttaagtatgtaatttcaattattttttatttttaaaatttcctctggttctttttttttttttagacagagtcttgctcttgtcacccaggctggagtgcagtggcatgatctcagctcactgaaacccccacctcctgggttcaagcgattctcctgtctcagcctcctgagtagctgggattacaggcatccgccaccacacctggctaattttttgtatttttagtagagacagggtttcaccatgttgcccaggctggtctcgaactcttgaccttaggtgatccgcccaccttggcctcccaaagtactctggttctttttacaatatacttggtcattcatttttttaaatttattcatttagatatttattgagtgttcactattttctaagcattgttaaggacttgagattcagaagtaaatgaaacagataaaaagttctaccctcatggaatttatattctagtagaggaggaaataagtaaggaaaacttgcagaattttagattgtgataaaggccaaggagaaaaataaaatacacaaaaggatgggaagtgttggagtgttgcagctttggaataggtgctcaagaaagagctcctcgagaagatgacatttgagtaaagacggaaaggagatgagggattgaatcatatggatattgagggagagagcatgccagacagccagagctcagtgcccaaggcaagagagttcctggaacattgaggatctgtgaggaggagccagggcagctataatagagtcaagaaaataaggagagtggggatgaagccacgtgagaatggtgagcttgatcacttagcctcttatcactgcaggattttgcacatggcctgacatgctctgacttacctttcaatgagatcactctattatattcagaattccctgggggattgaggggttaggtgccagataggaggctattattaaaatggtgcctcagactaggtgatatggtttcactctgtgtccctacccaaatcgcatctcaaattataatccccacatggcaagggagggacctggtggtaggtgattagctcatggggaaggttctcccgtgctgttctcataatagcgagtgagttctcacaagatctgatggtttaaaagtgtggcacttccccctgctctctctctctcctgccgctatgtaagacatgccttttttcccctttaccttctgccaggattgtaagtttcctgaggcctccgcagccatgtaattaactgtgagtcaattaagcttctttcctttataaattacccagtctcagatcattctttataacagtgtgaaaatggactaatacactaagctatcagcactggagatgtgtgaagtagtcagattcggattcaagtctgaaggtagatgatatggtttggccaagtccccacccaaatctcatcttgaattgtataatagttcccataattcccacatatcatggaagggacctggtgggaggtaattgaatcatgggggcagttacctctatgctgttctcatgatggtgagtgagttctaatgagatctgatgatttcataaggggcttttccctgtctttgctctgcacttctccttgctgcttccatgtgaagacaatgtatttgcttcactttctgccatgattgtaagtttcctcagccgtgctgaactgtgagtcaattaaacatatgtcctttataaattacccaatcttgggtatgtctttattagcagcatgagaatggactaataccgtaaattgttactaggtagtggggcactgctgtaaagatacttgaaaatgtggaagcagccaggcgcggtggctcatgcctgtaatcccagcactttgggaggccatggcaggtggatcatttgaggtcgggagttcaagaccagcctggccaacatggtgaagccctgtctctactaaaagtacaaaaattagctcagtggtagtggcacgcacctgtaatcccagctacttgggaggctgaggcaggagaatcacttgagcccaggcagcagaggttgtggtgagctgagatcacaccactgcattccagtctgtgagaccctgtctcagaaaaaaaaaaaaaatagaaaatatggaagtgactttggaacatgggtgacaggcagaggaaggaacagtttgaagggctcagaagaagacaagaatatgggggaaagtttggaacttcctagagacttggagggcttagaagacaggaagatgtgggaaagtttagaacttcctagagacctgttgaatgactttgaccaaaatactgatagtgatatggacaataaagtccaggctgaggtagtctcagatggagatgagaaacttgttaggaactggagcaaagataaccctcgttatgctgtagcaaagtcaggtggcattttggccctgccctagagatttgtgaaactttgaacttgagagagatgatttaggatatctggcagaaaaacatttctaagtgcagagtgttcaagaggtgacatttgacatctctggacacaagagagcataaaagtttggaaaatttgcagcctgacgaaccagtagaaaagaaaaacacattttctggggagaaattcaagctggctgcagaaatttgcataagtaaggaggaaccaaatgttaattgccaagacagtggggaaaatgtctccagggcatgtcacagaccttcaaggcagcacctcccaccacaggcccagagacctaagaggaaaaaatgtttatttttcctcttaggtccagggccccactgctgtgtgcagcctagggacttaatgccctgtgtcccagctgctccagctatagttaaaaggggtcaaggtacagctcgggccatggcttcagagggtgcaagcctccagccttggcagcttccacatggtgtttgtcttctgggtgtgcagaagacaagaactgaggtttgggaacctccatcttgatttcaaaggatatatagaaacacctggatgtccaggcagaggtgtgctgcaggggcagagccctcatggagagcctctgctagaacagtgcagaagggaaatgtggggttggagtccccacacagagtccccactggggcactgcctagaggagctgtaagaagagggccactgtcctccagactccagaatggtaggtccacccccagcttgcactgtgcaactggaaaagctgcagacactaaacaccagctgtgcaagcagccaggaaggaggctgtaccctgcaaagctaccgggtcagagctgcccaagatagtgggagcccacctcttgcatcagcataacatgggtgtgagacatgaagtaaaaggagattatttcataactttaagatttaattagttacctattggatttcagacttgcatggggcctgtagcccctttgttttggtgaatttctcccatttagaacaggtatatttacccagtgcctgtacccacattgcatttaggaagtaactagcttgcttttgattttacaggctcataggtggaagggacttgcttagtctcagatgagattttggacttggacttttgggttaatgctggaatgaattaagattttgggggactgttgggaaggcatcattgtgttttgaaatgtgaggatatgagatttgggaggggctggggtagaatgatatggtttggacatgtccccacccaaatctcatcttgatttgtaattcccatagtccccatgagtcttgggaaggatgcagtgggaggtaattgaatcatgggttggttacctccatgctttcctcatgatagtgagtgagttctcatgagatctgatagttttataacgggcttttcctctacctcactcttcacatctccttgctgctgccatgtgaagaaggatgtgtttgctttcctttctgccatgattgtaagtttactgaggcctttccagccatgctgtactgtctgtcaattaaacctcttttctttatttcccagtttcatgtatgtctttattagcagcatgagaaccgactaatagagtagaacagatattattagcggatagatcagatatggaatgtgagaggaaaaaaaggaattagccatgatccacactttttggcttcagcaactggaaaaatggagttgctattaatttcaatgaggaatactataataggggtgccaggggttggggtggggggcagttgttagctgaagggtaagaaatcaaaacacaaattttaggtcaagttttagcgacctattagacattcagttggagatgacaagtaagtattccagtatgtggatttggattttaagggagtgtctgtgctgggttcataagccatcagcatgtagacagtatttagagccataggaataatgaggtcaccaagggagtgagtgtagatagaacacacagtccaattcctaaaacacagggtactccaatctatagatgtgagggagagaataagaaaacagcaaaagaaatagaacaagtggctggagacaaggaggaaaaatcaagaggatataatttcttggacaccaatttttctagaaagtgttttaaggaagagtagagtgacctactatagctatgctgagaagctaagggctgagaattgatcattgcctttagcaatgctgaattcattgctgaccttggtaagtgcacattctgtgaaacattgggagcaaaaatccttattgggtgtgtccaacctgagatgaggagagtgattcgaggtgctaagacagttaatcttggaaggagtttcccttgtaaaatgaagaaatgcagtcatatctagaggggtacgttaggtcagaacaggtagatttttaatttaataaaaagataatatgtttgtattatagaaatgactcagtgggggtgggggagatgatgtaggagaatgggaaaacttcaaggagttatatcaaagaataggtaagagaggattgaatttaacatgcatattggtgagtagtttcagctagaaacacatacaatttattcatagaaagaagaaaggaggcagccgggcacagtggctcaggcctctaatcccagcactttgggaggctgaggtaggcagatcacaaggtcaggaaatcaagaccatcctggctaacacggtgaaaccccgtctctactaaaaatacaaaaaaattagctgggtgtggtggcgggcacctgtagtcccagctactcgggaggctgaggcaggagaatggcatgaacccaggaggcagagcttgcagtgagccaagatcacgccactgcactccagcctgggtgacagagtgagactctgtctcaaacaaacaaacaaaacaaaacaaaaaaggaagaaaggaggcataatagatgcacagaggtacaaataagtgggcagatgtgatgggaggtggtggaagcttatagatcttctcattgtctctatgttcctagtaatctggaaaccaaaaatggtagagattttgcaagttcaaggagagatcataagttataaattagtcaactaggaaagtagagattgactggactagggaaatagaactttgattgtgactgatatggtttggctctgtgtccccactctgatttcatctcaaattgtaatccccataatccgcacatgtcgagggagatacctggtaagaggtgattggatcgtgggggtggtttcctccatgctattctcatgatagtgagcaagctctcacgaggtctgatggtttttataagtgtttgacagtttcttcttcacagactctcttgcctgctgccatttaagacatgcgtgcttcccttttcgccatgattgtaagtttcctgaggtctccctagccatacggaactgtgattcaatcaaacctctttttttttttttttttttcataaattacccagtcttgggtatatccttatagcagtgtgagaatgtactaatacagtgaccttcttaggatgattaatatttttgaatttaaagacaggtaatttttttccccatccacatttagctctgtggatttgggcatgcctcaggtagaaagtggacttaattgatgttatagcaagtttgaggttataatagatcaagacagaggcacagtaactaaaatgattgcccattacatttaattgagtaaggatgaaaacaagaacatgagatggatgaggaaccatgaagagtagtaattaccacaaattgtaagtcaagtggcaaagaaattttggagttttcagaggcaagagtaagagagctgaaaatatagtagatggtgattagatggtggcatgtttgaaattgagattctggaaagattgtgattattggcagggacaataatataagatataaccataggaacaaggcattgaaatgggataaagtgtaagatttttggaggagaggaggttaaggaactgagaggccatgatactggaagactgagctgtgtgaatattgaaatcactactgggggagtgttagagaaggtggttgtgagttaaaatctttatggaatgagaagcaaaggaccagggatcagcagatgactttcacaataagaggtacaggtggtttaatcagatggtatgggagtcaaagctgagtgtgttttagagaagagggaggggatgaaggtgatctgaaagcagcagttagtagcaggacagtcacttatctacctgtaaaccccatggtatataaagtgtgggagggaaaatagccaccacgtaagagggctgcagggaagcaggaccactggggaagaatgagaagatgaaaggaatattaactgattttatttatgattcatcatgagtccaagagggcaagtggaagggtttcaggaggagatggtgagtttatgacttgagtaataaatgcctgctgttgctatgtgccaggctctagagtagtcacagacgatataaagatgaacaaagacttgacccctgctcttaaaaagctattaatctagtgagagaaacagacacaggtagatcaatgatttatatgagctatgtgccataatagaagaatggacaaaatgctgtttgagtccaggagagagaatcatgaatttttattgggtatgtctagaatatttctctgagaaggtatatcagttatctatttctgtataacaaacccacaaactataattgcttacaactacagtgatttattgtttcttatgattatgattccatgaaccggcaatctgggcagttctgctggtctcagccatgaggccatagtcatctgatggctcaactgaggctggagggtctacagtggcctcactcatttgtttggccttggtgcttactcttaaactcttaactggggtctcagttcttctccatgtcaccttgtatctgccaataggttagattgggcttcttcacagcctcttggtcttagggttccaagcaggacaggataaaaactgcaagacctcttagggcctaggctccagaactcatacaatgtcaagtgtgccacgtcacgttcttcaaggcaaattacaaggcaaagtctggattgaagaggatggagaaaccaactccacctcctggtgtaggagtggcaacatcatgttgacattgggagacacgattcattggagggcattaccataacaatctaccacagacaataattgagaaccggaccttaaacataagtggaaacccaggaaaagtcattccacgtagagaaaatagaattttcatagcctcaaatacatgacaaacatgccaggtttcagtaagtataagcttgtttgtgtggttggagtttaaaacacatttatgtgtgtatgtatttgagaagaggagcatattggcagaacagccacaggaatgaaaaggatacaagaattacacctaataatatattataaaggaaagctgacttgtagactttgttccaaaggtggggctgcttttatctcaaaggtaacccatctaccctgctcagatggactgccgtcagaggttttaaatatgagggaattcacatccatgaagtggatggaagtttaagcaggaagaaatgaggagtgtggagactagttatggagtctagatgagggaatgtatgtgagaaataaggccatattaacgacaaccacagcatcaactgaaaccatggctgtacagccacgcatcattaaatacttataaaaaccccatgagatagaaaccgttattatctctaccaagtaatggaggaaactgctaattcaagagtaacttttccaaggtcacaccactagtaaatagcaggatctgttcctctgggccacccgtgtaaggatggtagcagtagggttcaaaagatcagaggaaacagtagaaggtatgattgacacaacctgctgacttgaaatagagcagagggtaactcatccaaaatggatacaccttaatatcatggattgaatacattcatttaactttttctcttctgaaaccccacaaaaattatagtaaaagatttttattttaaaagcatgatctaaaagttggaggcctctattacagtgatctaccatgggaaataaacatccttaaaaatcttgaaaagatagtccagtacaaagggcagtcagtgcctcactctcaagatgtgcagatgtgtgaaagactcatggagaatagtcttccaacacaggagacaatagccacaaaactcaagaatctgaaaaacaaatggatgagtggtaactgacaatagccctgaaacaatctaaccatcacttgtcagtggacaaggctaaaaaaaaaaaaaaaaaaaaaaaaaaactctatatttatatgatggagttctcaatgggctcagaaactggtaacatcagcagacttttctatctagttagaatacattttgccaacactctcacctacttaactactgcacagaccaatcactagctagtgtctattgtttagcaatatcagatcctgcacttggccagcacagctcaggctggtgttgaggtggttcctaagaccagtcaagccccaggacagaagacaaatctcatgcttacctctagttgctggcactagagtagagaattacatagagaaaaaacccaggtcactgagacccatgggtaccaaacttaaagttgaaacgcattaatacatggccaccctgttactgtggcaagagaagctgtatctacatgggacagtaatcagcccacacttcagcctttccaccagctcagcagcctccatcagactttctagccatttgagaaatagccagtttcccatcacaaaccagcagataccagcagatactccaacattggagcttccatttcaacagcaacagctgggggaataactttttctcttctctattgggaccccagttctttaataaaaattgaaagtaaagatgaaagaataatggacattataaggctggttaatcagcagtgtctttatttcttgcactgctacataacgtactgtccatacctacatgtgactttgctaaataaacagcaagtgatttcaatggaagaaggcaagaagatggagaccaatggcacgatgatgacagtctgctggtgaaagcttctttccaaagatgatattgatgaggaatgcatgagcatgtcccagtgcatccaagactctgtcactctcagaagctctgggaagctgcttgtcaccactttctcagcaacacagtgaaagtcagagaataatgttgataaaaagtagtatcttgctgcaaggcccgtctctacactgtcaagttaccacattgagttgaaaattttgccaacatatccagatcatcccaaaggcgaaaagagaagcaactgttaatgacctacaccaaataaatcaacaaacacatagcaatatgcggatgtgtacctttgtagtggatcaaatgagcctggacaagaaactctaaatggaaagttttagagcataaagagaacattctagaaaaagaatgtacttgccaaaaaagtcaaaactgagataaaggaaaaattgtagacctggggaatgtgaatttggaaaaataatttatgggtactgaggatagagataacaggggaggtatagctataagcagagcagaaaattgatatccagttttccagaattcacaggtgacatagaagggaaccattgtaccaagtgatacacaaagatcagagttgaagagatgtgatttcgtccacgagtccctttaaagctggctttgtggtgtgtttgtttacaaccttcctaaggtgtcgatgtctaccagttggaacagtgacacaagagatggtaggcatttcttgactttccatctcacaaattaaatttgtttggtgaattcctgaaggatccatacagagcctggactgaaagcacctgtttcgatcttatgtgctgaaagcaaaaccttttctcatcaaatgtttctcttctttgtctttctggctttcatatgtgtgatctaacttcattggttacatctttattaataataaatatctaataaaaatgttaataaatttaaataaatacattgaataaaaataacctatattcatctaacctgttttgggtaaaggaggttcctatacccaagataaggacttgaggaagttatgggtttgggagagaagacacaagatcagtcttgattatgctaagcttgaggttttgaagggttatttgggtagcactgtttaggagaaacttggaagtgaggagccaaagtcctggagaacattttatgtaagagatatgtatggatttgggagtcatcagagtctgagtgacccgggactccagggtcatgactgggaactataattttcacatcttcttctataagccatgtattagtctatctgctacccagccttgagataacatgctcacccaccccacatcttctatgattttgagtttgaaattttcccaccaatatgtaagggaaattatcttccctgctcagatcaggacaaactcataggtgaattcacaggtattgctgggatgaagagggagaaggaatgcctgttggttcacctgtgggttcgaaatgttgggattgggaaggttggcccagggagtaaatgcactgagttaggggatagatatgtttgggagaaggccaaacacaagagataaccattagaatataatctctgtcttagaaagtgaaaaattaagagctgtaaggggtgaggtttagcaaataaatatttctgagcaaaaatagagaattggagagagaaggaaatacggaagaaagaagaacccaacatcagatcaaagtccaaggctcattggctttttgcaggggaagtcacatacaaaccatctcatcttccagaagcttaagatttctgagcaaggtgcccacagaaagggtacttcagagccaccctaccaatcccttttcaggactacagaccaacctcctcagaccctctttgaatagtaagtaggtaacaaagatgatcactggagccaagatggtgagtcttcggagtttccaacctcagcgtgccagctctatccacgccccacctgccctgcaggtgatagacatatcctgggcagaatgcctgccagccccaggaaagcagccagattgtgcagctttgcccagctgtcatagacagtcattccaggataattctccatcacctgaatgtcatgaagaattttccagggactttggagatttatttcttccagaccaccctcagaaacacaaattcctagcatgtaagagccataagatgcatctagtctcacttattcttgcagtcaggaagattgagtaccagagacatgatgtaatgtcctcaaaaatcacagttaaggacagaaccaagactggaatctggattcctcactaccattgcaaactgttcccatgatctcatgcacaaaattatagactcttggattgcagcagtttcttaaaggtgtttgatgcgttctccctgaacatgagaatcacttgtgtaacttgttaaaaatagatttccaggacatccccatgggtctggactcgggatcctctattttcagcagcttctcatatttatctcctacagcctgtatgaatttgggaatgtgtaagacccctacagagtgctctctagcctctgttttaacaatctgcaatgatggatgtcatctctccttccatctttggacaactttgaccttgagaaacttttttttttgtaataaacctaccagcctcctcttgcttcactgcattagtcccaattctacctctgtatcacaaagaatagaggaatggatttgattaaaattatgcccacctagctcttccttatgaaattttcttgcacaaataattttcagaaaatatccaaggtatatacatgcatttttattttacttaacacatttttttatgaatacatttctgtcttttcattatccacaaatttatttttaatagctttatgtttacctaaacatttaaaagtattattcttacagtttcttggcaatacagtttggagtctaggctccaaacagcctatgtgacctgggttggtcactgtgtgaccttgagctagtcaccaacctctttgggcctcagttttctcacctgttaattgataggtttggattaaatgatatttgtagtccattctgactctgatcttctgagattcttcacaggatatgtataaaggcctgtctgaagttaattcttttcactttttctcacgatgttctaactgaatctacctctgagttaatttaggccaccagttttgtcttaagatgtgtgtctcagtctgtcttctgctgttgtaacagaatgccacagactgggcaaagaagagagaaatgtatttctcacagttttagggtctgggaagtccaaaagcatggtgccagcatctaatgagggatatcccatggcagtaggcagaaaatggaaggtgcatgtgtgtgaactggggatggggggtgcaaactcagcctttttattgggaacccactccttggatagctaacccactcctaggataactgcattaattcattctgtagttaatgcttctcactttttctcaagatgttctaactgaatctacctcatggaaccctcatgatctagtcattcattaatgatcccatctcttaatattgttactgtggtaattaaatttcaagatgagttttggaggggacatccaaaccattgcactgtggtacttccagattagaaaaccaaagaacaagaaacagcctctgttttaataacgtgcgatgatggatggcatcatcactcattccatctttggacaactttgacctttagaaactttttttataatgaacttccctgcctccctcttgcttcaattcattcatcccaattctatctctttctcacaaatagagaaatagatttcccaaattagtaattccctgagaattgcccaaagttaatcagtattcttagtctttgttactcttcttctgcttctgtatcactggaaggaagaactttaaaaatgcctcaaaatagagataatttgttggatgcatgtagagggctgaataatggccccccaaaatatcagcttctagttctttacatctgtaaacatttgttgataaagggtctttgaaggtatggttacattaagtatcttcatatgggtaggttattctagatcagggtgtctaatcttttgacttccctgggccacactggaagaagaattctcttgggccacacataaaatgcactaacactaacgatagctgatgaactagaaaaaaaaatcacacacacacacaaaaatctcataatgttttaagaaaattgactaatttgtgttaggctacattcaaagccatcctgagccacatgtggcccatgggccatgggttggacaagcttgtcctagattatctgggtgtgccctaaatacaatgacatgtatccttacaaatgagagtctgaggaaaatttagtatagaaagaagaggagaaggccatatggcctcagaggcagagattagaatgatgtggccagaagccaaggatgccagcagccaccagaagattccttagcacctccagagcaagtatggccctgccatcaccttgattgtggcctggtgaaaccaactgtggacttctggcctccagaactgtgagataataaatttctcttgttttaagccacaaagtttgtggtgatttgttgcagcagccatagaaaactaatacagtgccaaaattacactaagcacattatagtttaaagtagatgacacaatgattttttttagaaaaattgtgattcattaactgaaaaaagaaacaagcaaaaatttagttttcttccaaagttttatttgaaaaaatatagattataatattaattttgaaagcaaattatactaacatgaacttatgtagtagaattatttaataagcattcagcttaaattgcttaataaagttataaattgtatttgtccaggtctaatgtagtttaaaatatcttttggatatcataactaatcatattatttccacgttcgtgatggaattaaatcaattagttataaaataaaatttattcttaattagtatgccaaaatttatacatacataaaataatctcttaaaatattcacttcgaaaagtggtatatttatttcagtaatgcttccattgctttgattttttcagatttttttctccagtaagagcttttagaacttgtttaaatatcctcaacagaagcaaagccatgaattcataaccatatatacatttatataatcaaaattgatttggagattctgctttggagaatggtagactagcctactcagaccaactgtctgaatgagaacaattacaaaatctggtaaaaaaaaaaaaaattcacttgatgtcactggagagttaacaagagaataaagagttactgggccaagattcatgctaacataaacatccatagatatgatggtggccttgggtgctgtttttgccctggggacatttggtaatccaagagagcacctgtcagacgatgcctttattaaggcccatggacattatctcctatgccataggggttgtggatttgctagtttaaagaaaacacatgcaaagatgagagcttatttacctgactctggtattgactattaggttttaccatggtcagcagctgtgggctgtgtcaggtttgggtcagggagatgaggaacaaggaggctacatcttaaccgcacggggaggggacgttttaacaaggccaaaggtgatgaggtacatcagggtaaacatgtgttaggcctaaaaatggatgtcaaggcagcaactatattaaacaaatttatgatgggcagtgattactgtttacctctaaggggcagggagtatattgtgattgggacagtacctgcaagagactaccagagtgttgaaaaaaaaattttttaacatcaatcatggtaacatgattaaaataatgtaaactgttcccacagtatttcttcttagcacttttctgtttgtataatatttcacaataaaaatagctttccttttcctttttccttttgttttacaaaaagtaatttgaagtcagttcggtgaataaagtctgtaattaaagagggaaatgccaattgtggtttaaataaggtgtgactctgggtaaatgaagtcagttttcttgttgtccttaaaagctgtttcataagtttatttccaaagagcatttccaaaaacatttgtagcacagccaatactgatggaaggaagggtgtggcttttttagggccaactctgaaaatgacagtgcttaattaaatattgattatgctgtggttgccttaacaaatgtaacttcactgtaacatgttttatttaaatgtatgaatttttcttcttatgggattcactttagtaacaacctcttaaaatcctgtcaacttataactgtgaaagcaaaggcatatctctgatgctcctggcctttgtgtcattaaaatcttactctaaatgtcgcattaattcatcttttcaacatttttccttgtttgatttttttctcctggaagaaaaaatgctaagtggaatgaaggaaggaaaagacaggcagtttattaaaagtcaaaatataccatacaaacccctaattgtactctaaaatttctttttaaacgtttctattaaaaaattctgggccgggcatggtggctcatgcctataatcgcagcacttttggaggccaaggcgggcggatcacctgaggttgggagttcgagaccagcctgactaacatggagaaaccccgtctctactaaagatacaaaattagccagtcatggtggcgcatgcctgtaatcctagctgctcaggaggctgaagcaggagaattgcttgaacctgggaggcagaggttgcagtgagccgagatcgcaccattgcactccagcctgggcaacaagagtgaaactccatctcaaaagaaattaattaaataaaacattctgtttccaataagataaaatttgagaagagaatgaaatccagatttagtgtagctgacccgggatcactgactcttttttagagaaggaactgggaaactgcagtggacatcatgctctggagcaacagtgactatggatttcactgtatcatcggtcgcagcatggaattctatacactaaaatcgctggatgagatgctggtgggaagaccctaacaaaatcgtgtttctgacagaaagtgtatacacattatgagcaaggagaacattagttttcagcttagctccttgtgcagttgaatttgttactctgttctgaagacattggtgccagataaaagctttaaacacaaaacgttgttactgacatgttaatataattatgccacgtattatatatacaaaactttaaaagctaaatttagaagttattgctgtatcatttatataggctttgttctccttaaacacgttgactttaataaggcatgttttgtacaaataaagtctaattctaccatcagttgcagccacaggaaatttgaagtcatttttatataaaatttaaattccaacacttaattcaggttctatgacaccattttctagatccaagaaggaaatcattggctcaggattttctacagcgatctatcctgtatgttcctcagataatatgcccctagaatattattttttataagaattaatggcagaaacatttgagcttatcactgatggcatttgttgactatcaaaattgtctaaaacctcccacatttatccaggtataaaagtaaacttctaggttgggtgtagggtaggttgggagtcaaaagaggacactctatagagtcacagttcataggttttcctaaagaacactttctaaatctaaatttttcctcccactaagccaaatgaggagggctccagggaaatcactggtgatgattaggggtcctacaagaagcagggtgttaaccttctcactgattggattcttgctgagctgttgaacccatagctcatccttgcttctgctgccagagaggaaaatatggaaaagttcatgggccatttgccagagtttgtggatgtatatgaactgagactcttgaggctaagaggctgcatggggcagcccacaccaaaaggcaaatagggcccatattgtagtgtgatgcttaaggagaaatatatggaacactgacctccccacccccaggatccctgtgactcttggagggtcaagggagcatcatcatggagacagaagacagagaaagagaggaaaagaggaagccgagcccacccttttcctgtctaggtcctctagacaaagctgtgaagggaaaaaaaatagaagataaaatgggatttaaattttaaactggactaaattgcaagtgaccagaaagctaaagggtctgctcaagatgtcataagggaaaagtaaaattatttcccattggtacctcatcgagttcatattgttcaagaaactggatataatacctagtgacaaagagactaggacttctgttttgttcttgtcatacagccaaatattgttctggtcacacagccataacaatacccattggggcagaacactgaactggtaagaaagtaagggaaatttttagaggccttaaaatagaaagtgagaattcaggaaagtagactcgttttagattagtcttttctcagaggacatctgtccatcctgggtagtctagggcatgaattttaaaagcctatatgagtatcaagtaaaaaaattgagtagggtggcagtcagttcagagactcctgaagagcaatacgattattagatgagtagggggagaaggctttagagaaggagatgatggaaataatcgttttgtctttggctattaataggtgaaagacaggagaaaaagtctccctagaaaattcctaattccaaattctaagtctattcttgttggcgtgtctcactaaaccccatgtggcccaaaaattcaagcaaaaatttaaattgtctttttttttcccccactcagtaaagatttaatgatgaaaaaatgcaagttttataatacaaatatataaaattatgaaaacaatttttataacaatcatttgatagtctttttttaaaagactacagaaagtttaaaatataattttgtaattatagatataaacaatgaagttttataaaattaatcatttgatatttttaaaaaggctatccaaaggaatttaaaatcagaatgttgttgaaactgaacaccaactgtatctacatttatttctttttttaaaatactttaagttctagggtacatgtgcacaacatgcaggtttgttacatatgtatacatgtgccatgttggtgtgctgcacccattaactcgtcatttatattaggtatttctcctaatgctatccctcccccctccccccaccccacgacaggccgtggtgtgggatgttccccttcctgtgtccatgtgttctcattgttcaattcctacctatgagtgagaacatgtggtgtttggttttctgtccctgcaatagtttgctgagaatgatggtttccagcttcatccatgtccctacaaaggacggcattattcacaatagcaaagagttggagccaaccctaatgtccatcaatgatagactggattaagaaaatgtggcacatatacaccatggaatactatgcagccataaaaaatttaaactttctctatttcagtactgcccccagctaccaggaagaagcaaacacatctcctctctggagaagcacacattaaatacagaacaaaaaaatttccagataaaaacaaaagtcactggaaacataagaaaacaaaacaacataaggataagtcagcaaagagcacaaatggcagaatccaacacataaagattgcagacattgtaattatattcagattatagaataattattagatcatacgaaattgccatttttataggtcaaagctggtaactatctgcagttccatatgcttaacataatgtttttaaagaaataagagagtactggaagtatgttgaagaaaagaggattaaggattctcaaaaaggactagaagctttgataagtagccaaatggaatctctgcaaatgaaaaatataattgaaattagagacttaatagaaacattaaacagcagatttgacacagctaaacaaagagttgataaactagaagataaagcagataaaagtactcagaatgtatcacggaaaggcagaaacaaataatatgaaagagaggttaaaagacttgaagaagagagtgataaattctaacatctaaccaaattttgagaagtaaataacagagaaaatgggaagagcaattcttccccattgtctttattatttccttccaaatttaaagatctaatagttgacagtttttctgagtggattaaaagcatcgggttccaaaagccaaaaaaattccaagcaggataaaatgaaaacaaatctatatctagctacattgatgtcaaatttcagaacactaaacacaaaaagaatcttcaaaatgactagagagggccagctgaggagacttcacctgtgttccaagcctgagaaacagcaccatgggccacccctggcagacacgtccctaggctggctgagcagctgtgcacccatgtcctgggcctgagaaagagccccacagactgctcctggcaagcatgcccccaggccagctgagaaaccatgtgcccctagacagagtaacagccctgtggtcccaaccccagtgagccagaccccaagaaagctgacccactgtgtgcagacatatgcctccaatctgagcaacagctcagcaagcccacctctggaaaagttgcaccgctaccagcacaaactgtctaagcctaggccactgagacattcataaatatcgctagtatggattacagcttaagaaactactggagactatactactgtgtctacccagaagcaaagccaatgcactgcattgagcccacaccccaacacccacataaatgaataaatcttttcctattaaacctactccataaaattggaagaggtgactgtttcatcagatgtgtagaaatcaatgtagggacacaataaacatgaaaaagcaaggaaacagacctccaaaggaacacaataattccctagtaataaaccccaatcataaggaaataaatgaaatgacagaaaaagaattcaaaataataattctaaacaaattcagtgaaatataagaaaatatattcaatgaaatcatgaaaacaataagtcattattttaatgagaaattcaacagagatagatatcatttaaaatgaaccaaattctatggctgaagaactcaatgagtgaaataaaaaatacaattgagaacttcaacaccagactagaccaagcagaatttgttcttacttgaagacaggtattttgaaataatacaggcaaacaaatagatgaaattaaataaataataaaaaggaattaagtcaaaggatttatgggatatcattaagtgaacaaatatttgcattgtggacattctggaagaagagaagggaaaaggtgcagaaaacatatttaatgaaataatacgtgaaaactttccaagtcttgggagaaagatccaggaagctcaaagaaccccaaatagatataatccccacaggtcctctctgaggcacattttagtcaaattgtcaaaagtcaaagacaaacagcaaaagaaaagcttcaagtcacatataaggtaatctccatcagattgatagcagatttctcatcagaaaccatgtaggccaggaaagaatagaatgataaagtcaaagtagtgaaagaaaaaaaataaaacttgccattcaatattatgcccagcaaagccattctttagaaatgaaggagaaataaaaattttcgcagacaagcaaaaattaagaaaattcatcaccactagaccaaccttacaagaaacgcttaagagagtcttacatctagaagcgaaaagacaataaccactgtcatgaaagcatgcagaactataaaacttattgatggagccaatacacaaaggagaaagaaaaagaatcagaccatatcactacagaaaaacacccaactgcaaaaataagagaggaagtaaggaacaaaggatatacaaaacaagtaaaaagaaatcgataggatgataaaagtcctcaccgatcaataataaccttgaatgtaaatagattaaaatctccatttagatgtagactgactgaacagattaaaaatacaagatacaatatacagcccacaagaaactcatctcacctataaagacacaaatagactgaaagtgaagtgatggaaaaagatactccatgcaaacagaaaccaaaagcaagcagagtagctgtacttatatcagacaaaacacacttcaagacaaaagctacaaaaagagacaagggcattatatgatgacgaagagattaattcagcaagagaatataacaattgtaaacatatacacttaacactagggcacctagatatataaagcaaatattattagatctaaagggagagatagactacaatacaataatagttggggactttaacaccccactctcagccttcgacagatcatctacacagaaaatcaacaaagaaacatcagatttaaactgcactatagaccaaataatataaacctaacgacatttacagaatatttcacccaatagctgcagaatatgcattttttttcatcagcacgtggaacattctccaggcttgaccgtatattaggacacaaaacaaatctcaaaaagcttttcaaaatcaaaattatggccaggcatggtgtaatcccagcactataatcccagcactttgggaagacaatgcaggaggattgtttgagcccaagagtttgagaccagcctggacaacatagtgaggctttgtctctacaaaagattaaaaaattaaccacccgtggtgctgcacacctgtggtcccagctactcaggcggctgaggtgggaggctctcttgagcccaagagggttgcagtaaggatgcagtgagccatgatcatgcctctgcactccatcctgggcaatagagtgagactctatctccaaaaaaatattgaaattttatcaagtatttaatctgaccgcaatggaataaaactggatatcagtaacaagagggacatttgaaactatacaaatacacaaaaagtaacctgctcctgagtgaccagtgagtgaaggaaaaaatttaaagtgaaatttaaaaattccttgaaacaaatgtaaatagaaacacaacataccaaaacgtacgggacacagcaaaagctatattacaggcaagtttatagcaataaattcctaggttgaaaaactaaaaagatttcaaatcatcaacttgagatgcatctccagaaaccagaaaactgagaacaaaccaatccaaagttagtaggaaagaaatgataaagatcagagcagaaatgaacaatattgaaactgaaggaaaaaatacaaaagatcaatgaaataaaaagttggttttggaaaagaaaaacaaaattttaaaaacctttagctacacaatgaaaaaaagagaagactcaaataaatcagaaatgaaaaaggaaacatcacaatgaataccacagaaatacaaaggatcgttagagactataatgaacaactccatgccagtaaatttaaaaacctagaggaaataaattcctgaacacatacaacctatcaagattgaaccaagaagaaatagaaaacctgaataggtcaataacaagtaataagattaaatcagtaataaaaagtttcccaaaaaagaaaagcccagaattggatggcttcactgctgaaatctaccaaacccttgaagaaaattaatgctaatttttcttaaactattccaaaaatttgaagtagaggaaatttttcctaactcattctatgagaccagtgtaactaactagataaggatgcaaccaaaaaatgaaaaaggttatacaggttaatatccttaatgaacatagacacaaaaatcctcaacaaaatacaaaccaaatccaacaacacatcaaaaagataatacaccatgatcaagtaggatttatctcatgaatgcaaggatgattcaacatatgcaaatcaataaatataatacatcacatccatagaatgaaacacaaaagttatgtgattgtctccaaagatggagaaaaagcattcaatacaattcaacatcccatcatgataaaaactctcaattaagatggtatagaaggaaagtaccttaacataataaaggccacatatgataaacccacagctaacatggtactgaatggggaaatctttaaagctttttcactaagaactggaaaaagacaaggatgcccactcttaccattcttattcaacatagtaatggaagccctagccagagcaattggcaaaaaaataaataaagggcatccaaattggaaaggaggaaatcaaattgtctctgtttgcaggcacatgaacttatatgtagaaaaacctaaaggctatatcaaaaaactcttagaactgataagtgaattcagtaaagttgcaggttacaaaatcaacatacaaagatcagtagtgtttctgtacttgaacaatgaactaatgaaaaagaaatcaaaaaggcaatcctacttacaatagttacatttaaaaaaaacctaggaataaacttaaccacagaaatgaaagacctttgtaaggaaaactacaaaacactgatgaaagaagttgaagaggatacaaatggaaagacatctcatgctcatggataagaagaattaacattgttaaaatgaccatactacccaaaacaaactatggattcaatgcaatctctaccaaaataatgatattcttcacagaaatagaaagaatcataaaaatgtacatggaaccacaaaagaccatgaatagccaaggcaatcctcagcgaaaagaacatagttagaggtatcacactgctagacttcaaaatatactacaaagctgtagtaaccaaaacagcatggtactgttataagaatagacacagagaccaatagagcagaagagaacccagaaattaatccacatatctatagccaactgatttttgacaaagatgtgaagaacactcactgaggcaaaacaaaacagtatcttaaataaatggtccccaaaaaatcagatatccatatacagaagaatgaaactagacgctcatctctcatcctatactaaagccaactcaaaatggatcaaagacctaaatgcaaaatctgaaaatataaaactagtacaagaaaacataggagaaatgcttcaggacattggcctgggaaaagattttatgaataagaccccactggcacagactacaaaagcaaaaataaacaaatgggattatatcaaactaaaaagcttctgtacagtaaaggaaacaagaatgagaagacatcttacagaatgagagaaaatatattcaaacttttcatctgacaggaggtcaatatccagaatatgcaaggaactcaaatatcttgacagcaaaaaaaaaaaaccgaacaatccaattttaaaatgggcaaataatctaaacaggcatttctcaaaagaagacatacaagtgaccaaaaaatacatgaaacaagtgttcaacatcatgaatcatcagggaaatgccaatcaaaaccacaatgaggtatcattttaccccagtcaggatggctattatcataaagacaaaaataacaaatgctggcaagaatgcagagaaaagggaacttatgcactgttgatggggatgtaaactagtagagccactatggagaacagtatggaggttcctcaaaacactaaaaatagaactactatagcatccagcaattccactactggacatttatgcaaagggaaggaaatcagtatatcaaagggacatctacacccccatgcttattgcagcactattatatagccaagatatggaatcaacctagggtgtccaacaatagatggatgaacaaagaaaatgtggtatgaatatataggtatatgtgacggaatactattaggctaaggaaaagaataaaatcctgtcatttgtggcaacatggatggaactggaggatattatgctaagtgaaataaggcagataccacatgttgtcactcatatgtggaagctaaaaaatattgatctcatagaagtagaaagtagagcagaggatactagaggttgagaagggtagagagggggagagagttgttaaaggatacaaaattacagatagaagtaagttctagtgctctatagcactgtagaataactctaattaacaataatatatagtttcaaatagctagatggagaatattgaatgttttcaacacaaaaaaagataaatgtttgagatgatagactatgctaattactccaatctgatcactatgcattatatgtatcaaaacatcactatgtaccccataaatatgtacaatttttacatcaattttttaaataaaataaaacaactagaaataaaagacagattgcctatcaaaaaacgactgacagctaacttctatgtaaaaatggacgctacaaggcagtagaagaccatctttcatgtgctctgataaaataacaattagaattctacatgtaatgaaactatctttcaacaagagcaaaattatcatgcaaaagaagtgaaaggaatgtatcactaccctatctttaccaaagaaatgtctacaaaatatattttaggaagaagaaaaattatctcaggatgaaagtttgagatatcaaaaggaatgataaatactgtggtaagtggggcttaatctaaacaatcatggactgtataaagaaaaagcaataatatccactatgaggagttaataagaacccaagtgacttctaactactggaaaataagagcatgcaaattgggaaaggatataaacgtcctctattgttcggaaaaatggtaaagctacttagtagttttagactggtaagaacactcactggggcaaaaaaacagtgtcttaaaataaatgttgctgggaaaactggatatccagatgcagaagaatggcttcttaaaaagccattcttctgcatagctttttaagttgaaattaattaaagtcatgtagaatattaaaatttagtcacctgcattaataaaatttaaaacttatgctcatcaaaagatctattaaagtaaaaagaagccacaattggaagaagatatttgcagcacacaccaacaaagcattagaatcatgaatatataaaagacttctaaaaattgagaaaacaacaaacaatgccatagaaaaatgagcaaaaccatgaacaaacatttcatagaagagaaaatatacatgaccaataagcatacaacagttgctcaatgtcattaataatcatgaaaatgcaaattaattaaaactacagtgagatatcattttaattcactaaactggaaaaaattagactctgaccatgccaggtatgcacaagtgtgtggaacaaagggaatgctaatcgaatgctggtggaagtgtgcattcgcaaaccacattggaaaacgttgtggtgatgcctatggaagttgaactcttacatatttatgacttggcatctccactccaaggaatatattatagactagagaaacaattgtgcaagtgattgaagacactcatcttagcagcattgttcgtagcagcaaaattctggaataatccaggcatgacgtttggctctagaatggaaagagaaagcacattatagtcatatggtagaattatacaaatgaattagctataggctttaacaaggatacaattcaaaaacaatattcctgagaataagcacaggatatctcatgatcccaattatgtaaagtttaaaatcaggcaaaagtaagcattgtattatttagtgattcatgcatatttggttaaatggtaaaaatacatacttgaaaaggaggactaacttttgtggggaaagtagacaacaagaaatgtttaggtgtggaggtactcggtatcaatctcaaagtatactcataatgttttcttctttttactgggtggtgggtacctttattattttagaatacatctttatacttttacatatatgcttatgttgcattttgcaattaaaattttttcaagagtttacagttatataaacatatatactatatttacagccatgaaaaaattgtacatatatatatatatatatatatatatatatatatatacacacaaacacactagtatgtgtgtggatgggagagggagaaagattgattttaaaggaatataaaataaaggtgtatcacgaggtgggactaaatgaacacatttacttgcagaagatgaatttgactttactgtgcttttttggattgtgccgactcataaatctaactgggcttttagtagacaggagacgattgaacattattccatcttatgtattttcaaacagactgtattattttgggtgttgtgtgtctcacccacactgtcaagattctgtaaacctgcaacgtgatccattcggctgcgctctagttattatccaattatcatccattctgcttattaacaggcataaacagacagtatttctgcatggagctgataccctccattatgggtcaccggtcccgttcttaagtaggattgtgaaggaaaaaagcagagaacttcatcttcagtactaatttctctcacttaattccttctgttttactctttctcaagaatgggcatttatcctctactggtgaagaaagggcagagttgtaggagccatctacggtaaatgcaggctttcaaagggtggggggggacggtagagattttaaacgtaataataaaactgaacaaaatttgatctgctgtatgttatcactatgcaattctaaacagtgttagcatgaaaatattcctcccctagaaattattttgttgatctaagagtactgaattgctacagttacttttgcattgtaataatatatctgtaagcttcaaatcagcatattatattctacatggacgttaactcagagaaccaagagttgcacagggactgccagcacactcagtgacacacacacgttttgatcgtataataagtgcctaacagggtggaactgggcacagggcatgtctcagacctgtatggtacttttaaaaaaataagttaaaataaacactggggcatggtgatggaaaagatgaaaaaacagaacgtaagttatttcaatgttgtcactcggtgtggccacttggagtttatatttgcattttactgttgcatttgaaaattgttaaagtgaaagtgacaagtgcaagacacactctttttgtttggtaaatatacatttcagtccacacatgagaatagttattgaatgttagaagtatcttttaaaatgaaatgtatgttttttcctatcttttggttttaaaagtgaaagaaaaagaaattttagaaaatttaaccttatgttacttactagtataatttagtggttgcctaaattgtactgtttgcatacgtttcagttttattaaagatcacttattggctgttgtcagtaaagagaggatgttaaaaatgatgtgttctgagtgtcaaatccataggtgtactctgtgatcctcttttccgatcagttccccgagtgtcagtaggaaatctaaacagctaaggaccaagcacaggaggagatataaccaatggacttttaactgaggggacacggtttgcatattttttttatttttattttttattttttgagacagagtctcactctgtcacccaggctggagtgcagtggtgcaatcttgtctcactgcaatctccgcctcccggattcaagtaattctcctgcctcagcctcctgactagctgggattacaggcttccgccaccacacccagctaatttttgtattttttagtagagatggggtttcaccatcttggccaggctggtctcgaactcctgacctcctgatccacccatctcagcctcccaaagtgctgggattacaggcgtgagccatggtgcctggccggtttgcatatttgtaacggtgtctttagcacctgcccgtcatctttcctaaacttggtctgcttgagaacacaccttgcttgccatgtcgtttataggataattttccatgaatggaattatttgaatctcaaagattttgtcaaaaaatatattcaaagcttgggtgtaatagacattacacctgaaattacatcctttgcggttatctcaatgtactttaaaatgtttagacattatgctaaaaatatgttaaaagggggcgtcattttttcaatttctcttagggatcacacaaggaagaaaagtttttcaagactgctgatgtaaaatagtgttatcagacagtgttcacatttggagggattgttggtagccaagtctccttggtgtttcttgtgaaagaattcttgagaaagaaatatcaggcaattggggtatattccttaaacatatagtagggaatggggctggtgaatcagttctgaatgcctgttttcttctttaaaattccagccaatgatatgaagcccaggtatgtgggggccttttgatgacagtgagggtgagactaaggaagctgacctgccctgcccagggacacaaggctggctagcaacagagccaggacattagtcagtgtgtctggctctgaagcccccatgggggacactgtctcccatctcctttctcctgtgtttagccttgactttcaccttcaatgtcatgccagacaaagagttgctatggggcaagtgggaaaggcaaaactttttctgaactgctctttaatttgtcaatatagcccaaatctagttgcaatctggtacacttttagtcatgaacgagggtggaagaaagctaatatcacatgttgacctttcattttgccaccaagaagctctccttgaatattctgaaggagaacacgttcttgctgggggctggataaaccttaaaaatttcatgcccctgaatgagcatttcccctcatcacggacttgtccctggggctttcttaggcatgggcaggatgtggattgaaggaagaaacccagtgtcatgggcagcaaaggttgaatgtcttctgtgtctagtcctaacactgacttggagcccattcctcatcattttatcttactttctcccatctgaaaatatttacaaaatcatgtttgatgtcaaaatactaaatactatttggggggccgggtgtggtggctcacatctgtaatcctagcaatttgggaggctgaggcgggcagactgccagagctcaggagttcgagaccagcctggacaacacggtgaaaccctctctctactaaaatacaaaaaattagccaggcatggttttgcatgcttgtagtcccagttactcaggaggctgaggcaggagaatcacttgaaccctgaaggcggatgttgcagtgagccaagattgtgccactgcactccagcctgagcgacagagcgagactccatctcaaaataataataatagtatttggaggattttcccagagcatttgggaagcatttgtacacaaatgagtctgtgagcaaagggccaaggcaaggggcaggagctcagatgcaggctgtgttgatggggctcaaatccagagccccatgatccctatcccgtgctccactgcaccatcctattatcctattttgcattttatttttacattcctataaataaaaagtgcaatcaaataacttgaaatatggtattgcttttgtgcttaaaaataatctcagaaatacagcaaacatgccattcacttgaaattctaaaaaagggcaaaactatgttgacagaaaacagatcaatgatttcctggggtgctgggggtagcagtgggtaggaagagaattagctgtgaaagggcacttggaaactttttcagatgagagaactgctgtatcctgatggtgagggtggtttacacagctgtatacggttaccaacactcatcaaactgtgtgcttaaaacactgactatgcaatacctttatgcttatgtctttttataatttaaatagggagaaaaaatatgtattttgtaatatacatattaatacacattataagatatatataaatatcaataaataataccttatttggaaatagggtttttgcagatgtatataattaggcccaccctaaatccaatggctggtttccttataaaaaaaagggagagggggctgggcgcggtggctggcgcgcctaatcccagcactttgggaggccaaggtgggcggatcaccaggtcaggagatggagaccatcctggctaacacagcaaaaccccatctctactaaaaatacaaaaaattagccaggtatggtggcgggcgcctgtagtcccagctacctgggaggctgaggcaggagaatggcgtgaacccaggaggcagagcttgcagtgagccgagatcgcaccactggactccagcctgggtgacagagcgagactccatctcaaacaaaaaaaaaaaaggagagggatatttgagatacacagacacagagttatatattgtacattttacaaagaaaaaaatgtacatatatatgtatacctatatacgtatgacatccctttctattctgtcttccacaaatgtgagtataagtcttcacagtgggaagtaggaatgatcagagatggagtattagtttgccagcactgccgtaacaaggtcccacagaccagatggtttaaacaacaggaatttattatctcacagttctggaggctcagaatccaagatcatggtgggggcagggttggtttcttcggagacttctctccttggcttgtagatggccgccttctcactgagtctccacatcctcttccttctgtgtgtgtctgcatccaaacttcctcttcttgtggggacaccagtcatactggattcaggcataccctgatgacctcattttaacttattttcttctttgaggaccctatctctaaatccagtcacattctgaggtacatgggattaggactccacatatgaatttttggggggacacaattccacccataacagatggagaatagtgcttgaggtctttactaatttactcaccttggctctatttgaggttttctgccaggagcaggtattttataatttaaagtatacatatgggaaaacacacacacatacacatatatatatacacatatacacatatatatacacatatgtgtgtgcatatttcaaacaaggcagagatcatctgtgacccaaatatgtgctgatgagatcaatggactgtgctacttattggtcccataacatatcacttgtaacctctatctatgaccttccacgtcagtgcaataactaatacagccatcatacacagctgtgcaagagttaacattttattcttctgtgactgaacttctgtttcgagtcccccttttctcagagttgcatctcagttggtggggctgggggtgtctgtggtctcaggcagggaaggcaggcagctcttctggacctggccagagtacatggtcatttctccaggatggtctcccttagacagcctcattccctacctggccactcacatgtgttattgctgcaccctctgtcctgaccctcaggcttcttaagtttgactctgaagccgcactctctgggtttgaatcccagctctactcactatgggctctgtaccttggccacttcactttactttacttctttgtgctttgattacctcatctataaattagagctattcataatagtatctacttcatgtggctgttgggaggattaaatgagttagtatgtgaaaacatttgaaagcgtgtctgccccatagtaaaagctgtatactgtaagtgattcccattattagtagtagtagtagtattgttactgtgatgtcacatgcctcattggtgttttattttggggagcacataaagtactccatttgcctctcttagctgcaagagagaaattctcctgggttgtctcgggtccatgtgctggacccatatttctgctcctgcatcatgctgggaatacagattgtggagctggggtgcagggaggtgtatgactttgccagcttcctgtatttcccttgagaagtggagcggtgctaattgtccctgtcccggatgttccatcaactgtgtggtcccataccaacccctcaggggtgtctgcccaacccccaccccagctttctttccttctttacttagcatctactcctcaggagactgctttgcccagtatgccctaagataataaatgaccttctgagagtcaaatgccaggactcactcttggtctgtttgtcctcacccggctgctcccttgggggtaggccaggacacacactgggtgagaagcgtggtggaggaaaattatctgagttaatttatcaaaatacattattccccagtgacactagggaaaccttacagaggccccgccagcatcaaagagcaaggttctgtttcccatgttccgttacccgatccccagggcctgaaacagagtccagggaatatttggaaactaatcgtcatgagtggtagcatcctaagcagtaccattgtttacctcctaagatcccccaataattgtggttggctatttgttttctagtcatttagacacacacacaaaaattgtttttcaaatgagaaggggaatccacaacaaaaaactgtggctagcttattttcgagtttgaatgctttgtgtaaattaataaagttgaagtctatcccatgtgtataaaaatcttggagttatgttcattaatgagtctattgaattagttttcataaattcttctgattcaattgcatattcttaaattaacaacaaaagtccaacttgtatcattaaagactcaaaacagatggtgggaacagtaaagtgtaggaaagtgggaaaaatccttaaaaaataaacggttctttaaaataaatgaataccaaataaaacagaaaagtataaagagctatagttctttttttttttttttttttttaactgagacagagtctcgctctgtcacccaggatggagtgcagtggtgcgatctcagctcactgcaacctccgcttcccgggttgaagcgattttcctgtctcagcctcctgagtagctgggattacagatgcatgccaccacgcccagttaatttttgtatttttagtagagacggggttttgccatgttggccaggctggtcttgaactcctgacctcaggtgatctgcccacctcggcctcccaaagtgctgggattacaggcatgagccactgcacccggccgggagccatagttcttggtggaaagcaaagcttttcacatcagctagtgtagtgtctgaaaaagtcctcattatagatgggacaaaaagatttagtgggaagaagaaagagaacattgagacagttatgaaaagttttaattgtaaattttaattctcatgtgaaatgaaaattttgggatactttcacacacacacacacaaatgttatcctcagattaaaatatttatgtgggaaatgtttagaggtaaaatgtttagaggggaaaaaaccacttaccatgattgctgccagaaagggtaaaccttagaatcataatactgcagaatttaatgatcctttgtgagcttctggttcaacactcgttttacaagcaaagaaatggaggctcagagagattggttaggtgagccctgcaaggactcatggctaaatagtggtgaaatcagaagctaaagccaggttttctggcttttattccaggactgagatgtagtgacctgactctcgtaagtttctggcttcttccttttggagccacaggtaagcaccagtctagaaccttccactcagacttcatgctccagggttgtgaccagagcttacaagggtgttgtcctgggctggaagcagagactgtgaaactcaaatatacttaggcaaatgcaagcatatgaataaatcaccgaaatcaggacaaacagcttttcttagataaattgcccttggaaagaaaggtgaaaactaagccataatgcatgaatgtgttaattgtttttctcttctacagacactaatttattctgaagggaatgcttcatttccaaattctccttctactttaaagaaattcaaacttcaagaaaaaaattcaacaccatattgtgattgcttcaatagttaagaatttcggctgtcacgactgaaaaaaatcattagcaaaaactggccgtggaaaagggaagtctgtctagttcatgacaagcatccatcatcgtatgtgagttagtaatttctcacctctcatttgagagaggcaaggtacctgtgtgccattggggtgggctttccccgcagtgacagatccggatagatcaccagcctggctaagctccaagccttaaattcctttacttctcacccctgggccatttccgccacttttcctccatctcctttatccatttaacatctgttacatatatgtatatacacacacactttaagttctagggtacacatgcacaacgtgcaggtttgttacataggtttatatgtgccatgttggtttgctgcacccatcaactcgtcatttacattagttatttctcttaatactatctctcccctaggcctccaccccctgacaggccctggtgtgtgatgttcccctctctgtgtccttctgttctcattgttcaactcccacttatgagtgagaacatgcggtgtttcgttttctgtccttgtgatagtttgctgagaatgttagtttccagcttcatccatgtccctgcaaagggaatgaactcatccttttttatggctgcatagtattccatggtgtatatgtgccacattttctttatccagtctattattgacgtttaacatcttttatttatttttatgttttactttttgagacagggtctctgtcacccagactggagtacagtggtgcaatctcggctcactgtagcctctgtctcctaggttcaagtgattcttgtgcctcagcctctccagaggagactttgacaaatatatatatacacatacatacacaaatatatatatatatatttgtcacaaggatttgaccttatgcaattatgtttgctggttaagcagcctctgtgaggctgttgtctttacatctgaccatgagatgttggagcttgaagtccaagaggcaggtggtcagcagaggaagatggatatgaagtcgggagagcagggatgggctgggacccacaggcacacacagaacccatgaagacccaccggaactcaggtcagttatcgctgcctctctgggtgctatagttgtcctacaggatatgccggctcccatcatcacagacatacacacgcacctggcccaagagtcacagaagctgaaggaaaattcagggaaggtagagcagttgtgacttggctactgccccacccagcaacatgagccacagataaaacaggtgtgagctacagaatggctgccgcttccctgcctcctctgaatctcacatgtaagcatctcttgtggcccactctaacaagaaacattcaggaaaggagatctgggggagggggagcctctccaagctgacactttgcaagccacccagtctacaatgtggagaatggttgcaaagccttccacacttcttcctgccaatcctcaccctggtctccagggtcaagtgtgcactttctggggatgcagcctctccaccccacacacaagttgtaccgggaaaaactgagatttccagcaggcagagattgagaagcagcagctaataacattacaaggccatttggcagcagcgcaaaccttcaccattacaattagagcaagtggaggtaaaagagactctcttaatggccaaatcaaataaaaagtgacaggcttctgaagattatgttgaaccctgtatggcatgttaatgaaacaaagggtcagataccatttcatctgtggcttatctgcttagatagaagggatgtttttctgcctagtcctacctgaggatttccaagccacccctatgcatgaagatctgacacatttttgtccgcacttttctcagagtgttggggaaccaggactgagccagcagcgaaatattctgtgatgtaaggtggaatttagaataaaggtattttggtgatcaagcagctcaatggtccttaaccttgactgtaaccttgactgaatcacatgcaaagctttatagcctttctgatgtccaagctgcccagagatttttagggtgcacccaaggcatcaccagttagtaacgcatcccaggtgattccaaggtacaaccagagtctagaaccagggatctagtctaatccttttttcagataatgaagctaagtcatagagaagttaggtgtgttggccagtagtaaatacaaacagtagaacccaagtctcccaactcttaaacttatcaccttccactatatgccctgccatatctgctattgagaagagtgagaaacacacattaaaactgcatactctactgtgttccaagaatgggatgactttgaaatgcatgctatttgtagaatataggtagtgagactgatgcctggtcattcgcctacagccttaacacctcctggaagtctgattctttcagtttaccttgcccatagtgtgagacagagaaggaaaatagacgagtctcagaatgcattgttcagtggaatgcattttggaatgatcctacaaattacaggaaagctttaatcgccaataattaggtgtcttaaaaatggagttgtcttctggcgtatgctgacattatcagtccaagatagacttgagccaggagcctctgtgacagtatgctttagaaagagtgagagagggagcatgtgtaagctaagaaaacctttgtaaataagcaaagtcttattcaacctacagtctgtcctcagagctatcatttatcaggggaacccacccctgataattcaacatgagtccttttctattttccgtaagcgtcggccggtctgagaaacaaagggaaagagtacaaagagataaatttttaaagctgggtgtccgggggagacatcacatgtcggcaggttctgtgatgccccctaagccacaaaaccagcaggtttttactagtgattttcaaaaggggagggagtgtacaaatatggtgtgggtcacagagatcacatgcttcacaaggtaataaaatatgacaaggcaaatggaggtggggcgagatcacaggcccggggcgaaattaaaattgctaatgaagtttcaggcacgctttgtcattgataacatcttatcaaccgtaaaagacagacattcctagagcggccattttagagacctcccactaagaatgcactctctttctcagggatgttccttgctgagaaaaagacttcagcaatatttctcctatttgctcttgaaagaagagaaagatggctctgttccgcctggctctcaggctaccagacctaatggttatctcccttgttccttgaacattgctgttatcctgttcttttttcaaggtgcccagatttcctattgtttaaacaatttgtgcagttaacgcaatcattacagggtcctgaggtgacatacatcctcagcttacgaagatgacaggattaagagattaaagtaaagacaggcgtaagaaatcacaagaatattgattggggaagtgataagtgtccatgaaatcttcacagtttatgttcagagattgcagtaaagacaggcataagaaattataaaagtattaatttggggaactaattagcgtccatgaaatcttcacaatttatgttctgccatggcttcaaccggtccctccgtttggggtccctgacttcctgcaacaataattatttattttaaaagaaacaaaatcaaattattagacatttcaatctgtggtagtaacatgatattctggcatctactttcattatcacctttattaaaataaatttaaagaaaaatggcagtatgtttctgtgaagaccacgagtactcattttaaaggactcaagagttgcagaaaagtaaaaagaaaagagtaaaatcattttctaaatctcaccttccagaaataacgatgttgagcattaagtggacttcatttcatactctttcaaagattatgtaggcatatatatgtgtgtgtatatacatatatatggatacatccttagagaagttggctggctagatagacacactataaaaatggaatcatactctaatgccatttttaatttaaaaaatacatattcagatccactgtacttatatacagaagtaaatgaaactaaagtaacacgagaggaattctgaccctcatataattttttttactatccaacataattattttttttattatactttaagttttagggtacatgtgcacaacatgcaggtttgttacatatgtatacatgtgccatgttggtgtgctgcacccattaactcgtcatttaacattaggtatatctcctaatgctatccctccccttccccccaccccacaacaggccccggtgtgtgatgttccccgtcctgtgtccatgtgttctcattgttcaattcccacctatgagtgagaacatgtggtgtttggtttttttcccttgcgatagtttgctgagaatgatggtttccagcttcatccatgtccctacaaaggacatgaactcatccttttttatggctgcatagtattccatggtgtatatgtgccacattttcttaatccagtctatcattgttggacatttggcttggttccaagtctttgctattgtgaatagtgccgcaataaacatacgtgagcatgtgtctttatggcagcatgatttataatcctttgggtatatacccagtaatgggatggctgggtcaaatgatatttccagttctagatccctgaggaatcgccacaccaacttccacaatggttgaactagtttacagtcccaccaacagtgtaaaagcattcctatttctccacatcctctccagcacctgttgtttcctgactttttaatgattttcattctaactggtgtgagatggatggtatctcattgtggttttgatttgcatttctctgatggccagtgatgatgagcatttttcccatgtgttttttggctgcataaatgtcttcttttgagaagtgtctgttcatatccttcacccactttttgatggggttgtttgtttttttcctgtaaatttgttggagttcattgtagattctggatattagccctagccctttgtcagatgagtaggttgcaaaaattttcttccattctgtaggttgcctgttcactctgatggtggtttcttttgctgtgcagaagctctttagtctgattagatcccatttgtcaattttggcttttgttgccattgcttttggtgttttagacatgaagtccttgcccacgcctatgtcctgaatggtattgcctaggttttcttgtagggtttttatggttttaggtctaacatgtaagtctttaatccatcttgaattaatttttgtataaggtgtaaggaagggatccagtttcagctttctacatatgtctagccagttttcccaacaccatttattaaatagggaatcctttccccatttcttctttttgtcaggtttgtcaaagatcagatagttgtagatgtgcggcattatttctaagagctctgtccttttccattggtctatatctctgttttggtaccagtaccatgctgttttggttactgtggccttgtagtatagttagaagtcaggtagcatgatgcctccagctttgttcttttggcttaggattgacttggcaatgcgggctctttttttggttccatatgaaccttaaagtagttttttccaattctgtgaagaaagtcattggtagcttgatggggatggcattgaatctataaattaccttgggcataaattaccttggccattttcacgatatcgattcttcctagccttgagcatggaatgttcttccatttgtatcctcttttatttcatttagtagtggtttgtagttctccttggagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgagacgatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgcccgtttccaaagggaatgcttccagtttttgtccattcagtatgatattggctgtgggtttgtcatacatagctcttattattttgagatacatcccatcaatacctaatttattgagagttttttagcatgaagcgttgttgaattttgtcaaaggccttttctacatcttttgagataatcatgtggtttttgtctttggttctgtttatatgctggattacgtttattgattttcgtatgttgaaccagccttgcatcccagggatgaagcccacttgattatggtggataagctttttgatgtgctgctggattcggtttgccagtattttaccgagaatttttgcatcggtgttcatcaaggatattggtctaatattctctttttatgtggtgtctctgccaggctttggtatcaggatgacgctggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgcctcaatttgagagcctgttattggtctattcagagattcaacttcttcctggtttagtcttgggagagtgtatgtgttgaggaatttatccatttcttcttgattttctagtttatttgcatagaggtgtttatagtattctctgatggtagtttgtatttctgtgggatcagtggtgatatcccctttatcattttttattacatctatttgattcttctctcttttcttctttattagtcttgctagtggtctatcaattttgttgatcttttcaaaaaaccagctcctggattcattgattttttgaagagttttttgtgtctctatttccttcagttctgttctgatcttagtcatttcttgccttctgctagcttttgaatgtgtttgctcttgcttctctagttcttttaattgtgatgttagggtgtcaattttagacctttcatgctttctcttgtgggcatttagtgctataaatttccctctacacactgctttgaatgtgtcccagagattctggtatgttgtgtttttgttcttgttggtttcaaaaaacatctttatttctcccttcatttcgttatgtacccagtagccattcagcagcaggttgttcagtttccatgtagttgagcggttttgagtgaatttcttaatcctgagttctagtttgattgcactgtggtgtgagagacagtttgttataatttctattcttttacatttgctgaggagtgctttacttccaactatgtggtcaattttggaataggtgtggtgtggtgctgaaaagaatgtatattctgttgatttggggtggagagttctgtagatgtctattaggtccgcttggtgcagacctgagttcaattcctggatatccttgttaactttctgtctcgttgatctgtctaatgttgacagtggggtgttaaagtctcccaagtctctttgtaggtcactaagggcttgctttatgaatctgggtgctcctgtattgggtgcatatatatttaggatagttagttcttcttgttgtattgatcccctttaccattatgtaatggccttctttgtctcttttgatctttgttgatttaaagtctgttttatctgagactaggattgcaacccctgcctttttttgttttccatttgcttggtagatcttcctccatccctttattttgagcctatgtgtgtctctgcacgtgagatgggtttcctgaatacagcacactgctgggtcttgactctatccaatttgccagtctgtgtcttttaattagagcatttggcccatttacatttaaggttagtattgttatgtgtgaatttgatcctgtccttatgatgttagctggttattttgctcgttagttgatgcagtttcttcctagcatcaatggtctttacaatttggcatgtttttgcagtggctggtaccagttgttcctttccatgtttagtgcttccttcaggagctcttttagggcaggcctggtggtgacaaaatctctcagcatttgcttgtctgtaaagtattttatttctccttcacttatgaagcttagtttgaaatgaatgaaatgaagcatgaagagaagtttagagaaaaaagaataaaaagaaacaaacaaagcctccaagaaatatgggactatgtgtaaagcccaaatctacatctaattgatgtacctgaaagtgactgggagaatggaaccaagttggaaaacactctgcaggatattatccaagagaacttccccaatctagcaaggcaggccaacattcaaattcaggcaatacagagaatgccacaaagatactcctcaagaagagcaactccaagacacatcattgtctgattcaccgaagttgaaatgaaggaaaaaatgttaaggcagccagagagaaaggtcgggttacccacaaagggaagcccatcagactaacagctgatctcttggcagaaactctctaagccagaagagagtgggggccaatattcaacattcttaaagaaaagaattttcaacatactgattttttacagatgccttatcaaaagagattatgaaagctattggaattgtaatacttttattaattaatggttcacttttatatagtatcagtgaacttcgagcaatgaaagaagatgattttaatgcttccttcatttctctatcacccacctcctgatttttatagatcattatcattcattcattcaaccagtgtttatttagagaatactttgtgtaaggcaccttcaaggtgctgagcctagagctataagctatcgatggaacagacaagattctcacacataatggggcttgcattttaatagaaagaaaaaataaatcactattttgacattgcgctgattctgttcagtaaccataagcctcataattgttcagtattgtttctatatttgaattctttctatgcatatacataagtagaagtctggcagactagagagatagccagactcacttttataaaaatgggatgatactataaattcacttccgtcgctgacagcccatcctccacctaccttcttatctctgatcctccctagcagccctatccaggtttccctggttagaaggagaagctcggtcttttccagattcacagggaaaggttcccaagcaggaggagtgaggaggagccaggtggcagggccaggccaggccaagcctttctccactgcttctctgcagaatttccttggctgctggttttggaagtgtgtgacattaggttatgtccatttccttggttggtggctgctgataaaaattttgactggtttcactattttgatgctataattcttcatttttttttaggcattgctaagttagataaatcttatgttcagtcttttctatcttatctttaccccaagtctacctccttaaaatacttttatgagcacaaatccctgatgtaaaatcaagccataatgtgtttcctggagtaggggcggacaaatatgttaactaaattctttttgcgtgcttcatgttggatcaattcttaaggaataattttgactgagcctcttttaagcttttccaggcctggcttgttttcctgaaaagcttcaaagcagagaggagaatctttgtcagttagctgggtgagtggttcacaagcctcactgttgtgacacactccgtcatttgtgagggcatcacagccattttgttaatagaaatacagagccaaaagtcaaacatgattttatatgtgtgagatgttgcccgagggaaagggcaaagaatgagaagagctggactgggcaactctcatgtgaccccaggtccctttcaaagttgagtttctctagcaagtttgggatttccaaatgtttctactgagaaaaaaaaaaaaaggaaacgtgcaattaaattagaaaactacacagctcttactgaagagctgaaattttaaaaagatgcttaaaataaagcaaggaagataaggagaaagaaacataaagcatccaaacctgaaagaataacattcagataggctaacactcagaaaagattggagtcttgccaaacatcctgaggtcagccgccaccacagcaaaaagactgtttgatttggagtgacaagaaagatgatgtgatctcagaggaaacagatggctcactaaagatatttgaggatattttaataaaaagaagattttaaaaggtgtgagtaggatacagggaaagtgacaaaagatggagcaagttggaacctgatgggagtaatctggggggaaggaacccatagcagaagtggtggctctcaatggtggagcccagccaatccgtgggatcgggcaggaagggagctgacccactgtctgctccacgacctcctggtgctgcctccccttggctgaacccagccagaaggcaaagagagacccattggtccattccgtccaagatctctctcagggctcagagcagcgtacagaaaggtagtgtttctggaggaacaaatagaagatatccagcagtaagggcaaggaggcacagaagtacttcctgcttcaaggggttgagtggctatggtagttgatgttgagaaggcagatgaagtaaaagcaacttcgcatatatctttcctatcaaagacaatggtctaactggaaagaaaacaataaacagggttgtgactaaaaactgggcaaatgatctaaacagacatttctcaaaagtaaacatacaaatggccaagaggtatatgaaaaaaatgttcaacatcaccatcatcagggaaatgcaaataaaaaccacagtgagatattatctcaccccagttagaacggctatgatcaaaaagacaaaaaataacaaatgctgacaaggatgcaaaaaaaacccacttatactgtgttggtaggaacgtaagttagtacagccactatggagaatagtatggcggttcctccaaaaaactaaaatagaactaccatacaacccagcaatcctactactaggtttctgtattgttttgttttatattttttgtttttttggttttttttttttttttttttttttgagaaggagtcttgctctgttgcctagtctagagtgcaatggcatgatcttggctcactgcaacctccatctcctgggttcaagtgattctcctgcctcaacctccccagtagctgggattacaggtgtgtgccaccacacccagctaatctttttagttgagatggggtttcgccatgttagccaggctggtcttgaacccctgatctcaagtcatctgcccactttggcctcccaaagtgctaggattacagataagagctaccatgcccagccccattactaggcatttatccaaaggaaaggaaaccagcatatcagaggaatacctgcaccccatgtttatcacagcactattcacaatcgctaagatattgaatcaacctaagtgtccatcgacagatgaatggataaagaaagtgtggtatatttatacaatggaatactattcagccatttaaaaataaaactctgtcattcatggcaacatggatgagcctggaggacattacgttaagtgaagtaacccaggcacagaaagacaaataccatatgatctcattcacatacagaagctgaaaaacagttgatctcatagaagtagagagtacaattgtagttattagaaactgagaagggtaggaggggaggagatggagaggttggttcaaggttacaaaattatagccagatcagaggaatatgttctagtgttctatagcactgttgggtgactacagttaaaaatttttgtatattttcaaatagctagaatagaagattttgaatgttcccaacgtaaagaattgaaaactctttgaggtgatggatgtgttaattaccgtgatttatcattacacattgtatctatcaaaataccactctataccctataaagatgtataattattatgttcaattaaaaataatgtaaggaataaacaatattgaaagcaaaagaaaaaatcccaaagtggtcaaagcaataagccaatacttaactcctttaagcccatctgcaggcctaaatgaatcttacctgagagtgctgaaagaaaattatgtttaatttccagaaagggtcaaaagagtacattattgaacctgtaataaagttactgaaattaaaaggaatgttaaagatctcaggtttcttgatttcaggaagctatttgatggagcctttcaaagtttggttggtaatgaatatgctggagaaacaccggccatacaagaaggtttccctgacctgggatggacagtcatgcacagtgtttactagtgttgctcgcatggcatgaggaggaaagggcacaggacccttctttttgacccactcctattcaagtttctatgaaggtcttgaatgaagataggaggtgtaggtcaaagtcgtggttatgactgtttcaaagtcagaaaggagaatcggttctgtggatcttacaagctcctttaagatgcctcaggctatgaagctgtgggagagctggaaattctggatggatgggataatatttcctgaagcttgagggaaggtgtttgctgaagtttgtccaatgtgctctgtatgaagccagaacccaatgtcccatctgccttgttccagcactgcctcggattccagatcctgagaaccaccctttaccccagggaaacccctgatgccaccttctctgctgccaaccattatgtggtgtgagctgtccccaggttgcaagtctctgccagcagccctgcatgcttcaagactctctgtgtggccccacagggcaagcacaacaaagaggtcaaatgacagaatttcaaaagatttcaactgatgaaccaaattaaaggacatgttaggtattggaattttccaatttacagagctagtttgtcctagcattggccagaatgaaggctgaaagagtggcagggctgccaccatggttactgcagcaggtggaattcgagtgcctgaattgagggaagtgggggtcctcctgcatcccgagatagcgagagcacctcagaagtgctggcttaggtggtggcacccactgtaagagaacgatgacaaatctcagtttctccctaggagagtgcccagcagggtgatgagccaggaagatctgtcaggatgaagagtagtgagaggaagggggaaccctggagaagagaagaacttaaagggattcacaagaagttgaggagggcagagctgaatgagacaaggttgcagggaaacagactttttaagatcagtgtaagggaaaaaaaaatccttgacaatcagaattgtttcaaaacagagtcagcagcttcttgagactgggtcgctgtgctaagaacgtaaagggggagctgggtggcaccagcaaagtggcaggaatgtgtccctgcagggtctttgctgccttccgaatcctctcctttgtgatcctgtaatttgtgagagagcctggagggtagcatggaaaagagagaggagaggacctgacagcagtatttccatcttgtcccctaacaattgcctaggcagtctcctctcagcagggaagcaaactggtcaccaaataataataattatccccctacatttccttaattatttaaacttctgaaaggacatcaaacacagcaaagagtcaatgacttgctttcagaagtgattcagactgtagctccacccataacagtgtcaccttgagcagtcacatatgccttaacatccttctttctaaagcaattccatcttcccaggttgattgttgagcgtttagacatgatgacatatataatctttatatatgtatatttacaagtatatgtttatggataaattttgactgcctgtaacccatgtggccttgtgtcatcacacataagttcactgaagctcccaacaaccagacttttggggaagtacaaacctccacattagcactaggtctccttgcctgcccctctgctggaagaatccctggcaggggccttctttggtgatgggattgaattttctatttcctgaaatgtaatcagctttcagtttcaatggtggtcacccccttgtaccttcttttaaagattggaacgctgtattggtttctcagggctgctgtggtcttcatagaagatgacccgcgtatttccaaggtttcctccaggattgctggggctgtctgcgtccagatgttaaggttactgtagacaataaatgggagagggtgaaggaaggaggatgtttagagaaaattatccagtcacctggaggaaaggctcttagctgcaaaagaggaaataagggccaggcacagtggctcatgcctgtaatcccagcactttgggaggccgaggcaggcagatcatgaggtcaggagatcaagaccatcctggccaacatagtgaaacccatctctactaaaaatacaaaaatcagccgggcgcagtggcacacgcctgtagtcccagctacttgggaggctgaggcaggagaattgcttgaacccgggaggcagaggttgcagtgagatgagatcgtgccactgcactgcagcctggtgacagagtgagactccatctcaaaaaaaaaaataagaaactgctatttagcacaacatcaaataagcagtttgttgcttatgtctgaacacttctgtgaaaacaggcaaaggcagtcgtgtgtaggttctggtgaccaggaactggagctgcacagaggtgtagaggctcccaaagctcgtcaattgtttatgaagggagtaaaggctggaagtcagggggtgggtgtcagtttctgccactagctaccagatttctcctaaagatgggaaagctccctttatagagctggagtgcaattttgtgttttctttgtgtttggcaatgtctgttactgacttgcaatagatatgcaacagtataggtatgttcatcttagtattttggggacaaaactcccaaaccagccaccacacaaatgtatttataggtaccagtaggcacctttggactcggagggaagtcagcctccttaaagccgtattcagtaaggagaatgaagggtaggcatggctgcagcttgggttgtgcccaccatgtggatatccagccatgatctcaatagtcaggttggtccacattgtccagatatctccatgtaacattaactcagactttatgaaaataaccggtgagaataaccaaagccacattgggtaatgaaaactgtatgtacaattttctttagttacattgatgttgttacatactgttcataattaattacattggtttgtaatgtatcatgtcctattgtattgtaggttctaataccaagaccctaggtgttcctctcttaaaagctggtgaccacctttaactcatgtggtaaaagaatgatagttctgggaggatctgcattctctctgtgtccatgcagcattgccccacactgcctgtgctgagctgcatgatcctcatagctacatcatagtctttgcttgtaggcttgtcgtttggagaaccgtcttggagtctttattggttgatgtcaatggaaagctctgcttccctctggatgtcctatggtattgctgttcctaatgtctttctaatgagtgctacgtgtctgtatgtgtgtataaagagatttatgtaaagaattggctcatgtgattacggaggctgagaaaccccaagatctgcatttgccactaagtactcagatatttggtcaaacatgattgtgagtgctgttgagtgctgtattttttaactgccacgtaatcccctcaaggtccgtgttattctagacagtaaaccgggagaggcttctaaagccccctttgtcaggaaatgttactttagaatctgaccttgtgtgaaacacagatgacagaacctctctagtgcaatgacattaaaatcctcccccagtacttgaagtgcaagggaaatagctcattgctattatggctggatcatctcatggcctctcaacagatcaagagcaccattactactgttgctttcttgacttgtgttttacttttattctaacatttgttgcagtctgtgttaaatagggaggtagaccaaactatgagaaggagccctatattggaaactgtatagccaactatgaaacctccaggcttactttgctttctcattacaggcggccttcccctctgctccactggagagagtcagagtaattggctcttgctttatatgaaggatatgctcccaaaaaagttgtatttaaatcaagttttaacaaaccgactcatgcttgtttatccacttataacacttactatttaaaggaaatgataaagagtccttttctgttgttacagcgtagttggcaaagctgtatcttctgaagactgacttgcactcagcagttttagatcaactcgagtctgtttatactaagatccacagacccctggtggttctcagatgacttgcaaattctactagtttttccaattgtgtgttttttgatgataacttaaaaattttttatgataatcttttcattgtttagtataataatgtacagataaaccctagatgatcaccttataactgagtgctgtcatgagatttcagtgcctttgttctcagtcctgtaggtaaccaagacttcatctaaaatcacatcacttgactttaaatgtttgcaagacacatctgactgtcattgggttgataaaatctgtcttgtcctcattttgtgttgtgtgggactctatcatcaggtacaaaagcaaaactcctttgccatgagcgttcacagttgaatgacttttttatagaccaagagtttagtttcttagagtatatattgaatcaatttggcatcatggaaatggcatagtacattagaggcacatactatgttaactgtcacaatctaatgataaagaacagaaaaggacatattacataatcggtgcatttctgttaaagtcatggcaagcttattgaactagttttatagcaatttggcaggataaaaatgatgggaggatggagtcatcatagggtgcctgccctgtagcatggacacctgggacacaccttgctggatgatgtcttctttgggttccatcttaatacatgacaactggaaataattctgtagcagaaagtagagtgtaaaatagaaaatgactcttattctgatgaatcaaagtttttaagccatatatgtcggagtacacttgaattacttctgtaaaaactagcacattatataaaaatcataataaaaacagagattccagtgaggggtccctcttgttcagagtcgaaagattcaagtcaacaaaaatggaacctgtaagttagtctttttgccactgttaaaagaaaaacactggacacaatacttttaacagagtttatgtgagcattagaggattcatgaattgggcagcacccagaaccagaaaaggttcagagagctctacccagcagcatgggtagtgagctttaataggcggaacgtggaagtaagacaaagaaaacatatttgatttgttagagtagaaagtccctagttagaggttagttggaggtttctgatggtaacttctctagtttcattttactgttcacattgggctttggtttgcttacctaggaacttaaagtgctgggaatgcttcggcttaatgacctcccaattaaaatttttttaacatcacttttatttatgatctacaaagtggcaactgcctatttttttttaattttattattattatactttaagttttagggtacatgtgcacaatgtgcaggtttgttacatatgtatacatggccatgttggtgtgctgcacccattaactcatcatttagcattaggtatatctctcagtgctatccctcccctctcccccaaccccacaacagtcctcggtgtgtgatgttccccttcctgtgtccatgtgttctcattgttcagttcccacctgtgagtgagaacatgcagcgtttggttttttgttcttgcaatagtttgctgagaatgatggtttccagcttcatccatgtccctacaaagcacatgaactcatccttttttatggctgcatagtattccatgttgtatatgtgccacattttcttaatccagtctatcattgttggacatttggcttggttccaagtctttgctattgtgaatagtgccgcaataaacatacatgtgcatgtgtctttatagcagcatgatttataatcctttgagtatatacccagtaatgggatggctgggtcaaatggtatttctagttctacatccctgaggaatcgccacaccaacttccacaatggttgaactagtttacagtcccaccaacagtgtaaaagtgttcctatttctccacatcctctccagcacctgttgtttcctgactttttaatgattgccattctaactggtgtgggatggatggtatctcattgtggttttgatttgcatttctctgatggccagtgatgatgagcattttttcatgtgttctttggctgcataaatgtcttcttttgagaagtgtctgttcatatcctttgcccacttgttgatggggttgtttgtttttttcttgtaaatttgttggagttcattgtagattctggatattagccctttgtcagatgaataggttgcaaacattttctcccattctgtaggttgcctgttcactctgatggtggtttcttttgctgtgcagaagctctttagtttaattagatcccatttgtcaattttggcttttgttgccattgcttttggtgttttagacatgaagtccttgcccacgcctatgtcctgaatggtattgcctaggttttcttgtagggtttttatggttttaggtctaacatgtaagtctttaatccatcttgaattaatttttgtataaggtgtaaaggagggatccagtttcagctttctacatatggctagccagttttcccagcaccatttattaaatagggaatcctttccccatttcttctttttgtcaggtttgtcaaagatcagatagttgtagatatgcagcattatttctgagggctctgttctgttccattggtctatatctctgttttggtaccagtaccatgctgttttggttactgtagccttgtagtatagtttgaagtcaggtagcgtgatgcctccagctttgttcttttggcttaggattgacttggtaatgcgggctcttttttggttccatatgaactttaaagtagtttttttccaattctgtgaagaaagtcattggtagcttgatggggttggcattgaatctataaatcaccttgggcggtatggccattttcacgatattgattcttcctacccatgagcatggaatgttcttgcatttgtttgtatcctcttttatttcattgagtagtggtttgtagttctccttgaagaggtcattcatatcccttgtcagttggattcctaggtattttattctctttgaagcaattgtgaatgggagttcactcatgatttggctgtttgtctgttattggtgtataagaatgcttgtgatttttgcacattgagtttgtatcctgagactttgctgaagttgcttatcagcttaaggagatttggagctgagatgatggggttttctagatatacaatcatgtcatctgcaaacagggacaatttgacttcctcttttcctaaatgaataccctttatttccttctcctgcctgattgccctggccagaacttccaacactatgttgaataggagtggtgagagagggcatccctgtcttgtgccagttttcaaaggtaatgcttccagtttttgtccattcagtatgatattggctgtgggtttgtcatagatagctcttattattttgagatacatcccatcaatacctaatttattgaaagtttttagcatgaagcgttgttgaattttgtcaaaggccttttctgcatctattgagattatcatgcggtttttgtctttggttctgtttatatgctggattacgtttattgattttcgtatgttgaaccagccttgcctcccagggatgaagcccacctgatcatggtggataagctttttgatgtgttgctggattcggtttgccagtattttaccgagaatttttgcatcagtgttcatcaaggatattggtctaaaattctctttttatgtggtgtctctgccaggctttggtatcaggatgacgctggcctcataaaatgagttaggaaggattccgtctttttctattgactggaatggtttcagaaggaatggtaccagctcctccttgtacctctggtagaattcggctgtgaatccatctggtcctggactttttttggttggtaagctattaattattgcctcaatttgagagcctgttattggtctattcagagattcaacttcttcctggtttagtcttgggagggtgtatgtgtccaggaatttatccatttcttctagattttctatttatttgcatagaggcgtttatagtattctctgatggtagtttgtatttctgtgggatcagtggtgatatcccctttgtcattttttattgcgtctatttgattcttctctcttttcttctttattagtcttggtagcagtctatccattttgttgatcttttcaaaaaaccagctcctggattcatttatttttttgaagggttttttgtgtctctatctccttcagttctcctctgatcttagttatttcttgccttctgctagcttttgaatgtgtttgctcttgcttctctagttcttttaattgtgatgttagggtgtcaattttagacctttcgtgctttctcttgtgggcatttagtgctataaatttccctctacacactgctttgaatgtgtcccagagattctggtatgttgtgtctttgttctctttggtttcaaagaacatctttatgtctgccttcattttgttatgtacccagtagtcattcaggagcaggttgttcagtttccatgtagttgagcagttttgagtgagtttcttaatcctgagttctagtttgattgcactgtggtgtgagagacagtttgttataatttctattcttttacatttgctgaggagtgctttacttccaactatgtggtcaattttgaaataggtgtggtgtggtgctgaaaagaatgtatattctgttgatttggggtggagagttctgtagatgtctattaggtccgcttggtgcagacctgagttcaattcctggatatccttgttaactttctgtctcgttgatctgtctaatgttgacagtggggtgttaaagtctcccattattattgtgtgggagtctaagtctctttgtaggtcactaagggcttgctttatgaatctgggtgctcctgtattaggtgcatatatatttaggatagttagttcttcttgttgaattgatccctttagcattatgtaatagccttctttgtctcttttgatctttgttggtttaaagtctgttttatcagagactaggattgcaacccctgcctttttttgttttccatttgcttggtagatcttcctccatccctttattttgagcctatgtgtgtctctgcacgtgagatgggtttcctgaatacagcacactgctgggtcttgactctatccaatttgccagtctgtgtcttttaattggagcatttagcccatttacatttaaggttaatattgttatgtgtgaatttgatcctgttattatgatgttagctggttgttttgctcattggttgatgcagtttcttcctagccttgatggtctttacaatttggcatgtttttgcagtggctggtactgcggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctggattgaaaattcttttctttaagaatgttgaatattggtccccactctcttctggcttgtagagtttctgctgagagatcagctgttagtctgatgggctttcctttgtgggtaacccgacctttctctctggctgctcttaacattttttccttcatttcaactttggtgaatctgacaattatgtgtcttggagttgctcttctcaaggagtatctttgtggcgttctctgtatttcctgaatttgaatgttggcctgccttgctagattggggaagttctcctggataatatcctgcagagtgttttccaacttggttccattctccctgtcactttcaggtacaccaatcagacgtagatttgggcttttcacatactcccgtatttcttggagactttgtttgtttttattcttttttctctaaacttctcttctcgcttcatttcattcatttcgtctttcattgatgatatcctttcttccagttgatcacatcgactactgaggcttgtgcattcgtcacatagttctcgtgccgtggttttcagctccatcaggtcctttaaggacttctctgcattggttattctagttagtcattcttttaatttcttttcaaggtttttaacttctttgccattggttcgaacttcctcctttagctggtagtttgatcttctgaagcctccttctctcaactcgtcaaagtcattctccgtccagctgtgttccgttgctggtgaggagctgcattcctttggaggaggagaggtgctctgatttttagagtttccattttttctgctctttttttcccccatctttgtggttttatctacctttggtctttgatgatggtgatgtttttggtgtggatgtcctttctgtttgttagtttttcttctatcagtcaggaccctcagctgcaggtctgttggagtttgctggaggtccactccagagcctgtttacctgcgtatcagcagtggtggctgcagaacagcagatattggtgaaccgcaagtgctgctgcctgatcgttcctctggaagttttgtctcaggggagtacctggttgtgtgaggtgtcagtctgcccctactgggggggtgcctcccagttaggctactcgggggtcagggacccacttgaggaggcagtctgcccagactgcgtgctgagagaaccactgctctcttcaaagctgtcagacagggacatttaagtctgcagaggttactgctgccttttgtttgtctgtgccctgcccgcagaggtggaggctgcagaggcaggcaggcctccttgagctgtggtgggttccacccagtttgagcttcctggccactttgtttacctcctaaagcctgggcaatggcgggtgcccctcctccagcctcactgccgccttgcagtttgatctcagactgctgtgctagcaatgagcgaagctccgtgggcataggactctccaagccaggtgcaggatataatctcctggtgtgccatttgttaagcccgttggaaaagggcagtattagggtggaagtgacccaattttctgggttccgtctgtcacccctttctttgactaggaagggaatttcctgaccccttgcgcttcctggatgaggcgatgcctcgccctgctttggctcacgcacggtgcgctgcacccactgtcctgcacccactgtccagcactacccagtgagatgaacccggtacctcagttggaaatgcacaaatcacccatcttctgcgctggtcatgctgggagctgtagactggagctgttcctattcggccatcttggctccacccccccggcaactgcctattgttttacctgatatgcacaacattggccattagtgttaccaaagcaacatccatcacaagaattaatgcttcttgatttgaattttactcctctctgtctctgtttatgtgcattcatttgattgtacacttgtataagaactaaaagcataaaaagtttattcctacatctggcacagctcacgtctgtaatcccagcacttcgggaggccaaggcgggcagatcatgaggtcaggagttcaagaccagcctgaccaacgtggtgaaaccccaactctactaaaaatacaaaaattagccaggtggggtgttgcgtgcctgtaatcccagcttctcaggaggctgaggcaagagaattgcttgaacccgggaggcggaggttgcagtgagccaagatcgcactgcaccccagcctgggtgacagaatgagactctgtctcaaaaaaaaaaaaaaaaaagtttattcctagttttacatttgtagcattgaaattaaaagaatctaaataaataacagagcactgtgagaatttgttgtttaacagagctctatatgcattacacaatttcaaggaacattgatctgaatgttcctatccctcatggaccttgagccctgacaaaagttaataaagatgggtctccttttcttcttgtcccctgctttcagctctgaatgagaaaagttttgcaaatatgtcggtactttgtattaagcctaaaacttataaagtatcagatttgtaagttgactgtattaactttaatttctcaaagtgttctcagttaattaggttaacctaaaactaaaactataaagtgattcctcccctaccaagaaaaaaaaaattaagctgaaatcctctgtttagagtttcaggcctttgggctggactccacaacccttctcaggaagtagcagtagacacctgaccttaggctgtagtgctaatataacctgtgtcagtagctgccccattgcaaacaaggaaatgatcctctgaagtcaaactcaggaaggaacaagaacctgtctctctgagctctctaaagagtgtggttaagagtatgagcattgacaacagactgcctaggttcagataccacctctgatgccagttatgtgattttgggccagtttcttaatctctcaatgtctcaacaacatgagtctaataatagcatatatacccctataaccatggcatgaggattagacaggttgattggtgtgtataaaacacttggaacagggcctggcacagggtatgccttagtagatgttagcactgcatcacgactgctactatgattaccgtccctgtcactgttgctgctgccaccacaggcaggtcagtggaacgtcacccttcagggatttatcagcgccactccctaagcatgccacctgcatgaagggcagacatgaaattgtgccgccagcgttctggtttcttcagcgctccctgccagctgagctgtgtgaaaagcactcagctatgaaaaaatgagaaagattgattgaaatgttggtgaggtcattgtcaaatattctctgtcaactgaatgactgcaaatagggagatgactgcccccccaccaagtcagcctaggagggttcagtccttcatttattcattcacacatcactccttcactgtgccagccagccatgacaattaagtgcatttgggaggaggtggcagctgagctggaaagggggtttggcattatgctgggaaggtgtaaaaagccaggctgaagatttgggccgtctttttttttcccccagatagtggggagctggatttggagacaagaaacctttgtagaccctctggcactctctattgacagatcactgctaggaggcagtgtgactcggagaaccgcatgggctccgccaccagctctgggttccgcactcattagccagatgaccttgggctcattatttagcaagcctgcacttctgtttcctcacctacaaaatatgcataaaatagcagtacatacctcacggagttgttctggggcttaaatgagttcatctgtgcaaacatttagacgaagtgcttgacataatcagagctatgtaggtgctgttaattcttctttgccccactggtccccaggttccatatctgtaacaagaagcaactggaccacataatttcacatccttttatacccaagtttttgatcaagagagctcaggctgtactttaagcttaatgtgacagtgatttatagcatagcttgggggcgatctgaacacttgggggcagaaaaacaagttaggctttccctgtttccatcattctcccacctttcctccatctgcctgtccccacctggacatacatgccaaaagccacggcccattttactagatctaggtagtatgggaaaagaccatgaagcggacacatcatctgtactgccagtgtctctcttcaaaataaactttttttttttttgagcctgaatctcactctgttgcccaggttggagtacaatggcatgatctcaactcactgcaacctccacctcccgggttcaagcaattctcctgcctcagcttcccaagtagctgggataacaggcacctgccactacagccggctaatttttgtatttttagtagagatggggtttcaccatgctagccagactggtctcaaactcctgacctcaagcaatccacttaccttggcctcccaaagtgctaggattacaggcatgagccaccgcgcccggcccgcttcaaaataaacttctttaccaggaaataggattaagaggaggtagaaggaaattagagtaggatcagaaagatagaaaaaggagttttctctgaaacaataggacagccagatacaggctgagcaggcccaatgatggatagagaggcacatccactgctgagctctaacctagagagagaatgtctcaaaactccttgcatggaaggtgcctggaaatgtatttattctcctgttgtttattctcacctctcttcattcctttttctttcttctgtccttgaatcgcagcagataaaaagacaaatctgctgagaggatgcatgtcacaagtggtcagatgaattacagccatagcaccatatagataagaggcaaggctggcgcctgggcaggtctgagagggtccaggaggacacacaccatatcaaattgtgcaatttagcaaatggctggtggcagactgaaatgatagttaatctgttttccatgcactaaaggcttttgccaaactaagatttgctgtgaagacccaaagctggagcccacccagggagcgggctgccttggatgcgtttcccagccttctacagtggatgccagtaaaactaactagagacatgaatgggcaccaggataaacacaaggggatattttgttcttaccattagagaaggatactgctaactggcaagaagtcccatggttgttatcttttgattagtagtagtaaaaatactatttaaagctagtagcattttttgagagcttgctttacactgggtactttttcaagtgtcttacaagtattcgctcattttatctgcacggcagctgtatgaagagaatactgtcattatcttcactgcataggtgagcaatggaggcacagagaagttcagcaacttgtccaagctctcatagctgggaagtggcagagccaggctttgaactcaggcagtctgactcagagtccaagactgccggcctgaattgtaggagagagacagtgcgggtataccaggaaccaaatcctatcggctgaacatcagtgtttaagtcgagcccagatgctctgcacaaaatacaatgtgtctgtgcacatgtgactgttaatcagccatttccttggttcctgctttgtgctggccactgagctggaccctgtgggatggataaatcaatgtcagtcatgcccctggagacctggctgttgcaaaaaggctcctgaaatcatcataacccaaaagagaaaagggcaggtgctgaagagaagtataggtaaagagcagcaaaatcataaaggaggggagactctttgcctctgtggtatcagggaatgcttctcagagcgggtggcgtttgccctgagacttgaagtaggaatttaaaaacatagaaatgcagtggaacgggaagaaggacattctaggtggagagaagtagagcaaaatggtccaatctgcccccctaagggtgtgagacagagaagtggatgggaaggccaggaaggctgtcgccatgtgggccgaacatggggagggaggtgtttgtcagaatcagaatggactcagagggaagctgagctaaaagcttcaatttacagatgaaagaagaaagaatttggatatgtgactcactcagtgtaccaagttcgtggcagaagtaagtctcaaaccccaggcttgcctccaattttctttgcactgatctcctggcataaacatgtggctaacaagggtctcacaatgccaggagggtgttacgtttttataacctgttctatttgagggtctccaaaattacatatttgaagttaatattagccagatgctaactgtctgcaggcaagaataagcacccactttacattgggagaagctagagatttgggaatcaggatttgctgcagatactttgaggaatctaggcctctaatccacagtctcctaaattctggaacttctggcttaattacactttttaataaccagtcatcattgctgcataatttgtgaggtctggtatagtatgattcctgttcccttcagctaaccctgcccccacccccatcctttaataaacgtaaaacttttctttcctgtgaattcatttttttcccttttatcttttggacctttgcaattaacatattaatatttaattcatattacctgaaggtccaagaacacttttaaactcatgaaaaaccttcactagtaatttagctgctaccaaggtatccctgagccctcattatttgcctctggaaaatgccgtaaacgacatctaacaggcttcagctctgtacctctacaaataagaaattaagcagtattcagaacgccattgattattaatttaaaagaaatcaaaaatcaatatcacattcctgtaacctggcagtttttcttaactgaaggcagttgcctgcagaagccttgtggctttccagagcaacggcgccccttcgtggtgataatgtgaactgcaccccaggcgtgattgaaaataaggcagaaaggaatgccggcctcgagcaaggacaccggttcatgcccaaatcacttctgctttcagccaacagactgtttctgccaaaagatggacgcagctagattttttttttttttgtaccgataatctgtcttaaaacttggagaggatctcttttcccctgtgaagtcaggaaaatgacagcaagcagcatggattggttcgaataattttcaccagaaatgtggggtgaggggaagggatgggactggagtcagagcagtgatctggcgggatggggtgatgagccatacggagatgaggtgtggcgccacgggctgggagtcagggattatagagtgagggtggggtaggatcttcctggtcatcaaaactatgagaaatgtaattatttacattttaaactaagccaaagactgtattgaaatgtcttacacccagaacagagaagtggtatcaccaaagttcagaattcccagctctaacgtgatgcctttggggactgcctccccaccccaggctgacctaacacacccctttgagaaaagaggatttagtttctcctgactgtgaattgaatatgtgggatgtgcccctccaggagcttctaaaatcacctctgctttgaccttgaggggccgtggtagaggggagacagcaccggcttagaaaccccacggctcggctctagtcccagcatcagtggagcaccaaggggagaaagtattcatcactgaggtattttatgatatgtatattgttcctgggcagttgcaccccttatcgcctgcaccctgtgtacagctccccattcctcctcccttggaggccactgtgctatgtaacttgctgtgggctgcaagaaagactgggctcccgtttcctcttctgaaaggcaggaatcatgctcccggctgacctcacagaatcattccacagattaaatggcgatatggcttgtctgtgttcacactcaaatccacatgttgtgggagggacctggtgggtggtaattgaatcatgcgggcaggtctttcccatgctgttcttgtgatacagaacaaacctcatgagatatgatggtatcataatggggggaggttcccctgcacaagctctccctttgcctgctgccatctatgtaagacatgacttgcacctccttgccttctgccatgattgtgaggcctccccagccacgtggaactgtaagtccattaaacctctttcttttgtaaattgcccagtcttaggtatgtctttatcagcagcatgaaaatggactaatacaaatgggatgtaaaaataaaattcttatatacttagaacggcaatatgagctttacatctgagttatgctataatatcaatcaacatatataataatataaagtagtatatttattataagttataataacagagtgagatagcttagtaatttcttgttagtatctgcaatcttggggaaaacaaatctagagaaataagtccaaactggagctgcagagtcaagtgggcgagagaaagaagtctcgctttttttgttttccaggaaagctcaggtccagttcagcaggccagcccaagagactgggagagccctatgtactcaggagagcagcctcacccctcgtccttgtccaagattggggagtgggtgcccacagcttgtatgtgtccccatgagagtgggtgtcattatgaggagcatcaaagggccaagcacagtggtgacagatgtgggggaatttgccattctgagggcagaggaggtcaaacacaagtggactcgcttattaagcccagaaagagaactgggagaggaaggccaagtgaggatggaggcggagatccagggcccatctgcaagtcaaggagcaccgaggatgctcagcagcagagccaggagagggcatggagcggactcgcttgcagagcctgtagaaagaaccaactctgccgacactttgatttttaacttctggccttcagaactgggagagaataaatttccattgttttaacccacaaaggaagaaaaagactatcaagagtagaagggcctgacaggtggccacacggcaggtgagtcagagagttgagtcacgtgggaggtagtttagaaaaggatttgtgaagagggccatcccctagcagcgtgttgaatatagtgaggaatatgagatggaaaagaatctttttagagaacatgggtgccagacatagccacagacaaagtcgtgaaatagacagaaatttgtcccatttatggagactgtggttttccacccatatgtccccccaccccatgtcatgtttacctggccctcaggctcacgctgatggccctgggctgcttttttcccctcaaaagctgatgtctggtctctaattataagatacaagatgagatggaaataattgttaacaatgtattcattcaacaatggattgtgtaaaaaaaaatgtggtacacatacaccatggaatactacacagccatgaaaaggataaagtcgtattcttcacagcaacaggaatggagctggaggccattatcctaagcaaattaaagcagaggcacaaaactcaatactatgtgttctcacttataagtgggagctaaacattgggtcctcatggacacgaagataatagtaactgacactgaagactactagagggggtagggtgggagggggacgaggggtgaaaaacaaccagcaggtcctttgctcagtacttgagtgacgggatcatttgtctatcaaacctcagcgacatgcaatttatacatataacaaacctgcacatgtacccccgagcctaaaataaaagtcaaaacaaaatattcattcccaaatcatttactacatacaaatcgttaagtcaggatccctgctgtgacactagggattatagaagtgttgaaagcttcattctcatccagtcattcattcagtgcctggctggggttgtgataagcaaaagcaaacccatccctctccacatgtagcttccagtctcgtggtggcatttcctcagaggatgaagccatccaggtagcatagcaggcatgaggtggttccagtaaatggaggtgggacagtctccttgggctgccaccctgcttggggctattcctggtagggcctggagctctgcctagagaagcccacatgccctctcctggagtcacaagggcaggccaagtattctgtcctattccagtctttgctagaatgtgtcaagtgctgtgggcttgagtccttggcaatttttgcatgggacttagtttgggggtaagttttctggaaacttgaaatgtttcacttaaaaagaaaaatgcaggattcaaagaagtaaagagtaacaaataaatagaggcttttttagttcaggggtcagcaaactgagggcattgcagctgttctggaattaatgcgtgtccgggcaagggtcagtaattctgagatgccgttctgttgctttcaggccttttttggtgaaaactcttaaaggaggtataattcttcccttgctgggagtctttgtttcagaggggttgtaaaaaaagattcccagaggataaatcatatctgtattaacttcctaatgaaatgaaaaattatatcattgctgattattcctccttggctgatatggaaaaaaatactattaatactttttagtgtgattttaatcctttgcattcacggatatttgcattagtattttctggacatcatcttgtttatatggattttattcattgtaagatgccatcagatccaggcatctgagttctgggggggcaatgctataatccctgcccagaaccaaaactttccctgtgcagatggtctttcaatagagtggaatgtgtttggggtttctgcatatttcagtttacaaacccttcagtgatggttgtcttcatcctgagtttggctccatgcttcagaagatgcaacagtgctgagaacggtgcctgacatgcaggaaacattcagtaagtgtttgctgaatgaatgaataaattaattcaacaacagctaatgaaagcacatcccttaaaaagtctcggcaatattgcgagcataataccaaaggcagaaaccataaaagaaagaattgatggattggaaggggaaaatctttttttttgagacagagtctcactgtgtcacccaggctagagtgtagtggtacaatcttgactcactgcaacctccacctcccgagttcaggcaattctcatgcctcagcctcccaagtagctgggactacagatacacattgccacacccagctaatttttgtaattttagtagagacggggtttcaccatgttgcccaggctggtctcaaattcctgacctcaaatgacccacccacctcagcctcccaaagtgctgggattataggcgtgagccaccgcagccggccagaaggggaaaatcttataacatgaatttcagataaactgttacatccttaatacttaacgaattcctgttaatcagtatacaaatattagtacccaaatagaataaataccgatggccaataaatgtattagaaacatttgaatctcacttataaaaacatagttattttcctaaatggggtatcattttttcccaatcagattggcaaaaataaacaagaatacaaatccagcctagcacatgtacgtactttcaaagggaggataatttggttcaacatgttttgaaagctggttgtatggtatgttttgaaaccttgaaaatgacccagaaattttccttctagagatttatcttaaggaaattataggaggcataaaaagtttcacctgcttattgctttgtggcttatcattgcaaaaagaaaatggaaaactacttcttcagctaaaggaagtgatacgctatcgtactagaatattaaaaatgaagaaggtagggaaaagagaaagagaatctaagcggtaaaattgtttgacctttattttcttctttttgcttagctatattttctaaagtttttgttaaaataaactcttttaacaaaaaaattctaaaaactcatagctgcttagatgataatataattataatatttatgttaatttttgttgcgaacgtatgtttatgttgaacttaccaagtgatctaagctatattactaagttcttttcataagcctctgagttcatgtatattaagcccttaacataattcttagagttaagcagagcaggtggcgttattcttccatgaccgcactgagactcagaaaagttacatgacttattcaatatcacataattaataaagagtaagactggccacaaagtccaggatgccacacacatagctgagtgcttcttcctctatcatagaaacaaaaatctggatgaccattaggccgttgttggcctgcaaaggtgtagagcaaactattttatggtattgagagcacttatcttggcattactccatctgattgtttgtgtcaagtaggaaagatacatttattattcccattttgtagatggagaagctgaggctcagagaggttgagtgacattcccaaggttgtacacagtaagtggtaaagttaggatttaaacagttttagtccgaatcccttgctctgtctacttcagtttggcataataaattcttaacttccttaacagtttgtcccatcatattcctaaagttttatgatttgatgaagtctctcttaagctccttttccacatgggtggcatgggttagcaagattttgagggctgatcttgtgtgacagattgtatttccaaagatgtctggaataatatcttgtgtcccacatactgttgtggaactatcacctctccatcccaaaaggtggaacagaagcaacactatgaaactgccaaggctaaatcataaacattcaatgcacttctgccttgctctcttgggatgtttgtgcttagaatccagctgccctgctgtgaggaagcccaagcaactctgtggaaaggaccacatggaaaggaacagaagtgcccagctcacatccctggctgagctcctggccatcagcctaatttgctggccatgtgagtcatcttgaaagtactgtaggttcaaggtttactttctgaggtttcagttatccatggtcaaccgtggcccaaaaataggtgaatatagcacaataagatattgtaagagagagactatataacttttatttacataacttttcttacagtatattgctatgatttttctcttattagttgttgttaatctcttatgactaagttataaataaaactttatcataggtatgtatgtatagaaaaaacatagtatatgtaggattcagtactatccgctgttgtaggtatccactgggagtcttggaacatatcccttgtggataaacagagactactgtagatcctcctgctcctaattagcctaccctaactgatgttgcattgagcaaagtgaggtgagccgaccaacctctgcccaaattgcagatttctgtgtaagataagtgattattctgttgggggtagtttgttatactcattttccctcctaaccccaaattaggtggcagggatggaggagtcttgcttatcatctctctatttttgttaactcctcctcgttcagggtagactttggcacctggatcacaaccttattctccaccccaaacctgccattatccttggtgacaccattatccatgaaggggacccatttgatatgttagcttctcagttccctgtcttctaccccaaagtccttcaaattcaaagtatcttactctttttgttttaaaattgcttggagtagtagagaggactctagtggaatatacaagccaaaataatcaggaatttttacatgagagaaaggaggaatgtcgtgaagggcatcaaaaagcaagaaagatgctcattttcccttccaaccccaatttaggtggcagaggtgggagcaggtgaaaagaacaaagggcattggaaaagaccacctggaagtcagtgaagaccaagcggtaaagggatccttagcttaggcaaaggctagatggggacttatctcaccaatggagccagagaacagatgttccagatgtgtgtgtggaagtgggaagaggactgattaaggaaagaagaagctcaaagcaatatagagatgagacagagaaataacaggattccagaggcacttggattttactcaccaaggatgagggggaattagttggtctcaacatttctaacggcaaagttacaggtcacctaatacatatttatgtattagttggatcagaggatggatggatggatgagtgggtgggtggatggtagatggcagtggatgaacagatgaatgaatggacagatgtgaggatttctctgtgggagattcagttcgcccaggagtgatggtgtttctgagagagccctagcagcatttgttatctcctaggctctctctgaatgttcgaagcagtgagtggcaaagaggaggctcagccctctctggattgatctgttactggggtgtacaggcattcagtgcagagttctcttcatcaatggtcaaataacttctgttacccacttgtgatggctcctgtagcctctggttcgactccatgtaacaactgaagagcagccttgctgcaacagataggaagcaggtcttatctctgatttgagaatagaaggcccggtgggtacaacctgtagcactttcaatcctgtagaaatatagatagtgatgctgttggtaaaaaggaatccaccctttccaaactttttcctaagtcagtggttgtcaactggatgaggtcttgctcaagcacaagtgtctggacccctcctctagaaggagtgattctgcaaggctgagcaagcctgagaatgtgcatttctcacctgtaatcctagcactttgggaggccaaggcgggtggattgtctgagctcaggagttcaagaccagcctaggcaacatggtgaaaccctgtctctactaaaatacaaaaaaagtttccaggtgtagtggcacacacttatagtcccagctactcaggaggctgaggcacaagaattgcttgaacccaggaggcagaggttgtagtgagccaagatcatgccactgcactcaagcctgggtggcagagcaagactctgtctcagataaaaaaagggatgtgcatttctaataaattcccaagtgatattgatactgctctaggaccacactttgggaatcacttccatcctgcatggctaggtttaaattaggcattcttaacttcatatgtggcagggtgagtggatgttgagggccccaggtatattcttgaaaaacaaaaagaagtcagtgatcagttaattcattctagtctcctgctgagactgttgtctggcttatgaaggccaggatttttgccacctgaggcatttggagaagcctatgaaggagagtagaggagaggttggggacaacagaatgaagccagccagaaaaagagactgggcatagggggaatgggaatttgaggagaaacatatcattcatcagaacttaaatctgcatttttagagaagatattataatgtgcttacgtggcctccagatgtgcacaggtgccataggatagaagtagcccagggaagccttgtcatagatgggctacataaataggaaggcttgcagcagtgttaaaagacagctgatatgattaggctttgtgtccccacccaaatctcatcttggcttataatccctgtaatcccgttgtgacaagggagagaccaggaggtaactgaatcatgggagcggtttcctccatgctgttctcatgatagtgagttctcatgagatctgatggttttacaaagggctcttccccactttgctctgcacttctccttcctgccgccttgtgaagaaggtaccttgcttctctttcaccttctgccacgattgtaagtttcctgaggcctccgcagccatgctgaactgtgagtcaattaaacctttttcctttataaattaaccagtctctggcagttctttacagcagtatgaaaatggactaatacaacaccctccatgcaacctggagaaaatgcaaagtacatatagctctcaaacttcaggaaggggatccatatatgcagacagccattctttaaaataacctttccattctcccatccacttcgctcacacgtgatagatagtctgtattatctcttctctaacatctccacccaaaactaaacaaaacattaaaaccctccagtcattatttaacttgcctctttcttcacctcacttccagtttctccccgattcacattcacaaaagcccaagaatgttatggctgatcaaggactctcctttgagggtgggaagaaactgcaggggtcaggccagaattctcttctgcagacagaggagggggaaagacaggaaataagcatgcacaacgttcacctttgttggctgcacaacagcttgggatgtgcacccagccctaggtctccagctgagatgtcctcagttgtactcagcaaaattgccaccttttctgagttatgaaagccttctctcctagagccccagtatgttcctggcacctgcaggcttttgggttttggttttggggtttttttctgtgtggtgttgttgttgtgtttcttcaccagggcatgagtagacagatcctatgcaggcactttctttgtgatcttcaggatcatttgttttatcttgcctcccaaatgctgatcacccatgggcatgcttcttgagggttgcaaccatggctttaaaacccagaacagctggtgtctgtggtctgcagggcccagaaaatattatttaatccaggaaacattcctttgttctgctctgcttcattcagacctctcctgggtcttttccttcccctgctggctatcgatttccatccaactgaaggggtgaagttcagaagcccaggagacagcctgaataatgggtatgcaagtgttgcatcacacatgcagcaaacatttattaagcatgtatactatacagggctgcaaaagtccatatgtactaggatcttacagtacacttggaaacaacaaggaatctgggtatgaggattctttaggtggaccagatgcctgctctgtgtagcagcagaactcttcaatatggactgtaaccacctgctccaaaatcaccctggggaattgtgaataaaatgcagacttcaaggctcatcctatacttgatgagatagggccctgaaatctgctatcttaacaagcacccagttggtttggctcttcatttttctttttgagacagagtctcattccattgtccaggctggaatgcagtggtgcgatcttggctcactgcaacctctgcctcctatattcaagtgattctcatgcctcagcctcccaagtagctgggattacatgcatgcaccaccacactttattttgttttatttattttattttattttattttattttattttattttagtagacacgggatttcaccatgtttcccaggctggtctcatctcttggcctcaagtgaagtgcccacctcagggacatatattgtatggtactgtagagtgctttatacttatctttctcctaaccagatgttagctcttagaatctcatcctcctactttccaaggtccctgcacccatcaccaggcccccaagggatatggacagggagagccctctggccaaattctcgctggatctcccagtggccgttcagcttggaccgccttttctcctcttattccagtgatagtccaggatatctttttgccttttttcccttaagacttccctggtcttggtatttgggattttctcattttgaatctgggggtgaagaggggaatttaggggatattggtcacttgtcttctgtgtccaaatgtgagtgtcttgctttggattaggaaacccctaactaatgaatgttgttaggggctaagaccactccaacagtagaagctagaaatcttagatactaccttgcccatctctgggtgcagccaggacactgaatgtgattcaggctctgctgattagatgtgtccctgttagacattgacatagaccccaggagccagggttataagggacaggagtcctttgtcctctggcaagggtaatttcctcctcagaaccagtcctgggctatgttgatgggcgtggcccagttgccttgtaccaagtcagttttctagtcctgactagaaattgttagttctggcagctaacaattctacatgatccaaaaaagtgagggatatcatttaaggagggagggagacagcctctgccttggtgtctcaccttccaggagtaaagacgtgtcccaagtaatgggtagctccatgcacaagagaagagacagtggagaagataagacatgcaagaggaaggatcatggaagagagacccagaacatttgcttaaccagatctatttataagttttagtccttaatcagaaagcaatgtatctttcttagaacagtaacctcataatgcattcctgaggagcccagttagtccttgctcctgtccatcccacctccttcaggcggtagaacagaagaagggtcttcatctcaccccagctaaagcatctctgcttccagaaagtgtggatgagtgggagccataaacctgggaaataagccacatgctacccttttggttgttgtttattttaacaaaattctatgaccccaggaccatgtttctaagagtagccacttgaagcagaaggaaatatttagtcaaattctacaatcacagccaaatacagtctaatggcagccagcagacactgtggaaagagagtgtcacacaccattctaatgtggggagtaaggatgatgaagaatcagtcataggtccgtgttgtagctccgtctggggagtggaactcatagggtataagtgattatttcctattcatttccttagccctgaaccgtccaatgaccacacgcaacttgactggcaagaggtgtttagaatgttgagacacggtcagaaatgattggtggtttcatgtgatgcaaagaatttcccatactccgcctgttttctggatcacctgtccccagaaattgcctgaaaacaaatcacaggttgaaactagaaataacttccctctcctaggcagcttggagactggccaccctgtttcttggtttggtaagaatgttccagacacaaggaggggagcaacacacactggggcctgtcgggggttggggtatggggagggagagcattaggaaaaataactaatgcatgctgggcttaatacctaggtgatgggttgataggtgcagcaaaccaccatggcacacatttacctaagtaacgaaactgcacatcctgcacatgttaccccagaacttaaaatgaaaataaaaattaaaaaaaaaagaataatccagaaagtcaagaaaagcctaactaaaaaagtctttttaggcaagagagcatcgtaagtaggatgtagaggaagctcccctgcttaaaacctgttaatggtcttctgtagctttcaaattctagctcctcttgcctccacgactcaactccccagccctccttccgagtgtacaagatgactcaccctgagtccagagccaaactctcggtttgcatcccagctctttgccacttactacagaccatgtgaccttgggcaagtcacctaacctctctctgcctcactttcttaatctgaaaagggggggatgatgaccacccgtttcatcaggttgctgtgcatacaaatgggcgaatatgtgtaaactgctgagaacagtgcctagcaaatagtaagccctatgtaaatgtttgctgatgttgtgttccatgattccgtggctttgaagatgctgctctctcatcctgcaatgccaccttaccttacctagcaaattccaacgtgtccgttaacattcagctcaaggctgggcacagtgactgacatctgtcatccccaaactttgggaaactgaggcaggaggatctcttgagcccaggagtttgagatcagcctgggcaaggtagcaagctctcatctccacaaaaaaattaaaaaattatccagaggtggtggcatgcacctatagtctcagctactccaaacactgaggcaggaggatcgcttgacaccaggaatttgaggctacggtgagctctgctctcacctctgcactacagcctgggtgacagagcgagaccctgtctctaaaaagttttcatttttaattttttaaaaaatgtttttaatgtatctcaagccctacctccttcagcaaagtgttctgagcacccaggtctgatgtagggccttgtccatgcttcctgaaaatatatcttctgtagcattcaatgcactggaatgcctatgttagctgaaagttactgatcacaattccggtggcctggaggattggtgagcccagctgtgaagtttagaggcttgctatcttgcccaggctgatctcaacaagtaaacattagtttattcatctgtcttctccctggtttcaagcccctggagtgtagggccacatcttacttggcattgtatccagcagtcaacatagtcctagaatatagaaggccctcatgttgaatgaatagtaaaaccctcctgaaatccattaaattcatatgtttatttactcactcattctcttcctttgttcaaaaaacatctcttgagcctctgtgatgtaaaccaagtgctttttaaccagcagcttctctctgatgatctatctgcaatctctgtgtcagtcctcacatttaactaggacaaaaagagaacatagattcttagtagctttgctcatgacctgactttaacaagaaaaattttagagaccaaaagtctgactgatagctgagtgagttctttctttcaaactcaaagccctgtttgagcctctaaacttcacagctgggcttgcaaatcctccaggccaccgcatttgtgatcagtatctttcagctaacataggcattccagaagatgttctgccctaaacgtaattggaatcctttttgaatcagttgccacagtacttctgaagttttttatgctaacttcttgggtatatttcctcaagatggattcaagatgtggccagttctcttgtgagaagaatacatttctgttgtcctaagtgtagagaccctctagttcatgtaatagccctgcaaagcaatctgctattaccagtcccagcatccatttctccttccttccttagtaataaaaccctgctttggctgagcaccttgttgcccagaattaaacactgttttaccagcttccctgatgggtgtggtcaggttactaagatctggccaaagatgtgtgtatgagttttctatgctgctgcaaattactacaaacttagtggcttaaaacaacacacatttatcttataggtctggaggccagaaatctgagatggatcttagagactaaaatccaggtattggcaacagaggtgtattcctcctggaagttattgctttttctagcttctcgaggtcgcctgcatttcttgtctcgtggccctttcctctgtcttcaaagccagcagctctctggcatgtttgtgcttctcattctcattctctctctctctcccaccccgcccccgcccctgctgtgttatcacatctcctctctctgatccttctacctctctttcataagaacccttttgattagatagaacccacatggataatctctccatcttgaggtccttaatcacatctgtaaagtcccttttgccatgtaaggtatcatattcacagttctggggatcaggacatggacatcggggggacattattctattgtcatgtataagtagagtaagtaagtagagtatggcattttcagaaatgtgctcaaagggaggtgtctcaactgggaaggaccctctttgacccttctgcctttcctttctaaagctgagatatgatggctgatgctttagcagccattgtgaaccatgaggtggccttgcggatggaagtcaagcactaggatggtagaagagaaacattaagatataaattcctgatgatgccatggagccaccttttaccaaatacacttctatcttgtttaagctactgccatcttatttgtttttttttttctggaacatacagctggacctaatctcaatcccttaaaactatacatgactctcttcttaataaactgcaaggctggttctctcagcctactaccctgcctaaggaacagataggtagtaagcatggatatgaccattgctcagaaaatgtgttccaaaaacagacagtatgtttatcatttattgatcagttcagcctctggctctgcctatacactgagccatacaacctcaatattaatctgggctgttaacattcttccagagctttgatcatggtctacatcttactccccggagaatcaggtgggcagaaatgggctactgacctatcaatttctagtcctgattagctcaaaatgtggtcatttcctcttaacataaatgtatttaacaacctgaaatagcaaatagcaaggtaactttccactgacctgtcttactattaatatcagaagtcagaggtggacctaaaaagtaaccaaacaatcaaaaccaatgtctgtaaggaaaaccagcatcgttattagtgacaccaagattcaaatcattgatttagcaacactccttagtgtattcatcagatgtttattggaaatctatggtgtggcctctgcagtgagtcagagtgcagagttgaagagatgagggtccctcaccttaagaaccctcactgcattaatggagagacagaccaagaaatgcctttgtggtttcaagaagtgcctttgttctgtttcatttttttattgtcaacaatcatggccaggcatggtggctcatgcctgtaatcccagcactttgggaggccaaggtggggggaatcacctgaggtcaggagttccagaccagcttggccatcatggtgaaaccccgtctttactaaaaatacaaaaaaaaaaaaaaaaaaaaaaaattagccaggcatggtggcgggtgcctgtaatcccatctactcgggaggctgagacaggagaatcgcttgaacccaggaggcgggggttgcagtgagccgagatcatgccactgcactccagcctggactacagagtgagactccatctcaaaaaaaaaaaaaaaaaaaaaaggaaaaaaaaaatcacaacctagattctgtaagcacctacagcagctatcctttgctggggtttcctcattcagctctctcctcattcattatctgggtcctattgtattccctttattagttttagcaatgtttaaaattatttgctgcttgaaatctaatccattttgcaagtaaccagcacctgggggcaggggtagtgatgagaaaacagggctaaaaggaataaattcacaatgagttttatatttacaccatccttttcccattcacagggttttcccatttgggaacattcttagcgtgttctctgaacagaagaccgtttctcttggtctgaagttgatcaatgtgagaggaagatggcacattagaaagatgcctggctctgatgacattccaccccgcagtcttccagcacactgggatctggggcttgaagtcacttgtctggctgtgtgactgtatccacttggaagcagcgtcccctgctcctaagttgcacaagatacttcagggagtctgctgtgatttagtgatagacaagtcagaaaacaagtttaaacttgttattaatcagaagagaacacagacatttttagctgtctatctgacttggtcatagggcagagccatcagatgccatcagtggtggtcggtgtagatttttttgtgaatcaagacaggagcaggaaaaaggggggtggaaataacagacaggttccaggagggcctggtggagggttcagctgttggagctcatttttcttgctttttcccgagagaggggaatggactgccattgtcacaggttaagtcacagaagagtgaagctcaggtgacaggagacattccaaattgagaacagacatgccaggggtccctgttgccacctgctcacaagccaaggccttggttccgagcccctcttctctctctgcattttctccttgggtgacctcatccagcctcgctgcctgaagtgcattcctacacaccagtgactctcaaatactatctccagccagctctctccccacaaatccagattcaacagccactccatgtccctactcagatggctcctacagacctcaggcgaaacatggctagcacgcaagcccaggtgtcctccccatcctgttttctcatctcagttgatgtaagctccaccgtgcacccaactagttaagctagaaacctggagtcactcgagactcctctttttctcatgggcaagccccatccatcagagaggaccaggagccttgcctccaaacccatttgcttctcttgatttcaccatatcacctgtgcccaaccagccttccatttctctaacccagtggacacagttccaaactggtctccttgcttctactcctctccctttacaatccattctgcactcagcagctaacatcttttaaaaacataaactggaccccttaccacttgaagccttccaggactttctatttcttttaaaacctgacacagcccctgccttcctggtctcctctccactgtgttctgtgtggccaacctccaggcgtacgagcctgcctcttgccctctggacagatcaagcttgcttcctgccttggagatctggccttggctgttcctctgatggggaggctcttcctccaaagagtcacacgaccatctccttcttgttcctgagttctttattctcaatgaatgaagtttattgcactcccctccccaatctcagtagtccccagtgatcctctctcccaactcccattctagcttcattattgcgctgtttttccttggtttcatgcagtttccttgttcattgactcctccattacagagtaagcttagagaggtcagggaccacatctgtttctgtctcattccccacttcagcacagagaacgatatggggcacagtaggagctcgataaatgctttagtgaatgcataaacaaagtaagaaaccatgaggtgacccaaacctcggtttcttcagttataaaatgggcacatgggtgcaaaggctcaggtgtattgtaagggtgaaacgagaggtgatgcgtgtgaggcctttgtgagctctagatctctttgtagatgcaaagtatcagtgtagattgcagtaaccaggacatcagaagaaaaccctgctctttggaagcaaagtgtgccaaataacaaagcttagctctacaaggctatcgctaagcctatgcaataaatactttctctcctccacatctgagctggacattctccacttgtccctccagagccactctccacccttcttacctgcctctgtgcctcacgggctgtcactacagctgcctcagtaagctcccttgccctctgggtacaaggcttcaactgatgggtgacaccaacaggagatcagaggggaggagagggagaccaggtaacttattccctggcagaccttcatcagagagtagctgtgttctgctgaaggctgtggcttctgtctgtccaccttctcctagaaagaccacatcctgtgggttcctgtaactgttcctccttgctaccccattcgacctgaggttggaaacttcctctagttgttgctctagccgcaggctgctccacaatccctaacccacccaaacctttgtctaaagcaccttccttacaccctccccagctgtggcatttcggggccctgttagcatccacgtgatgctgctttctacaaatgtgtctatttgtggtgacagcacttgcgctttgctttcttccctttcttatcctacctgatatcccagccttctgcccctcagctacaagaccactccataaccatagaggaccaaaatcacctaggagcttgagagagaaaatgtatttgacatcttgaaaataatgcagtttgctcaggggatttatttctccctcccctgggctctgcgctcagaccctctttgcttctgtccgactactgcaagcaggcagttaagattatttctagcaaatggacttagagaagctgagcatatgagtgatgttgaaatttgacctacacttcttttttttttttttttttgagatggagtctcgctctgttgcccaggttggagtgcagtggcatgatctcggctcactgcagtctgcctcccgggttcaagcgattctcctgcctcagcctcccatgtagctgggattacaggtacatgccaccatgcccggctaatttttgtatttttagtatagacggggtttcaccatgttggccaggctggtctcaaactcctgacctcaggtgatctgcctgcctcggcctcccaaagtgctgggattataaacgtgaaccaccgcgcctggtgagctatgcttattacttagatttctagcagataacatatagttatttcctaaaactctgttcttaacctgagctgtttttgtcatttttcagggttttagggggtgggaacatattacaggagctattaggtgcatgagtgtgagttgcgggcatatgtgagggttgtgtgtcttgtgtctatgcacatgcgcaggtgtgtaagtgggtgtgaatatgtgtgagcgttgcatgcatgcatgagttgtatgtgtgttgcatctgtgcgtgtgtgcaggtgggtatgagttagtgtgagtgttgcctgcatgcgagttgggtgtctgttgcatctatgcatgtgtgcaggtatgtatgactgtgtgagtgtgtgcaggtacagcttctgtattaataagagacgggcaatcactgtgcactgatattgaggggtagggattagagggcaccttgtctatttgggaggtgaaggagggctggaatgagaggctgaaggggtacagaagaggaaggcagacccctgcaggcctcagggacctagcctccctcccttcagtgtcccttcctctccctgcaggaaccagaaaaagtgtggaggtctgaattgcagtctctaaaatctctcctcagtctcacatgactggcttcagttttctcaccagtcctgcaaagccaggccttgaccccttatctaaatatccaaagaaaaaaatggaattagggatcttagaaggaaagagtggggcaggaaatgcaccaccagggcagtgcagcttggtcactgccagctcccctcatgggcagagggctggcctcttgcagccgaccaggcactgagcgccatcccagggccctcgccagccctcagcagggccaggacacacaagcctttgacttcctcctgtcactgctgctgccattcctgttttgtggtcatcactccttccctgtcctcagactgcccagcactcaaggatgtcctgtggtggcatcagaccagaggcccctgaagaggagtgagttgggtgttttttgccgcgcccaaagcagctggctgtcccctgaaagatggcaagtggggaatgatgatggtgcaccatcgttctgcacaccaagcccttctggataggaggcccccagcagtggagggatgggggctgccaactggcattgcccagaggcccagctcctggtcacatagactgacctagcagtgcaccagctacccgaggcagcctgcaggaaaggtgcactcatagcgatgctggaatgccatgaggcccagccatggggttgagaactggaatggagggaaatgtttgcatcctgatgctgggaaacaggagatcagtcctcaccaacgctgagatgatttccctctggttcttaagctcggttctctttctgcttgatgcttgaatctctggtgtctggcagagagtctggtgtctggcatagtgctttgtatgtaggtcatgccagagcatgctggtgactttgcccttctaggactcttttccatttcatagggacttgctgtgaaaccccgtttgacctggatataaatgttagatgtcatggagtcctgttagcatggtgagctgcaggctgttctgcatgagtcctccttgagcctgcatctaatacccactgctcaatcaatctcttttcactgtttcccattgatcccaagtgtgtcctctgtgagccttttcttgacactgggtcacccagaattactcccctgtctgtgtccccatagcaccccacaaatagttcaatcatagcccttgtaacattctggtgcaccagtttaaggacagagccctgtcttattcatcattgctggtggatgaataaaaatgttcaagtcgtaataacggcaatgacaacaatgataaactcaccacttactgaccattggctgtgtgccacaggacataggactgaacatcttacaggtgttatcctcatgtccactctctcagactgcacttctatcgtattctacagaaactgaaggatggaaggtcacagagctggtgggaggggagcctggattcatacccaagccgtgtgcctcctggccactcctatgggtgaaggaaagcaaagggcttagctgtagctgggatggagaaagaggaatctcaggcttctcgtcatattttgcctcaagaactggaaattgatctgggagtagatcccacactgagggagaaggccccagaccaagaaaggatgggctcatctatttgattgaaaacagagaagcttggaagacccaaggtagggcaattcctgaaccgtccagggctggaaaacctgtagcaaaggcctggggagatggggcagaaaggctaaattataacttaggaatctccaccaggagatcagctccaagacagcttccagtttcggcagatggaagggatacttgatggaaaaggagggagggtaagtgtcagagactgctaaatgtctttacctacatttcctcatttcaaactctcacagaacagagtctgaggtagactctagggctggccccattttgcagatgggtaaactgaggttcagagcactatacccgtaagatctttgctcaagaacttgtatgtcccagaccatgcttgaaacctggtttactcacacaccctgctgtgcagacctcctccgttccaaagtggtggcagacttcagtgtgctttgcagactttcaatctcagcacatgctgtggaagtgctagcagtgttgctgtgctaaccctgtggttaggctgatcacagtcctggtgagtaactatggcctgcagccctggcatctgaaagatgaccccttgcctctcctgctgtcctcaagaaagccttagccccctagattattttcaatataaaatgttcatacactacttttcagattcaaatttgcacaaatgaagtgaccgttagacaccactggaaggtaataaaacccccaagcctgccagccatcaggtccctcccagccatcccagaaatatgctcagctgccctcgaaacatctgtcatgctctctggtgggtgctactgggcacctgacattagatcacttctctcccaaagctgcagctctgcttattcgattcttatttctgcctttggattgagtggaaggcagtcatcagtgacagccaccctcggggaacagaaacgatgtccacagtggcaacgatcctccatcttcctgcactgaggcctaatcaatgtagcccatacccagcctccatttaataagctgattgttgagctaaatcccgcacactctccccttgccctggacgcttttgattgacaaaactaatctctcctccacccccacgtctgctgctgcccacatcctcttgcaaatcatgtactcggctgctgacaattagatataagacttgggattcggatgtgggagggttatgaggttatgaatcaattgtgggggctcaggtgagataacaaaccaggggaacccatttcagacacctcgccacagccctcagagcctcctggttgatttatgagttggtaataacctcgctgggtctcctggcccctattatttttcataatgcacaggaaagctttaaatatcagagaatggggaagtgcacagtctgagtgggagggaggtgaggggggatggggcttgggggagaacagtggccaagggcttccccgcagctgattgtctctcctgccccatctccccaggccttcgctgcaggtcttctagtcctggacgtttcaggaattgctttatcttggctttttcaagcttctctgtttcattcaaatagatgagcccatcctttctcggtctggggtcttctccctcagcgtgggatctactcccagatcagtttccagttcttgaggcaaaatatcaggagaaacctgagattcctccttctccatcccagctacagctaagtccttcgctttccttctgtgggtcaccacggggtgccgttgtcatatacccatggaggccagcaagctgatctggccaacctgggagaagaccccaggttgatgacccctggtttaggagtgcatatggcaggatgcttgagggatcactgggcccaaaatcgtatttgctgtgtctggatgtaatgcctcccacctgttcaagaccacgtcagaatgactcagagacctgcctgttaagaagggaaaattatccgctggacaaaagccagtcaaaaagcaggctcaccctgcagtctggaagccagttgagcagcgaggacaggccaaaaaggtgggagggggccagtgagtgtctctcagcctggaggtaaagagctgaagactttacctttccttctgcctgctgtcctcttcccagtgacagccagtttttaataaggaaaaggaggaggctttgaattgctacctaatatttgtttaagtagtaatttgttgagatttctctgttttgttttgttttgttttgttttttgagacggagtctcatgctgtcgcccaggctggagtgtagtggtgcagtcggcttactacaacctccgcctcccaggttcaagcacttctcctgccttagtcatccaagtagctgggactacaggcacctgccaccatgcccagctaatttttgtatttttagtaaagacagggtttcaccatgttggccaggctggtctcgaactcctgacctcaggcaatccacctgccttggcctcccaaagtgctgggattacaggcaaaaagatgtgattttttttttttttttaacagtatcagtgggtgaaagaccctgaacctttcctctaaggcagtgtttgtaaactgcctatatgatgtctggtactagattgtgatgatgttttcaagggccacaaaacaattgaggaaaaatttaaaacatactgaatatacatgtgtgggtgtttatgtattatgatgtgtatttgaatacaactatcaacgaataagcattcattagaccccaactctgtaccagatgtttgtttactccatgccagggacagaactaacagggtccctgctctcttggagctacagtttagtgggcattatgggttgaattatgttctctcaaaaattcatatattgaagttctaaacactagaactccaaaatgtgaccttatttggaaatagagtcattgcagatgtaattagttaaggtgagataattagggtgggccctaatctggtatgactggtagtcttattaaagggaaatttgggccagtcatcgtggttcacacctgtaatcccagcactttgggaggccaaggcaggaggatcacttcagcccagaagttagagaccagcctgagtaacataaggagaccctgtctctacaaaaaatttaaaaattagccagcatggtggtacatgcctgtggtcccagccacttgggaagatcgggagaggcctgggacagattctccctcacagccctcaggaagaaccaacccgttcgacacctggatcttagctgtctggcctccagaaccatagacaataaattgctgttgtctaagccacccagtttgtgataccttgtcatggaagtcatagcaaactaatatagaagaggaaacagacatcgatcaaataattacattgtggctaattccaaactgagataaatgcttcaaggagaaagaaccttgttctcttgacgttgaaagccaaaggaccttgagccagtctggagggcaatgaaggccttcccgagggagttagggctgaaggatgtgtcagagtcagctagagctgtgttccccagcctttttggcaccagggaccagtttcatggaagacagtttttccacggaccagggttgtgggggatggtttcaggatgattcaagtgcattacatttattgtgtactttatttctattattacattataacatataaggaaataattatacaactcaccacaatgtagaattagtgggagccctgagcttgttttcctgtaactagacagtcgcacctggggggtgatgggagacaggaacagaacatcaggcattagattctcataaggagcgtgcaacctacctggcatgcacagttcacaatagggttcatgctcctgtgagaatctaatgccactgctgatctgacaggaggcagagctcaggcagtaatgtgagtgatggggaggggctgtaaatacagatgaagcttcacttgctcacccgccactcacctcctgttgtgaggcctggttcctaacaggccagggaccattacctgttgggaggctgaggacccctgagctagaggaagaggtgggaggaggaagggaaggcacgacaggcccagggagtagcagatgcaaagatcctgtggtgcaatggagactgttgcattctgggaagggaaaggcagtcccaaggcaggagaggtgggggaagaagaagagggtgttgggatggatgcaaccagagcaccccaaaccagaaagatgtttactccattaccttcaactgaattacagtggggtgagggcacctattttgctttctgccctcacttccgggaaatgcgcatcctggatcacagaaaagctgctgggcagaggtcccagtctctcagtgaggcctcaccagactagtagagttgtccagccacaatgccctcctcatttccccttctgtccaacaagctgtctatcggaagatcccagtctaaaagcaccagaagacattttgagtttctctaaggcctaaaatttaaaagctgataagtaacacaaggattccaagttactgctgtctctcccagccacgcagatgactgggttagacacttggctggtatgaggtccctgaaacatgggctctgtgagtagccaatgtgtattaatattaatgcttatgatatgtcaggcactctgcatgggttcattacccctcacagtcaagatgatgggtcccattattactgtcctgttttctttatttttgagacggagtttcgctcttgtttcccaggctgcagtgcagtggcacgatctcggctcactacaacctccacctcgcgggttgaagcaattctccctgcctcagcctcccaagtagctgggattacaagtgcccgccaccacaccaagctaatttttgtgtttttagtagagtcagggtttcaccatgttggccaggctggtctcaaaatcatgacctcaggtgatccacccacctcggcctcccgcagtgtactgttctcttttcatatgaggaaataaacgcacagggccagcagatgacttgctaacaaccagatcatttcagcaaaaccatgaaccaggcattgtgaagagagttttgtatacctggccttattcttaactagacagcacttcaccctagttgacgtatgaagaaatggagatcagggcaggtggtgggtaagggacctgcccaggttcccaccgtttgtaagtgatgtaccatgagttgctctcaagtgtgtctgactttataaatgctgcaccttatcatttcctatgcttggtaagcaagtgagtgtgaaatttgccacgcttttccttggaaaaactcaagcccattgaccaaacaatactacttgaaaatgacactgaacttttcatcactgtgtttctccacctgtgttcccttctgtcttactgccacctactcattgtgctcaccctccaaagcccagtttaacatttcctcttagttaagctttctctgctagctgatcattgcattttttttcaattaaggcataaaagaaaaaaaaaagacggtaaagattgtcctacttagaatatccttccattcatttgcaaaatggagataataatatgctatttacaacataggattagtatagcaggattattccagagcctggaatatagaaagtactcagtaaattattagttcaacagctaataatagtaccaattattattatcactaaattaatgcctctgtttcaggaaaaaaactgaatacatacagaatatcggttttctaattgttttttctttatactacttggaaagttatacagagttaagagacacagaatagtatagtggaaataatatttggcatgaaattgcctggattccatcagtagtagcctgtggtcttgagcctctctgggcctaatctttaaaatggatataataattatcatattggacacaattattgtcaagataacatgcgataacagggtcaagtgcccagctctggcctggtacaccatgggcactcaggaaatgtcactccgccttcataagcattggcctgtgcatgacatctatgtgataaggtggcctgaagctgtcctccccacccagaggtgcagcagaggcctggcaggaatgtgaaaatccaatggatcaagtcataaccttgactgaagagtatggtgagttcactcatggcaggaaccatctgatcattcatacggctccagaaacattttactcaaaagaaagtgtctttccccaacagtcaagattgataattagtttatgaattgcttcatttatcagtactatgatgtactgtataatccaccaggtttcaagttactggaattttgcaggtgatgggaaccagtctttttatcaactttgcataatctgatctgggctcagattgatagaatgctttgggaagaatcaggggagtgttttatactaggatctcctgcggttctgatgcgttaatgggaggaagctatccctgtcaaattctacaattttggaggagcttaaaacacctgaagacaaagccctgaattttatgagtgtctgcctgaaaccagaaacagaaaccccttacagcttactcaacagcgttaattcagcatggaaaggcaccaggaaaagatcactgcgtcttactcccaccaagtaaacaagctaacaaacacagaggagaggtgcaggttggcacccttaggccggactctgggtggacagccctgtcagagtctataaagggtcgctctgaggctccaggagtggcagatggccagagagtggccaactggaggcacactattgagcctcgggattgagcctcccactgtttacccctcaggaaaaagagagctttgagtctcctggccctttccccagagagcaggaaatggccagggcttgaggatagccagaggccgtccaaagttacccataccatctccactttggcctcagaggccagctctttcttctctctgtgctttttaaaataaaaacttatttttctagtgtaaaagtattatatgaatgttctatgaacttcaaataatacagaaatgtaaagaatagaaatttcccattatttgatgcctcccgctccccaaaataacctaaagttaacaatttaaatatatatccagaatttttcctctccatatttatatatatctatacatatataattaatagaacataaatattttacagtaaccctgttctcaagatgcttttccactgtagatgtttaataaatatttattgcatgaatgagccataatttatttattcagtcctctattagaggcctttggtttgttcccagtcatctaataaacatgattttagatataaaagacataattgaaatacatataacacatacagaaacataacccataactgcatatcataaatatatccttaaatatactaataaaacacgcatgcaatggagaggtgttttgggtgccgtctggtgtatatcctggatatccctggaatatatattgataaatcagcctcaaaaagaatgctttcagacagtgttttaggatctgtgggaacaaagggtggccatcctgcatttgttatgttgtttcaacatagcatttgttatgttgttttattaactttaagtccttggcaaagcagcttgactaagataagatccagaaaccagtcgtggtaacaaggcaacaattaatcttagatagaacagaaaaggaatccgcttcaaattctctttagaacaggaaggaaagggtgatcgtgggttagcaggaaggaaggaaagaggcaagaaaggaaagtgaaaaaagaatggaaatgctttctcctgctggtgatttggatgtttggactactcttgtcagatgctacagcgtaatcactgtaaatgttttaaaggacgcgatattatgacagatttccctttctgacttgttcctggggctgcacacacaatgatttactccctgccacgggctggaggcttggccactcctgggttggtccaaggaagcctggaatacccaatgcctgtgagagtgagcacgtccccctgtctctaggtgttgttgcttgtgctgaaatggagtctaccaagcattgccatggcatggaagggatggtggcggagtagatgccactgcagattgagtgcagtgtcccaggcagccaggggcagccgctcagcccttgcctggacctgaggactgttgcatcagtctccagatgagacagcagctgtcatggtggctgaaccagggaaaagaaactccactctgtggtctccatggggctagggaaaaaaggaaatgggtttttgtgattttcccttctttagaaacaaaagtgcttaaatgtgattctttagctctgtaaatgcaaaccacggcctggtggactggggagaacaattaggccaaaggctgagcacaggaagccaaaagcgggtggaaacccagacaacggtgctgagccgggggttggggtggttggggggagcggatatgatagcaaggaaggagtttcaatgtgaatgaatactaattagtgacatggatattaatgatgacagtaattaacaggggaaaggaagggctgtcattgtcccagggtgagtaatcaatcttggcaggtgataaataatggttcagcaagctcagcagaaagataatccgcaggcctgggggagaactcagctaatgcaggaaacctcacagtttctaggcaacccacagaaaagaactattttttttttcttttttgagacagcgtctcactctgtggccaggctggagtgtagtggcgcgatctcggctcactgcaacctccacctcccgtgttcaagcaattcccctgcctgagcctcccgagtagctgggactcaggcatgtggcaccacgcctggctaatgttttgtattttaatagagacggggtttcaccatgttggccaggatggtctcaaactcctgacctcgtgatccaccctcctcggtctccaaaagtgttgggattataggcatgagccactgcgcctggccagaactatttttcttttgaggaaaaaacagattagagtatctctcccacccccagcttgggactacagttcttatttgatttctgctttgttcttcatttcctgggacaaatgttgaacttgtataacttggaggaaagggacacacaggcacatgtacacacacacatattcattctctctctctctctctctctctctctctccaagaatacgaatgaatacgagtgtttttgatctaaagtttgactcacagatgctgtccaggagtagcaagagtgaggagaagcctagaagtgctgcctttgaggttggcgcggggaaactgcaaaattgcaaggctgtgtcggcagaactggggcacacaggaggatgaggatggccctgggggtcccactgtgcagggttacttcacctgccatggacccagagagaaacaaaatgtctaggctttctgtcctgtaccagtcccacttctggccaccagtcacatatctaagaaaactgatttctgggaagagggcaatcctcatgaagcccctctgctggatccccaggccttcagccaggaatccagcccaggagagttcttggcacatcccctccctctcaccaaagcctcagacccacggtaggactctgatatctaaaatgtctccccttgcaggctgtgttccatcaaacaatttagaggtgacaaagccacaccttcaatggtctgcactggtttaaagtgagatctttgggtggcaaaggtagattgaccagaaattcagaaccttccagaaaactgaactcctctactgccatgtacacagtgctgctctcagaacattgtttgcgggtcacattttcaaagagaggcagacagaagggaacttattcagaggattgggaacatatggtgaggaactccaggccacaccctgcaaggaagcagctgagggacccaggcctgttgcacttggagggaggacgtcgctggtatgccgcaggactgtctgaatagctgaagggctgtcgcacagagtggttaggttggggtttgtttttctatcatcaaatggcaaaactgaggccaaagggaggaagtcagagaggggcaagtttctgttcagataaatcaaggctgatttaactgggtcaggctgggtaggggggagtttgtgagtttccaggtactagggattctaaacacaggttacagcacctcttgtccagggtgttgtgaatgggacatgtattggctggggttggagtagacaagctttaaaagttccttcagggccgggcgcggtggctcatgcctgtaatcccagcactttgggaggccgaggcgggcggatcacgaggtcaggagatcgagaccatcccggctaaaacggtgaaaccccgtctctactaaaaatacaaaaaaattagccgggcgtagtggcaggcgcctgtagtcccagctacttgggaggctgaggcaggagaatggcgtgaacccgggaggcagagcttgcagtgagccgagatcccgccactgcactccagcctgggcgacagagcgagactccgtctcaaaaaaaaaaaaaaaaaaaaaaaaagttccttcagactcttaagatttatattcgttaaggtaatactagataccaaaacagctaagtcccaaatttcaggggcttaacacaacaaagttcagtcctttcagtcctcaatcaagtcagagccccacatgggcgtaatgtccatggttggaaccgtggctccctgcctattgtggctctgcattcccccaggtctttggagtcccccacatccagccagtagatgggattgaaaggggcagagctaaggagagccatgtaggagtttttatggtccaggtctggaagtggcatatgccatttctacccatattctattggcagaactcagtccatatctaagtgcaggggaggctggaaatgtaatctagctatggcacagtgaggagaggaaagaggtcttggtgaatacatagacgtttctgccacaaatgcagggacacattcattcaggataggcctgtgccggaagagatgagagttttgcaagaacctatgaggtcacctgtgttggtcagcccttgtaattgatggtagggagctgatgaggcctccttcttcaagaaatggtctgggggccaggcatgataaagcttcacctagcacgtctcagggaagtcctctatagacacttcctagaaacatgaatataagctcatcctgcatcatcagaagtgagtgttttttggacaagaatggaattgtaactatggaagtgtactgaagaatggaaagggttggttaggacaaaaaaaagtgcccatattatcctgctctacagtgtggactgtttggaattaggattctcttaggtaaacatgtttcttctgccacagtgttaaacacccaggaggtcttcagctgaaattgctttatcgttgcaggtactgacattgtgcagtggcttatgaagaacctttccattgaggacccaggtacttgacctttgaccccacccttatctcccctggtatcagtaaacatcccataaccaagttccaaactagattcccctgccctcctgagaactggtcttgtaaatgtgaattccaagacgtggaatcactctatttacaaataaaattaatttattttctccactgaatatttgtctttaaatttaaatcatgctttgaggaaatgagcaactttttagaatgccaaagagcccaatacaataatgtgtgaaatgagttgaattctcattagctgcagcaattaaagataagttgtagcactgtcactgaacagccttctagagccagctcttaaaattagattgcctgatccacaattaagatgtttaattatttgctaagactccctctgttttctgcttctgcaagaagtgaaggaatgattttttttcaactttaattgcgcatttcaattaggaagaccttaccaggaaaacaacaacagaaccctggccaataaaacaatttcccagtctgttctcccaccagaaaataggcagtaaaatttattttcacagtgtaattaggaaatggggggggtgttccagaaaaataaaaattcaagataagtaaagcttattcccatgtgctgtcagttaatacttttccgaatttattacatactcctttgccttgattaactgagtattcttgatgcctgaaggtcacatttataaagatccactaatacactctgatgttcttaatggacattggcgtgattagacttacctgccccaaattaaatggccctgaaccacaatgctttttgaagatttttttgaagtgcccattctgcatccgtgaccttcagctgtgagtccctgctggaatcggtgtgtcagcttggcactcctgtattttaacccaacatttctaatctgttgactgcaaaacaatacagtttctatgcagttcaattatatacagttgttagaactctgagtgccagaaaagcagatcattcatagaagtggcccgagtcttttcacccccttgattagtggctactctcacaactagtgaaaattcttaattctagtcaagttcttgattcacagggaaaaaactataaatgctaaccctttgtaaaggatagaacccaaagcaactcactatgtgttgtccctgatgcagcctgtacttctgagtgtccgcttggaaagcctggactgaatcagcatctacctgtttagttacatttatctaaagtcagtatttcttgtgattataatgctaaactaaggaacgtgtttcctcatggccaccttttctcttccaagagcactggtttctttgcctcctaaaataatcgttgtatttctgacatatattttattattactattatgagaaccctaaattggcgagcagtatgtgagaatgagcttcaggaatcctccagccctggcgtgagaagcttctgtgaagggtcctgaatgatgagagttatttctatgaaaatctgttatactctgatgcccttgggaagacatcatggtataggggcctgtttgggcttctgagaagtggctgaggagaagctaagaaccatttgtcagctgggaatagtctaaggggggagatgaggcaaaccgaggccttgggaaacagtcagatccagcatctgcccctctctcccttctttttcccatcagtcgatttcctgtggttattttttggtttttgaggcaaggtctcactctgtcacccaggctagagtgcagtggcacgagcatagctcactgcagccttgacctccctggcccaagccatcttccacctcagtctcccgagtagctgggactataggctcctagcaccacatccagctaattttttgttttattttttgtagagatggggatctcactgtgttatccaggctggtcttgaactcctgacctcaaacaattcttctgctttggcctcccacagtgcttggattacaggtgtgagacactgcacctggccccattggccaacgtctaagcaaaaacatttttgctcagagaatgaagttagagtcttagctccaagactggtggcatgaaagtcaccttcctacaggattttgttctttcttctctggggaaggagcaactgctgatgatgaaacttctgttctagctggactcatggttcttgaagcatatggactttaaaaagcaaaccggccagacatggtagctcatgcctgtaatcgcagctctttgggaggctcagctgggaggactgcttgagcccaggagttcaagaccagcctgagcaagatggcaaaaccctacctctaccaaaaaaaataaaaaaaaaattagacagacgtggtggcatgtgcctgtggttccagctacttgggaggctggggcagaagtatcacttgagcccaggagttcaagtctgcaatgagctgtgatcatgccactgcactccagcctgggtgacaagagtcagacctgtctctaaaaaaaaaaaaaaaaaaaaaaaaatagcaaattggtcatcactaagcaagtaaaataaaactctattcattccaattccaccagttacatgtatgtttctttcaaaggagaataggtggttcttgatacgcaaaacattgcattgtattcaacttcttgaaaagtttgcaagtaaagccaaaacaaactactttaaaaagtcagagctcgtgaaattaataattgctagaggctccctgagcacattaacaatttccatgtccaaaaattagttttaacctgtaacagtacttttggatttgtgaaagattgtgtgtggtagaagcattgaggtttgttattttttcttagctctgctcaggataaatctaaattcttaacttttttttttttaattgagacagggtctcgctgtgttgctcaggcttgtctcaaactcctgagctcaagcaatccgcctgcctctggattacaggcgtgagccaccatgcccgacctatattctcaactttctatgtgcatctatttatggctggtgccaaaggaacgaaggaacagattgactgtggcaaaaatataagtatttctatcaggttagcctctctctgtcactgcccacttcagtgtccttcctctaattttcaaaggaagtgaggttttcctctctgtccataagagaagggtgacacccttctcattcctgatgggactgtcatattggggaacgcactgggagtcctacgtctctatgggcagcgaggctgcattcttactgctggggatgatgaaactggtatgaatcagagctgctagcacttacggagtatttgacctgtaccagacaatcacttcatgtgaaatatctcacttagttaaatacaggttcttctatgccagaacttatgcccttgaccctgaagccagactttcttctgaaggtcagggtgaggaggggttaagccatgtcagactctcagaggtgggattcagacaagtcccagacacatagttgccctttccagccattggcatctcccctcctcacccccacactgagcaagggcaattgtatcatcaacacagacatctgggggtgatgacagttgacttctggtctcccagcttaattttcagccaaataacctgctttctaattccttctctctctatgcactgttcttacagttgaagcaatacacttggggagccttatcgctgcccagggctacatctttccaatctcagaccatgttctcaccatgaaggatgatggcaccttttatcgtttccaggtaagcctgctggctcctcctcctgaagaaccttttcttcacaacatcatctgatcttaggttagaactacaaagaaaacctagggatatctgagggagtagccctcactcctcatcagcactgggaaagccaagagaacttttctctgggccactgggtgacccacttagagaatagtaaaaggctgtcattgagagcctaccatgccctgggcactgccttagtcccttgggctgctacaacaaaatacctaaactgggtatcttataaacaaacaaacaaaaaatttacttctcatggttgtggaggctggcaagtccaagaccaaggtgccagcagattcggtgtctggtgagggcctgctctctggctcatagatggcaccttctagctatatccccacatggcagacaggacctggggcttatatcagacctcttttataaaggcactaatctcacctgtgagggcttcaaaggccccacctcccaataccatcaccttggggattaggatttcaacatgtgaatttgaggaggatgcagacattcagaccatggtagacactttgtacagatttcctcatttattctgaagagcacactttagggggtaaatattacccattttacagaggagaaaactgaattgctcaaagaattaaagtgtcatttagtaaatcctggagcagccttcatctgaacctaagtgagcctgatagcacagaccttgatctttctactgtctcatgttgccttctcggagtgaagtttctatttgcgacctaatcaccctccccacccatttcacactccttctcccagatccttccgtagagggaatgagggcagaggatatgggcttgaatcaaggtctaaccaaagggtgtgggagaagagttcttcagactaggttaaagggaggaaaggaacatgggcttaggtgcccagtaagttatgccagcctgacttttgtacttagacctctattgtctcaggataagaatatattgccctgtgaacaaaacttaacatttttgcatttgttttgcttacttacattttgcttctcaatgcctaggttaaaatgttgactcaccttagctgaattagagaagaggagagaattgtggggtagcatcagcaagaaggagatgggggagagcctgccatcagggaggctcctccctgggtgtgggagggaagcgcaggcatggcgcgcccctgagcactaacacccatgctcctttgcaggctccgtacttctggccttcgaactgctgggaacctgaaaacactgactatggtgagaactgaagccactgggaactctcaacttcaacactgtgtgtcacttctgggggtgcagaagacaaatgcttggtgtgggccatggtggtacatggggaggagggtcctttctgcttagtcctttctcatattgttgctatataacaaatctcctgttccacataacagaggaaggcccagcttactgaaagatgtagtccttggaggggaagcaggagagggaagaaaaatcttatcaagggtggtcagtatgttcatcttggggccatggagaaccaggatcccacagcaacactatcagatggtgacttttaattgttctttccagggatagggcttcagggagggctggatcaaggggctacctcctcctggccctttctgttctcatagacttgtcaaaacttactaagaaccttttggtgttcttgacagttgcaatttagaaaagagacagagaccagggaggagtatacagaagtcactctggactaggaaaatagagtgggtgaagttgagagttctgtctctctagacagggacctacaagacttctgccagatattctcagtggagattatttaatattcctatatgccaattctctgaagaagttttattatcgctatgcttaagagaaagaacctgaggcccagaggggccacaccctcacactaccacattgtctgaatgctcccttgattataagcctcttgagggcagaggctggtccagcttatgcattctcatatctccagggcatagcctatgtctgaggcagaattagtgctcagtaaatatccactgacagttctggttctttattgaaggtgaccaacagacactcactagagggagcagaacttgaactcagatctgagtggctccaaaacccatacttctttcacggtcccatgtgtgacatgcctgaaggttgtagctgcagcactgcccctttgcatgcatccttgctgctgactcagctgctgtggcagtctcatctgtggctctccttgggactgggacactcaatgagacctgcagcttctttgcagaattgtttaagacaagaaggcagatgcagctgtggtgagtgggagggagatgtgcagctgggtggtgatcaggggagcctgtctgggagacccatgggataagatacaaccttggagtcacacgtttgagcaagaggaaaccaacaacagggagccaagctgaggatggaatacaagcgagttgtacctactaaggctggagttgttccatggtcaagtgtggaggacgtcagtcatgcagaagggcaggctctggggctgtctgcttggctatccacaggcaccactgtgggccctctgacactgtgctgcaccctaaccaatgtgataagtggatccaggaagacttccgactgcaagtgagagctgcatttgaccgctcataaaactagtgcttctggggctgaaaagactgctcatgaaagcccaactcagaatttgaataattatagctcagttccatgcagcaacgtgtgcccttgtgaatgtgaaaaccagtatttttccaggcagtggagagggtgggaggatggtaagaccagatacctgggcccaagtaagattaaaatatttacttccgtaaagcttagggcatcttatgctgcatactaaagggcatcatctccctgttctacaggtgttcttcattttataattttaattgtgcatcatgaacagggagagaaataatagtttgtttcaggctctcattaaacaaaaattattttaaattcctgtgcctcaatttatggcaaatcagagggagaaatcaaggttcaggatgcacaagtgttcaccagggaccaggcatggtggtgcatacctgtaatcccagtgactcgggaggctgagatgggaggatcacttgagcccaggagttcaaagctgcagtgagctatgattgtgccactgccctccagcctgggtgatagaggaagaccctgtctctaaaacaaagaaaaaccagtactccccagggtttccaaagcagtttagttagaaaatcaggatgtatttatgaagagagaatccagcacaatgagcccccaggatcaacccgttccactagctgggtgatcttggcaaattacttaacctctctgtgcctcagagacctcatattaaaattagagtagtaatggcacttgtctcctagtgttttgttaggattaaatgaaatgcatgtaaggttctctgagttaatacggagtggtggttggtatcactactggggtggggtcggtattattgccactgggatgttggttgatattattatgactgaggtgaccgtctcaccaggaagcatgtgaaactgaagctaagaattcaatatagtatgatttggactgatgaagtaccagaaactttcattcaattgacaaacgtttactggtccctactctgtcaaattctatgtcagagatttgaataagtcacagcctttccccgcaagcattccaggctgggagaggcagcatgatgcagggaagaaaggcatggtgaggatctggcttgagtattcaaaggttttatgtgatgaatgactgagaaggctgaatagcttgggaggggcaggtttataaaaaggccttggcagtcaagtagagacatttagaatggattcagcagtttggggaagctattgtgggtccccaacaatgaacacactttcccaagttttttccctacttgggaaaaaattggttcatctataagatgggggtaataacagaacccacctagtagggttattatgaggattaagtggactgtggaagattaagtaagggctgtgacttagtcaaatagttcctgatattcagtgggctcaatggaagcagtagctgctacgatggtgatttttccagcacctaaaacggtacttggcccataggagacactcagtacatttttgaatgagtgactgaatgaataaatggatcggtgaatgtcatagaggaaactctgcactggtcctcgattctaattccatctccatcactaactagcccttgggtccatcacttcatttctctgggcctttagtttccccatctgtaaatgaggggcctgtacttgatggttgccaaggttacctccagtctaaaattctttggttctaaaaagtcatcagaaagtatgaggaaaatagagaaataagtgagttataggttccctagtttaggagattgaggtacataatgatgttgctagtaaaggcagaaagtaaagaaaggggtcagtttcttcagtacattgaaactcgataagctcaatattttttaagaaatttaattgcacatataatacatgaatgtgttccctttatacaatttttaaatatgtcccagttttgtgtggtgacacatggtgaacttgagatggcagtggatttctctgagtgagatgtgagatataggtaagggtggaatgccagatgtaaggacaaggaaatagaaatttttcggtaagaaattaaatatccaagagaaaccaatatctgagcttaagacagttcttccagatgccctcttgtagggctggctattgtcaccagtagtcactagagtcggttggaagttagagcaagccctagtgagggcactctgggatgcagacaagccccagggagttctgtgccaagaacagccacatcccaccttcctcattgtggtgaaaagattccttgtgtgactttaggcacagggacattagctagtagcatgtgaccctgtgactcatggccatcaggagtggccccagctctgcattccatgcatgataactcacttcacaaccccgctgtcccattttgaccccgcttacccatttggacatttcttgggatgactctgcctgcataaaacccacagtcaaatccaggttagccttttctgagttttacatttggccagtgcaaaatcctgtccagggcagcattgtcaaagcagctgccacctccactgacctgcactgctcaaaggtaatcatgacctggcccagtcgagctggtgacatgtcaagcttcctgcctgaggttgtccctaattctgccaggggtccaagagactgaaggaggtactttgtgatagatcggacacccctttatcagacacagtgaagcactatagctgcttggttcattggaaaagttggtaagtagaaaatcatttttaaaacgacatatgcacaccttaagcacctcatgtaaaggtaagatatacaaaggaacactcatttgacagccttgtgaagtaggaccaaagtgttctctttgattatgagctgaataattttagtttcttaaatcaaccgcactcaaaataaactaccctgttttggtatctttaaagtgcatcaagaatgtaaagacatttttgtagtcttttgtatattggcccctcctagatttttattatttttcttactttttcctgttatctcacctgtatcaaattcaccagcaattgccttagctaactctccttcattaaattgttccaaaccattcaactgagttttcatagaagcaacactctctctcttttcacattaatttcattgagacgtgtgatatttagtgaacttgtgtgattaaaataacagatgtgcctgatataagcagatttgggaacaaccacaactgactcctatgagcacacaattcgccgggtggaagcagaagtgtgggcataccagagggtaggctgctagcttccaggctccaaaatgtcataggtatcagtaaatttttcagaacaaatgaaggaagttggttgatccagcaaagagttgactagagatctcttagtaaagagatcttgttgtccaacaacaaaatgatcacaggttctctctggccctccctcttgatcattctgttgttcatttatttatgccattcatctactgttttccctggattgttccacttggctctggagaaggaggaagacattgaagaaggaaaggtagggagaagaagtgatgatgaaggccatgtttgaggaagaaacagggaaaccaggggccaagaacctttccttagcctgagttgagagacctaaattgtcttccctttccatagcctttttactgcacctgacaagacaggctatggtgctagcaacagggatgaaagctgagcaggacatagcctctgcccttaaagagacttcagcctagagcaggggacagtctagtaaatacaggatttcagtgcaatggaatttagttccatggtcaaggacatgtagatgctatctgaaacaccaacttgggtcttcaaagattagtaagaggttgccagatagagggaaggagagaagagagaaagactttcctcaaaaaggacacatatgcaaaagaatgaagctgaaaagagtttggtggcctcacagtgcctgcatgagggagaagaagttgatgagataagcagtgagcagatcataaagaaccatatttgccatcctaacgagcccaaccttacttctgaggccattgaggactccaggcagagcttttaggcactggagtaatgtggtcatgtttgtgaaatatcactctgagtgtaggatgttcagggtgaagcagagtgaggaggaagaaggggagttgtcaggattggaatatggaggagtcctcatttgatcatgactatgaaaggatttatagaggtcaggggtcatgaggtccacttagaaaacatatttttcccaggacagtgctcatgaggtccacttagaaaacatatttttcccaggacagtgctgggcacatagcaagggtgggtgggcgggctgtctggatggatggatggatggatggatggatggatggatggatggatggatggttgggtggatgggtggatgggtggatggatggatggatggatggatggatggatggatgggtgaatgggtgaatggatggacagatggatggatgggcttataattccattgtgctgctggttttgtacatgttgtcatttcctttcttccctcagccatctatctctgtaagaggacaatgcaaaataaagcaaggctggaactggcagattatgaagcagtaagtatgattattttccaggatacatataagaagagagtaaaatcatatctgcagctccgtctaagtttattttttttttcttttgtcccccttttgtccctttcagacagtggaagggaagtatcttctatttctcctcccttgttctcagctcctctgaccatcacaataagatggtgtttttacataaataactcttaaaactcaacaataaaaaaataagcagctcaacttaaaaataggctaatgacttaacagatattttaccaaagaggacacaaggatgataaataaacccatgaaaagatgtccaatattattagccatttaggaaatgcagattaaatccgtggtgagatactgttacatacctattagaatggccaaaataaaaaatactgatgataccaagtgatggtgaggaagtagaacaactggaactctccgctttgctagtggtaatgcaaaatggtacagccactctagaaaatagcttggcagtttcttataaagttaaacatacacttaccatataaccaagcaatcccacttgtatatacataccctagagaaatcagaactcatgttcacacaaacacctataaactaatgttcatacaagcttaatctgtgataaccaaaagctgaaaacaacccaaatgcactttaacagttgaatggttaaactaactgtggtacatccatacaatagaatactactatgcagtaaaaaggaatgaactgttgatacacacaaccacttgaatgagtaccaagaacattatgttgggtgaaagaaaccaatctcaggccagccattccatttataggacattcttgaaaagataaaactatcatgatgaaaagcagatcaatgattgctagtggttatggatggggtagggaattgttggaaggtgatggaactgttctgtatcctgatcgtggtggtggttgtatgaatctatacatgtgttaaaatttacagacttgtacaaaaggaaaaaagtcaaatttactacataataacatttcaaattaaaattttaaattgcacctttatacccactctcctgtgcttagtagcagaggcagaatctaagggtaaaattcaattcagaaaataagacaagatgtgtgtcacatgaggtatctacttcccagctttcttaccttccttctctatctttcttcataagatgagacttcttgcaaaaattagaggccccaccaccaaacttgggtccattcccatttgacagagcccagaaaccaaagcacttgaaaactcatagatcatttaattttttttttaacttttggttgcaaaatttttcccccaaactgaactttacatgggtcacagagaatgggagaaactggctaaactttcttataccttctacttccctctccctatatgtcttccaaaggatgtgctgctgagccatgaatgactgaagggccagcagctatggaaggaggggcaacattaaggggagcagagaatccttccctggatagtccagcattaacagcatcttcagacccacccaccgccaaagcccttcctgcttttactgcctcagtctttcaaaacaagtgtgaggccccactctgccaggccttacctctcctaggttcatgttcccaagcctaccaagcctaccaagcctaccaagccagctgggccatcgctcccctctctacagcccaagtgtgaatgcgcatgccattggggagcaggacgtgtgcatggtccttcacctctttgatcccactggcattgtggacctgtgaatggggtgcagggggccagaagaggaagaagcagtgcagcagtttgtccagagccctcaggacctggctagagtttgcattatcagatgatcatatgttggaatattatgatctccccagataaaccttggcctggttgttctgtggctctggacatcctgggagcccagtcatgcccctgtctgccccaatgcccagcaatcacagcacccctccttcaaaagactgctgttgtactctttgtgcgcccagtgcaagtagctttgacatgatgacattacctccttaacacaaccttgaggaaaggcccagacagtagaagcctggggcccctccctcctgtgtgtctcttccccatattttcaatgttttggaaaaaggtcccatacagaaatcagacagcatcaactcctgctgtatttgattcaatttctcttctcttgtcccttaatgttctgctctggtatttgtaaagaatatggcattgaggccaggtatggtggctcatgcctgtaatccccaaggtgggcagatcacgaggtcaggagatcgagaccatcctggctaacatgctgaaacccgtctctactaaaaatacaaaaaattagccaggcctagtggcacacgcctgtagatccagctactcaggaggctgaggcaggagaatcccttgaacctgggaggcggaggttgtgagccaagatcgtgccactgcactccagcctgggcaacagagcgagactccgtctcaaaaaaaaaaaaaagaatatggcattgagatgtgctctcaggttgaagttctgcacaaaaatgattcaaaaccaaaaaagcattttgcttccaaaatgcaataatttttttatgaattttctgattacatattctttttacaaaaacaaaaattcaaacagcaaagaaaggagagaatataacctgtgactccccctcacctaagttttttctatgcatacatttttttctttacaaaactatatcagaatcataacataaacattcttgtggcagctgcttctctttccccagtcattatactgtaggtatctcggggtctttaccatgtcagtaactataatctacgttattgtgtttaatggctgcctagaattctatgctatgactgtgtcacagttgattgacatttaggcattaccagttttgcttcctatgagcagtggaagagtcacaaagacagtttttagaagtactttcacaccaagcctgggtgataactgtgagctcatgtgtggtactctccaactgaagctccttttatattaataatccattaatgagggtaatcaattcgtgttggcatgagctctatgaaaatacatagcataatatgggctccggccttgcattcatcagaattaggaggatcattagggcgcctgtcaaactcccctcctcgccgcccatcctcatgttccattaggtaactctacagacttagagaaaatacttttctttttctctaacggcagccctcaatgacttttctttctgttttgggctttttctttcatgaacatcacaaacgtagacactccgtttggggcacttttttttttttttttgaaacagtttcattcttgttgcccaggctgcagtgcagtggcaggatctcggctcactgcaacctccccacctcccgggttcaagcgactctcctccctcagtctcccaaatagttgggattacaggcacctgccaccatgcccagctaatttctgtaattttagtagagatggggtttcaccctgttgaccaggctggtctggaactcctgacctcaggtgatccacctgccttggccttccaaaatgctgcgattacaggtgtgagtcaccacactcagcctcggccactttgaatcctgacattagaaaaagcatgaaagccaggtccctttggttttcctttcctgtgtccttcccagctccccactggaagaggagtcctgagaaatccagcctttggttttgctcctggagataccagcaggtggcaaagactcgttaattccccaataaccacagacaattttcccgattttcagcaacctttgaaacaagtgctgtgtgagttgcattcttgtaaaacaccttcatgaagagaggaatcaggtgaaccatagagacttcagacttaatgggtgtgtaaatgaatattaatagttcagctctgtacggagggtctggcgcaaagtcaaatgggatacatgtccaggggatttaaagcaggtcttgctattttgttggaagtaaccaaaattgatggatgccttataataagcataggtgtcgatgtgctaatttacgatgattaatgccgccttgttgattttcatttctcattaggaaaacttagcaagactccagagggcctttgcgaggaagtgggaattcatctttatgcaagcagaagcacaagtaaagtaggtgaacttgatagagaccttttcagagaggaaaagactctggaatttggaaatggtgtgaaggtgggattgtcaaagtgaagtttccagatggcgttagtatttctaatagggcctgagagcaactgagtagaaattaaagtcaggatggataagttttgtcttcataatcaatgcttctctaaagcaatttcagaaatgtgtgtttcagcagacaagggagatcctcccaaaggtagaactctggttataagaaggtgtacctatttccccaagagatttccagttattttctgtgttcaaaggctgaaatcccattttacccgttggactggagattttgtcttcatgggaaaacaggttggagttttaggaagaacaacaagtagcccctgtcttcttttccctgacaggggaggagtttagaaccaacagaaaaagaaggcacagaagtcagacagttggagtccaaaatatcagattattacattaattaaaagcaagagtaaggctgggcatggtggctcatgcctgtaatcccagcactttgtgagaccgaggtgggggtggatcacctgaggtcaggagttcgagaccaacctgactaacatggtgaaaccccgtctctactaaaaatacaaaattagctgggcatagtggtacatgcctgtaatcccagctactcaggaggctgaggcaggagaattgcttgaacccgggaagtggaggttgcagtgagctgagatcgtgacattgcactccagcctgggcaacaagagcaaaactccctctcaaaaaaaaaaaaaaaaaacaagattatagggcgtgacactggatatgtggccccaggtgaaaattaaatctgcccttcctgtacagaggtgtgtatctataggcctcctctccccagcatctccaccccaccccaccagggcataggtgacccctgtaagttttctgcatgcagagagcagctatcctgagcacaggctgacccagatgggggcccagagagggagagtctgaacttcttcaatttcttctttcaagtctaccaattagttaagtcatttttcctccacaaaggacaagagatgaaaggaagaaaaaagttggaagggtttttcccagatttttttctcctggatacatagtggacatttcttcctctctaaggaaacatgaggaatgggtactctatgttccccaccccacaaacatcgttgtcaaccagatccatttaattctgggaaacagaatgattggatctggatctcccctgtccctcccagggatgatgtctaggttagccaggatggttagttaacaggagaagtgggacaggagcaggaaagggatgctaagctgggagaatgggactatgtttcctctgggtaccacctgcatgtgagcagccgctgagtcttcagagcaacattcctgggcgatgttgcagcccgtggcctggagccgggtctcaggctgtgtgggtgtagactcatcacagctatggtcacagttggaagtgacctgaggccatctggtccagtggcctgtacactgccattgctgtgaacctccccccacagtctctgcctttctcctgtccatgatgccagccacctcctgaccacccagcagccccccggggataggcgggtaccaggcactgggtgcccccgaagaggtgcaggtgggagagtaggtaggatggaggctgggattcaactggactaaggcagaattatgcctgtgtactcagaagccactggaaagcaaagaggaacgctaatttgttcttccagaatcaaacagcatcacaagttataaacagaggggaaattgttacttcataaatacatggtatttctcgattaacttttttgattaactctgtgattacattataattgtgggccacctaagtacacagtaattatcacaaaaatcgcagggtgattatgggtttatttcagtccagtaaagtaaagcgttcccgagagagccgagacctaggagttacacggcaattaatctgagttgctttttacttgaaataaaatgaagtaatacatgcttttttaagaaaaaaaaaaaaagaaagaaaaagaaaaaacctcttatctatgctgcagatcagaacaataagaatctgtctttgtcacctgcaatttccctcttgcaatttgtgcctcccccagctgaggccagtgatatttgcctcctggatcttgtctcattctagggccattattctgcctttagaaagccagatggtgtaagtgacttataaaacacataattgcagcattttaaagacatttatttctactgattctaaatctaaagcaaactttcaaatttgaacatggaacactggcaagatggtggttacattccatcttataatttgtatatgcagtatcctttttgataagggggcatatcaatggataattcagtttttaataatccaaatcttaatacttcagatgaacagctgcattcttattcttcccttaggccaccatgttcattacacatgtatggcaatctgtaatctagcctaaaacaagttctcttaccatgtgtggaattcctgaggttttcggggggggaattatacacccctatttcacagctctgcagagagcaggcaccatgcaggtaccaatggccttgtgttcacttagcccctagcaacaggagcaaacgctggagcaagtgtcagaagggaaaacagaatacagagcttcttatttccttcctctctttactctttcaggattgaccggaaaaaagacaagacagaaaggaaaattttggatagtcaagaacgagccttttgggatgtccacaggcctgtggtgagaaagcgctactcaattctctagatttttttttcttaattgttcatttttatctctataaagaaaagaccgtctttagccaccaggtgtctcattcttaagaaaatcgctcagctttgtggaactggtttcgccattcatttatataatctcagtaaattttctggaatatatgtaagttccaccttttaaaaattattcattcggccgggcatggcggctcacgcctgtaatcccagcgctttgggaggccgaggtgggtggatcacgaggtcagtcgatcaagaccatcctggctaacacggtgaaaccccgtcgctactaaaaatacaaaaaaattagccgggcgtggtggcaggcacctgtagtcccagcgactcgggaggctgaggcaggagaatggtgtgaacccgggaggcggagcttgcagtgagccgagagcgcaccactgcactccagcctcggcaacagagcgagactccatctctggggaaaaaaaaaattattcattcctgaaaatatggaattgcaaatggagaagctatgggaattccaccaaaagacctttgtgtcccgaaggtttacattccccaaattaacaatttccatttccactgctattcaactctgaatcttcaactattctctgtcgaatacggttaattcttgttatccatggcagttatgttctataaagtctttgcaaacactgaattagcgcacattgaagcatcactcccgtgggaactaccaagctaggtccccgtgagcctgtggccacaacatttttatcagctgatcgatacataaccttttaaatgtgtttctgtataaagacagcttatgtaatatatatcattgattcattaacattaaactcatggccaacagcactgttgctcatgcctgcatgtttatttcctcctaaggcacatcagagaatggtgaacagcacttcagcactgtccttggggccattttaaacagcaaaatcaccaacaaaaagtacagaaatgcagaaaagttggcactaaattagccctaaatagaagggtctgaaacaaaaaggcaggacgtcaccttgttcaatttcagtgggaaacacacatatcaggctactcaaggtacaactactgagtaaggagttataaatgaaatttagcaagcaggcaaattcacaaatgcaaaatttgtaaataatgaggtttgactgtatttctgatttcacgttattaaaacaaatcttgcattttcctcatgaaatggaactaaaaaataaattattggtcttcttaaaatttgattaaaagcaaaaaataaataaatagctactcatcctgatatcgtggagtctttttcaaacggttaagtatgtaaaaaaaaattttaaggactgtgtctgaggcaatcttgccacttaaatagctaatttgctcttagaaactgtacactataccctctacatatcatccttagattatgaggtaagcttttctagatcgtatgggaactccacagaggaatgcatattatggcaaaatggaaaaaaaaatcatgcattgtctgtaatggaaaaagataaagattggtcctgatggtgtgacatgggctaaattggaagtgtaattttcacgtagtaatttatatgatgtgttttttttttctcagccaggctgtgtgaacacaacagaaatggatatccgaaaatgtcgacgtttgaagaatccacaaaaggttaaaaaggttcgctagtttagctgagttaaaaattcctgatgtgaatagcccttccagttctagtactattcaaatagtaatttgctacttgtaattctaccaccttttgtcatttgaaaccataaccatttcacaaatattgattgagcagctgatgcatgcttggcgctgtgctcgtgctaggatacagtggcaggtcctcatggagcccacagcctggcaggagtaaaacaagccaacaggcaacagggccatgaatgctgtgttaggagaggtacaggacagttgaggagcccaggaggggcagctaagccagacctggagtgggtgggggtggggggcttcccaagggcttcctgaaagagggtcaggtgttctgaagggtaagttgcagttgtcctggggaggtggcagggaggggaggaaacaaaaggagcaagaagtggcaaagctcacaggtgaaagcaagctttatacttagaagcaaataaaagtcttttttatggtttttttttttttttttttttttggatagagctggatcacccaaactcaaaccaccatcttgtccaactgtgaatgacccagtggtcacttgtgtttcactttactcaaaggagtagtggtcacagcatacccgagggtgccatgctcagactcccccacgattcatatgtcccaccctctccacagcaccagggacaatattgcaggacagcatgaccagactccgtaatattaatttccaaagagtgggccaggtacggtggctcacacttgtaatcccaacacttgggaggccgaggtgggcggatcacctgaggtcgggagttcaagaccagcttgaccaacatggagaaaccccgtctctactaaaaatacacaattagctgggcacagtggtgcatacctgtaatcccagcttcttgggaggctgaggcaggagaatcgcttgaacccaggaggcagaggttgcagtgagcagagatcgcgccattgtactccagcctgggcaacaagagcgagactccatctcaaaaaaaaattccaaagagtggagatgtgtccccaaacattcctatttcttgtgatgaccaattagctctctctcatgtatgcattaaaaaaaaatacacgcacacacacacacacacacacactagacatggcgtatgtatataaacttctttaatctacttacatattttgttcgtcactgacttaacaatatccactgtattatattttaaaatgttagtcctaaaatgtcctcatttcatcttcaagagccccataattctaacattacagaatttcatggagtcacatccaccttatctgagcccttctgcattttgatgattttgactacacattgcatgcccttcagtgtttcatttctttcccattgcaaagattgtgtttagtctttccgtaatacgaggaacagctttaaatgtagctatagctacggacatgtggaaaaacttaggccagaaaactgtttaacttgaaagggaaaccctgaaatgctgccatcccagttttgtaccagatgggaatctgctgaccaacggaaatgtagaggggatcttttgtgcatactctttggcagtggctcttgaactttctttattcagaatcatttggggcatttgataaaagtgcagatttccaaacccacccacaaagattctgatgcagtaagtccagggggcgaggggatactcagcaacgtgtcttttccaagcacacccaggtgattctttgcaggtggtctatggaccatatttggagaaacactgagatacaaggaggctattttcagcccaataaaagataggatttgggttatagtggtaccccaaagatgagatgacatgccttaagaggcagcattctcatcattgaagaaataaaagcagagaccaatctcttattgtcatgaggggattcacgaaattggatgagtcattggactagctgacccctaagccaccctccaattctgtgggtggatgatcctctgtgcttgcttcttctcctagtccgtgtatggcgtgactgaagagtcccaggcacagagcccggtgcatgtactcagccaaccaatcaggaaaacaacaaaagaggacatccggaaacaggtgaatgaattgacagcttgcactctcaggaggagacgtggccagtttaaaaaccctttcaaatgttcaactctgaagattgagcaagctttgagttcctggaaaccacagtggaacccagctgtgggtgattgaaccttttaagtgctgtgtgtgaacaagccacggaagcttgagagaaagaattctctacccagttcctccagcagttactagaaaagggcgtaaatgagtcatcccatgccttggggtaactgctgtaatggggtttcccacagtccgctgtgggagctggaggaaggagggggctcatgtcacacagtccttataattggaatgcaccagctcaggatggtctactttattgctgtgatttgaaaggaaagtttaagaataaataaagctctactcccaatgccatttcagcattacttggttgaatgttattttctttcatgatgagcagcccaggtcaacagacaatggctaattatattacttccttctgatatttactggtaacaaagcaacctactgtttatattatgccttgctggttcctagagggcaaaacccaaaggagtaaactttgaggtgcttgcccttgacaagtttattatctgatgggtaagaggtaatggatatatgaaaaaaaaaagctatttggcggggctcggggctcggtggcccacacctgtaatcccagcactttgtgaggctgaggcaggtggatcatctgaggtaaggagtttgagaccaggctgaccaatatgatgaaaccccatctctactaaaaatagaaaaaagttagccgggcttggtggcgtgtgactataatcccagctactcgggaggctgagacagcagaatcacttgaatctgagaggtggaggttgcagtgagctgagatcatgccgctgcactccagcctaggcaacagaatgagactctgtctcaaaaaaaaaaaagaaaaaaagaaaaaaaaaccacacagaaaaaaagctatttgatgattccagtcaagcatgccaaggacatgggtgtgacgtgcctgtgaaaggtgggcagaggaggggtcactggggattgttcaaaacaggtatttatggggcacatttcacctgtccatgctgttgctaagctacgtagaaaatacattgcctttaaattttggaaagcaagacttaaatcacaccacagtataggaggagatgagacaaaggctaaattgcagaatatgaatcttgtatgatagggatgtccagaggcacaagtaatttgctggagggcagagctgagggagttggagatgtctggccagaggaggtatttggatcttggtggaaatgcaggatttgggtttgtggagcgaggggaaaaaaataattttagtttggtcttaacatctgtgttctctattttcccagataacatttttgaacgcacagatcgacagacattgtttgaaaatgtccaaagtggctgaaaggtatgttttcctttaataatattactactttcttctaatttaacagggaagaaatgttacagggttatggttaacgaatgtgttcaatgccaagagttagactgtagttattccttagactggggtgcagaaaaacccacaggctccatgtgagtataactaagataacagacctcccttgagtgatgtcaagaaatgttccgttgctaaggctttacagggggtggccacgggaccttgtcaatcaaggaagaatgtcctttaaagctacataatgcacctttgccttcagcctctggattaattcaaatggaaattgctcccctttcagctataaaatgcccagattcactttataggggaaaagaaattatgtgtgtcctttgaggtgctggctgcatagacaggaggggactggatcatcgggaagtgttccgcctccacacgccatcaaccactgaactgcatcgaatcagctgtaaagaaaatatttggcccctccagcctggcttccacagcggtgtgtgtgcttcattctgcaccagtagctagttccactccgttaactcatgggagactcaattttatcaactaaatggtctgtttttttaactcttccgtgaagatgggagaccacatggggaatctatatggaataaatctaaccaggcagctcagtagtgaacatttattcatccatatgctaccgttaaagcaatgaccaattgcttaaggaatcaagagcttaagttgggtcttggtatttattggatgtcagataaactgagtcttttaagcccagctcctacagggggctggctgtgagagccatctataagcctgtaagcctttctctgctggctcctgggttgattcacatcttttttctagataaattacaacaaatggaaggtataaaaactccaaccccaaacaaagagtctgattgaataccctaccttcaggggctaaggacatccctggacttgggctcacgtctttattccagggtttctcgattgtggcactagtgacattctgagccagataattccttgttgtgttcttaatgtcctatgaattataggatagttagcagcattcctgacctctccccattagaggccagtagtcccccaccaccacagctgtgagaaccaaaaatgtctccagacattgccaaatgtcccctgggtggggtgaaagtcactcccattgagaatgactgacactcctgctttttctatgcaaatgtgctggaaagttgccctggctggagctcagcttacactgaggtactgatcactctggagtcgctgtttcagctagctgtgtaggctgcagaatcacctcatacctcctctctcatcatgtgtggcttctggccagagtaccaggctctgaaaatgctttttaggtctcactgtggttcctttgccccagaaaggtggctgtgagtgaaacagcagcatggcctcaactctcttggtgtcatccatggcctgtgaggaaccacgagcttctttctctgtgaactagggacagaaatggctgtcctagtatactttgagggtcggtgtgctagcaatgctcatgtctggccttggaaggtggaagagctctttagggtttgcaatttagaaagagcgtatatatgggagcatctgtttctttggatctatttgctcaggtccagtggttctaagtaccgtaatccaggtgagggagggggttaaaaaatggaaattcccaagcctcagccctagggattcagattcagtggttccagggttgagccaagaaatccacattctggataatcttcaagtggactgatctggtctttcaggatccggtgaagccattgcctgctactcaggctgacctgagagctcacatccaatttgttatatctttgggatgcagagaaagagcctgaacctgtcagcatgagggaggcagactccagggcaggtgtgcagagagtccaaggaatggaggaaaccaaggtggaggcggggagcccggcccatcctattgtttgtttgtttccttgctgtcagggaggggccccacctggtaccacctaattatgcttgagaggctgctcatattgaaggattattccaactggctactcctcggtgcccagctagaagctttcatgagtctctgcccggcagaggctggattttattcccagcagcaataactggcaacttttcaatgcgacacgagggtttttcattagagccacaaggaaacccccagataaggaggaggagggaaaggagacgcgtgttagctggagataaagcagctgggagccgggcctgtcagtggctctgtgaagatggggccagggaggaggtgctggcagctggtgagaagctgccagagatgcaggctgagctctctcaggtgggcacgcacatccacatccacatccccatcctgatctggcttccctgggcctgctccaggtgataagtggcaattccatatcccccaggaaaccgcatcccccaggaaaggtcttcatcatttttcacccagttctgtgagaactaatagtgaggagaggcaggagggctggggacagcgaggctgggctctgggatgtctacagtcagggttggactaaagggtgcatccagaccagcagggagggaaaaagggaactttgcaaactaaaggggcagaacagacagtttaggggatgggtctgaaaccgaccatcgaggtttgaaacctacccctgccatttcctgttttctaactgatgaagccagtggcttcttctctcggtgcctgtttttacctctttagaggggagatagtagttgtatttaaattataggattaatgagttcatgcatggcaaaagtatggtccagtccttgggactcagtctgcacactgggaatgtgaataataattattttccagcatgacacttaacttgtgctttggaagagagcagaattcaaggccatgagacagaatgaactggatatatggtgcttaaaggagcaaacaaagggcaggccaaggagggaggctgctaatgcaattctttcctgcaccctctgtctccccccagtctcccacacagagatctctgcaggctgcccaaggctgaccttgcactgcatgtctccttccactgcctcacacgccatcactaatctggggctttgcgggagaaaagacttgctcttctgcacagaatttctcagatcatcccagttccaaatattctgtccattgtcttcctgagtgcttaagtgtccccaaaatgccagcatcgtggcaaccaaactgcatttcctaggctgccttttgcacctggaagcaacacaaaaggctttctgagctgttacccaatttttgttgcagaatgtattgtctctgcacacacacacatgagtgtctcagataaatgacacttaacaccctaagctttttattttaactttttttttttttttttttttgagacggagtcttgctttgttgcccaggctggagtgcagtggtgcaatctcggctcactgcaagctccgcctcccgggttcacaccattctcctgcctcagcctcctcagtagctgggattacaggcacctgccaccaagcctggctaatttttttgtattttttagtagagacatggtttcaccatgttagtcaggatggtctcgatctcctgacgtcgtgatccgcccgcctcggcctcccaaagtgctgggattacaggcatgagccaccgctcccggcctattttaactattttttaatggcagtgtttcttaaatatggttcatccactttacttcctaataaaaggacactacatttcagttaattttgctagatgactcaagagtcagtagtcttctattatgctttaaaactgtcagtggtcaggatcttataaggtgccctgcttccccttccctaaatggccccagataataatattctttgaattcctgtttctgccttttagttgtctgtctgtctgctttctctactaacccttccccccaacacccaacccctgctttccaatctgtagcataccatgtgtatcagttagctgtcactgagtaacaaaacaccccaaaactcagtggcttaaaaaataggcttttactattgctcacatgtctatgtgccacctggctccactggtctcagccatgtttctctatgtggctatgggttggcgaggcagctctgctgatcttggctgggctctctcacatgtttggcttctgctggtttaggatggcctcagctgggacagttgagcactccttaatatggtctctcaccctccagcagactagtttgaccttttccacatggggatagtgggattccaagagagagaacagaagcatgcaaaactcttgcagattagaactggcattctgtcgcttctgttaccttttattggctaaaacaagtcactaagctggactagattcaagggcagaagaaatagactccttttttgaaactgaactaccacaccaggaaatcaaataaccaaattgattagctttgatcctaaagcaagtgtgaaaagtcttttttgtgaggtgtgttgttcccgataacaatgaaccttgaggcatggtgtttatttcatctgtagactatgcagaggctcttatgctcacttatctcatttgtgttctctggatacttgaagttgccagataaacaaggtcctactcttctctgcaagcgtccccaagggagtccctttttttattcatctaagccttatagcacttgacaaaccaactttgagaagcaacactccatgcattttagtcccaaactgtctagtctccatgtttggctgcgattccccagagacttctcccgacccatagcgagcttacaccacaatcactgcagctatcccagtgcactgctgcacacagagggatcaaaatgtttcattccgtacctgcatctgtacttggctcatcctcaccctattactgggagccattcgtgtgtcacagctgactgctgaattgattttttttagcatcatctcacttgcctgtatctgagattgccgctgctccctgaaattggatgctggttcttcctccacctcctgaccctcagtgatcatgaaatgtaattaatgaaatgagataagacagcaagggactggatacccctaagggtctattaaaaacctgctagggtgatagaggtttgggaacttaatgtctaattatagtttcaggggaggaaaaaagagggtcacagaagtcattacaactttgcttttatgggatttcagaaaccatggggtctttgctcctcctttctcctagcctgttctaggtgacagaaaaaaaaaaagaccggaggtatcattacagccagggtgactgtatctagaccaagatatggaatctgtagcatgtggaaaagaaggggcctccatacctggcctggtgtaagctcttcttcctgcagggctgaattcaccttcatgctccttcactcatcccaagtttctctattgaatgtgttttctctgggtgacttgcaattaaggagttctctttttatattttccctacttcccaccttctccaagtgaaaaaaaaaaagctagattaattaattaattgctaggaatcaaactttcttctttcctctccgcagtgctgctctgcttctcattttcctttctaatcagatccttcctgtcctggttctctgttgtgcatcacagttcagaaactgcatgtagcagagcgaggcgtgccagcatgctctcctcttcaccccctttaatattccaattccaggtcttctcatgtagaggctctgatttcataatgaatgctttagtgcatttgtactgtatttctaaagtaggactaatggtcgtatcccataatgctttagattccaggcctcgtttttgttggattttgtttgtttgtttgtttgttttcctggatagtagtttcccatagctgcaggccatacttcactgtccctttttcctggagcctagccatgtcagtatctcttcatcttctccccacctgctccatatatgtgtccttagctctagggattcctcctaggcattgcttaactcaggatggacagcatttcttcttcctccaacttgtcatagttttgtgtggtttttttttggtggggggcggtcacatctatacaatttgtagcaaaattataagtcttttgttaagagagaaaggataaaatctacaacttttatttttgtcatattttctcaagtggttggactgtatgtttactaaattctctttcattatttccttcccctccatgtttatcaaaggtagaccctaattagcaatctaaattgggaaggttttgcattaataactgtcctcctaccaggattggttactattgttagaagctgtgactttgctgttagctcagctctaacaactctctgagatccagagagctgtttgctatttaatggcatagtaggctctgaataatggctactaaatgactgaccacagagtgtacccctggtagccatctggtagattttttttttttttttttttttgccattactaaaggttcatggggcaggagtatgtgaacaaatagccagttccacatttccactcaagacccagttcaaagcccacgacaatggtgggtagcacatttgctaaaggttcacagatcagcatcttctagtgatgtgagaatttgtcatttgaaaataacaaaagcatataccaatcaggagtcagggataaagggacaagaatgctaaaattgctcattgagaaatattgttcctaatggacttctgaatttcctatatttattttatttcttccatctcatcccaattctgcttttctgccactcacacccagcggttggaggaccattgctgctgtgtactgttatatgctggacatcctacaaagctctttacatacctctattttcttctccctttttgcttctcctctcctacctctagtctttctgtggtcattggtattgactttggactgaaatggtactgtgcgttggccattgctgcctccttcattggcctgcctggccttctcattgtcttgtgtgtcccaagcagactctgttcatcttgtaatctgtacactaccaggaagcacatgttctgaaagagacaacctctctggctagttctacaaagggctgccttgatgaacttgccttcacactcccatcaccttcattcccttttcaactgtattggtttgattccaagcaataaaaccccagcttgaacctggttctgcaaaatagaagcatgccttggctcccagaatacaagaaggggctgtggaattgaaccctgggaaaggcagcaatgctactgagctcaggaaaagctggagccagggccttcagtgcctccaagacccattcttcctctctggtcctgcccactttccatgctgaccttattctctttcatgacagacatgtgttaggaaacatgacaccaccagcccttgaactttgtgactatacaactttgatatggtttggctgtatccccacccaaatctcatcttgaattgtagttcccataatccccacacgtgatgggagggacccagtgggaggtaattgaatcatgctggtgttttcccccatgctatgctcatgatagtaagttctcatgagacctgatggctttataaagggcttccccccttcattcagttctcattctccttcctgtcaccatgtgaagaaggacatgtttgcttccccttcccccatgattgtaagtttcctaggcctccccagccatgctgaaccatgagtcaattaaacctctttcctttataaattagccagtcttgggtatttcctcatagcagcaggagaatggactaatacaagcttctactgctgaagctggggaaagaagatatgaacctcacttgcgtcaggtatctgttcctggacaaatcaaccatggccaggagcagggcttataaataaatacatggcagctcctgaagtagccttgtgtacatgtcagagtacaattctcaggagacaagcagaagtgagcagaaacccatagaggccctctatgcctgctcacccattttggagtactcaccatccagaatccctatctgcttcactcagattcccaagagacccagcataagggtcaacccttgtacattcactgtattcctaggcagcacttctatctccatttggatctcctttcatgcctaagaaatggtgctggacagcctaggcacaaacccaaaagccttttaactctctgcattaagcttagatcttatcctatgtggccaaccttcatttctttcctgtgtcccaccttggaagctctagctaccaggcataaggcacctccagcccagactaaagagacaggagagcaaggaaagggtaaggagtccttgctttcatttcttgtgctgtttctgcacagtctgatgatgttgagaagcataagggaagaggagatcgccttccctctctgcccagcgtggggtgttctttcacctcctctcagtctttggctaccccagctgtgaagttaaccctctctgctactctctctgggaaggatcaccctcccctcccaccaagaagctgggagagcagttgaggcagcagactgctaaatgcccaggtcacccatgggaaactccaagatgcactttgctgtctcctgtcttttccatgcaatgatgatggcaaataggacaaatgagggtgcatagattcatgaacactgggtttatttgcgtgggttgtgatagtggcagcaaaataaaacatggcggtgccattatgcaccttttatctactgccacactctcctccaggtgactttattttctacatagataaatatagtaagaaatacataataatacatttattttttcacataaattgcagtcaaactacacctgtggtaggcagaataatgatctctcaaagatgtccatgttctaatccccagaacctgtgaataggttatgttacatggcaaggagaattcaggttgcaggtggacttaaggttgctaatcagttcaccttaaaatagagagattatcctggattgcccagatgggcccagcataatcacaggttcccggaaatgtggaagagagaggcagaagagtcggtgtcagagtgatgcagcatgagaaaaccatagctggctttgcagatggaagggggccacgagccaaggaatgcagggagcctctagaagctggaaaaaggcaagcaaatgaattcttccctagagcctccagaaggaacatcgccctgctgacaccttgattttagctcagtgagacccatttcagacttctgactcttagaattataagacaatacatttgtattgttttcagctgctaaatatgagataatctgttccagcagcccttagaaacaaatataaaaccccagtctctccccttctcatagaatctgaaggccaaattgttcatcctctttgtctttaatataccagcatctccgagcaccccgctgactaggagtgcctcttatagccccaatacgtgtatgtctcattctgatgattcaatacttccttttcccatcaataaaatacaacattcaaaatatgtatgcccatctaattttactgtttcctttacaaagcctctgactttatttatgtaacttaacaaaatagatttccctcttctaatacaataaatttcccttccgaccagtaccactcatctctgacactggccagcagattagttgctcgtaatgactttggctttgttgcctggttcaggttgtcaggactttctgtgttccttctccacgtgttcctctatagcatgtcttgacgcctcttgcctagaccttttttagagaaggcatgacatggcacaagctcccaggaacaatttcattcatgcttaatgcctgttgcaaagtcatattttttgctcttatgttgggtggtcacaaaaatctcaccttgggctctcaaccacattctcctaaaccaacatcaccatgagctctcaccacctctcttccacccacttctctaatgatattccaggatttttcttaaagagatctggctatgagcctgtatttcattacagcttaaataatcatattatttcccatttccttagttgctctctggacttttaagattctactgccttaggctggtcagcggacagctgccttcattgccatgcatatagtaataggcagctggagcctgcaggctcctcttgggaccaggtgctggctgaactctcaccacagcctctcctgagccttccctattgtcccctcagcccagcactcactcagggctccatatggggacttgtccacaggacctgacctggctggttggaccccacttcccaggttggagatgtgaccacatcgaggatctgctagaacacatttggggaggggtctgataaaaaccccagcctgtctcattgaaatctaaggaagcaagagggaggaggggaggacatttcatttttcaatccctatgttctacttcagggaaatctatttctggtcttaaaaaaaaattccccaataacgtaattaattaaaagaggtcctaccttttgccttgagctgccaagtggatgtcttttatttgagattcaaagctaactaaggctgagattattggaatggccagggcagatgtcctgggaggacaaagggggcccccccaccggctgtttgctcatctcagattttgagaatgccatggatgctgaaatgcctcataattgggagaaccccccaatatgtcatcgtgactcagatcctctggggcacctcagtacaactcgtcaccccctgaacaggatttcggttttctgctgctggcttgtctttgtgctgatctgagcaaaggagacaggtagcccagtgttctctctgtatccccacatccagcttgctctctcacattccctgtagtgggttgaatagtggagccccaaaagataggtcctaggccttacctgtgaaacctgtgaatgtgacctcctttgggaagagtctttgcagatgtaattcagttaaggatatctacataaatcattatggattatccagagactccaaatccaatgacaagtgtcctcataagacaaaaaagagagcggatgacacaggcacagaagaaagccatgtgaagacaaagacagagatgaaagtgatgcagccacaagccaaggcatgcctggagccaccagaaactggaaggaaaagaaaggaaaggaaaggagaggcaaggcgaggtgagacgaggcgaggcgaggtgaaattatcccctagagccttcggagggaggatggccctgccaacaccttgatatcagacttctagcctccaaaaccgagtataaacttctgttgttttaaccatttgtggtcatttgttattgcagccctagaaaactaacatattcctcaacatgcaatgccatttcttttataaagaattcaatcagcccaagtagctaagaagtggcttccaggtgcagcaccaacttgtagcctggtccttcctgccatagtgctttcttacagctcccttgcccaggttcattctgcctgagatgtcgtaaagctcttgatatggtttgcctgtgtccccacccagatctcgtcttgaattcccatgtgttgtgagagggacccagtgagaggtaattgaatcatggggcaggtcattcctgtgctgttcccatgatagtgaataagtctcatgagatctgatggctttaaaaatgggagtttccctgcacaagctcgctctctttgcctgctgccatccatgtaagacatgacttgctcctccttgcctcccaccatgattgtgaggcctccccagctacatggaactgtaagtccattaaacctctttctcttataaattgcccagtctcaggtatgtctttatcagcagcatgaaaacaaactaatacagctcttattggtgaagcctggccccagggaagatgcataccttgcaggagatttataggacagaggatgtgcctctagtgtgcccgtggtttcgcttgtctattttatatttgtagaggattgtcaagattctttggagatgctttcccattttctatcacaatggtcctgagtgctcaacaagcctgttatataacatgatgaacttgacaaagatcagttaaatgactcaaccaagaattcaaactaaggcttttcaactgggaccactgctgcttctaccccaggggtcatgataaacacctgggacagcgaggaggctctgaggtgtccgaaaatttacatccatcttcaaaaccaaaattaccaggggctctttcattttgatttgatgaataaaacatcttgtgtcctgaatgtttcagaaaattgaggaatgagatatggttctctcaaacttggatgtgcatatgaatcacctgggggatcctattaaaaagcagaatctgactcaggaggcctgggctgggacctgagatcctgcattgctaacaggctcccaggtgatgccagtgcagctggtttatggatcacacttccagtagcatgagatggcacctctgactaatttctctgcctgttcagcattaagctaattggccattattgccctttgcaattcagtagtaggaattgtggctctgactttgctgttgtgggagaagatgctgacacacaagctggcaatgcttaaggaaaaattttattgtggatcgataaccataaaaatattcataccttttggtcaaataattctgcttatggatatgcattctaaataaataacccagaagatgaaaaaaaaaaatctgtgtgaacaacggtgttctaccacagcactatgtatattaaaaaagaaaaaaatctgtgtctaataaaaaggaaacgattaagtaaattgtaataaagtcactcaatgcaaccaagacaatattgtagacatatgttcatcttctccctttcctcaaatgcaacatgtcactaaaggaacaaaaatggcatgaactcacaaggttaacaaactattaataatttcaacacatttgtccaagatacaaagtttacgtaattggggaacataaccacaggcccctatgtctgtatttgttattttttatttttttaattggtcagcgagtacaaggtatcaaagtaaaatcttacaatttttatacatttctgtatgcctgaaatatttcaaaatttaataaaaaagaaagtgcatagggacagagtaaagaacattctaacctacatgttgggggcagaagtgatgtgacaaagtgagccagttttcgcaacaaagcctggccttggctcttgaaggcactagggaccatggaaagcaggaatgaggcatggggctaacagcagaggaatggtcaagtctgtcacaggagactttgcacccctagatctcctgccctactaggaaacaatccttcccacctaccaccactgcaggagatgggcagttttttcttgagagaaattgagccacatacgctcagatctcagacacatcagatctcataagaggccacctgaaaataagagaattaatggaagctctacgcactgaactgtggggcctgtagggatggaaagtgtgatacctttcctcatctaccataaggattacggccaacactgctataacaaaagaggttaacaagagaaaagcataaatgcatttatttcatcagtttcacatgacacagaagccttcagaaatgaagactcaaagacccagggaaaactgtatttgtgcttaggttccatgaagaatgggaagccttgtagaaatgtgattggacaaaagggtgtgatctactggtaacagactgaggggaggaaacccagcaaggcctgtctgttcagattcttcttagtgtctctgagtagcattcctacctcccaggtaggacctctctggaatgagggttttcaagggagaagggagcgagtgacctttctaggttttgtggcttgctttgcaggagaggcattctagtttctatgacccactttggcgaaaaagaattcttgtttctatgacttacgtcgggggagaaaaagggatgggagacgggggcaggagagaaggtgaaagccttggcttctgaggcccttccattctcctttagttcaaagtactcagcatgccaacatactatactttagggtatcatgttctgagccccaacagaccctcagcccctccccgaccctgctctcaggcctccaggagccagacatatatacccacaggcaagagactgtcaaagtacaacctgtgggccaaaccatactccattctgtttttgcaaataaagttttattagaacacagtcacacgcattcatttgcaagctgtctatggctgcttttatgccacagcagtagagctgagtagtggcaacagacaccatctggcccacaaagcctaaaatatttactatctaggccctgcagaaaaagcttgccaatgcctgccctagggaaaaatagacgccccagaggaaagactccagatccctcatttggagctcccattaaaatactggtaaacttccctatgacaatgaagcccatcagtgacaagccccatccacacgcccactgagccgccaagcaggtttcagtacctcagtcttaagtacaaatggatgtccaaagattttccagacactccaggaaggctcagcgtgaaagagtataatcaaaataaaccgacagaaaaaaggaacttggaagaaccaaaataattcaacaactggaagaaacttacaataaaagtatagaactcatattatctgagaaatgagaaggtatttcatccataaaacaagaactagacactatgataaccaaaagtgaactctgaaacttagaaagtaatggctcaaaattaaaaaataaataaatagttaaaagagagtttaacaaaaagacaaggagatgaaaaatgggagggaaaataaacaattcaggatgtccaatattgaactggaaaaaaaaatataggacaagcaaacaaaggaaacaaagggtttaaaattagtgatgaatactataaaattcctgataattattttcttatctatcacacactgtgcccagcatagtaaataacaacaaccagcaagggccatcatgaaattgcagaacactctagcaataaagagatgattctaagttgacagagagaaaagaaactgaaccaaagaacgagaatcaaaatggatccaggcttctcaatagtaacactgcataccagaaaaaaaaaaacatggagtgatgcctacaaatttctaaaggaaagagatttttcacctagtgttctatgtctagcactatcagtcaagtatggagataaaagcatttttagacttgcaaggattctcatgcatcctttattacgaaactactaaaggatgtgcttcaacacaatcagggagtaaaagcaagagatagacatggaatccaggaaacatgggcttttcaacacagaagtgaaggaagtcccaaaaagatcattttccatcaagtctatagagcaaatgatccagtttcgagcaagaagactaaagacttcaggaaagaggatctctgggaaacaagaggacagaactgctcaattatttgatgtgtttaaggtataaaaaaatgattgctagatgttttacaggtttgttaaaacacttgcttggaaaaagtagtatgatatttagctgaacagcaaacaatttttatctagtttaataatgttacactgaccattgatttaacaaaaattgtaacacaaatctatttggaggatcacgtaagaaaaggagggagttgaggactggtgaatagaaagataaattcttgtctaaaataaaaaaatcaggaatagatataaaagcgtataatttagaaatatataggtagcttttagaaaaaacataaggtggaaagtagatgcctctctgagaagggatgggaggaaaaaataattgcttttgcttttttagtatatataatcatttggtactattttattattctaactattcacatacattttgataagaataaaaattagtctaaaataaattatatcaatctataagatcaacatatctattagatcataattataactagaaaagttgcttttttggaaaaaaatgcaaatgtttactccttgtggtctgctgatatttaaaagtctttatcataagaaagtccttccgttgggaatgctgagctggcagtctggtggagctgtagtgtcttttgtgtgttccagatgcctcgagaatcagtctttgtgggagggtggaacacaaacagttttgaccagtgtattagtatcagtaaggctagcataaccagggagagatgcaccaaggttcaggtaaagaatcaagtgaggaaaagatatataaaatgcatgtatatatcatggctgcaacagtgcaaaaatggtatgttcgttataagaaggaaataaggacaaatgaaaacagtttgatgtgtcagaagtgggagcggaaataaattttttcctttaatttagaattatgtgaagactgctataatgtttgtgtaaaacagaataaaggggttttctaaggaaatcagtggcattctttgctctgcctccctcctgcagtttaattgcctacacggaacaatatgtggaatatgaccctttgataacaccagctgagccatccaacccttggatcagcgatgacgttgctttgtgggacatagagatgaggtaaaaaatgttttaaggtttgggagtgggatgaatgtagacaaaaatccatgagatcatgagattaccttatattctatcttaatttgacattttttatcgctagaacagaaacccctcaagtagcctcccagctgagttctacttacagtttctacctccttatagctttgatttgtgcatggatcctttgtggctcccctctgaccctttggataccatgataactgagacagtccctcaccattccctagttctgattgctggaagaaaagaatctgttgttccaattttttttcctgttagacagcaacaataatgataatagctggcacgtattctgcattggccacatcctgcagtaagtgtctctcactgaatcccctcgacaggtaaacattactattctcaccactcagcagttatggaaactgaggcacagaggagttaatgaacttgcccaaggtcatactgctagtacagcagagttaggactagaactcaggcagagggctccagaaccatgatttcatcactctgttcttctggagtaactgccagcaacgattccagccagtttctccttccctgtgagggaagccactgtgtttacttaagaggggaggaaccaaagcccagagggacttggaccactttcagaattacagaaggaaacacacagacaaagctagtgtggtgtgccttcacaccccctgcaccttggctggatgaatttttatttcccttttcatgtctctgtcactcacattgtctttcacttttgccccttttctggctgcttttcctgaaatggaaaaaatcttataaaaataataaaagtcgcagatgctcattctaaaaagttcaaattatccagatgtgcataaagaagaaaatgctctcttcctccaacccgatttcaccttccagaaagaacctttgtttatagtctaatgctgtggttcccagagtggatcagagcaccctgagcactgtggggaactcacagagttaccactggatagtccaaattttttatggaaacacagcgatggttgacacatggcagatactgcataaactactagcttaagatggttcagtttcaacattagagcacgttacatcccttatgatgatacgcatctttgcaaatctggcttttcggagcagtcactatgataaaaagcaagaactgcacaaaaattaacatggaataagaaatagggacggtaagttccaacctaattccaaaatttaagaaaatgcgtagtgcccaataggtgcatattgtagttatttaagaatgaaaacaaaattttcaatttatgtgtctttcaaacagctactaagttgttaggatacaaatacatattaagttgattggtcctagccataataaatgacactgttaagtatttcttttggcccaggggcactgtgaaaaacttactgagacgctaagggtaccatgagctcagcaaatttgggaacatctgatttagtgtctattactttggatttttatgcacatataacattctatccttttgtataattgggttcaatatatatacccaaatatgtacatatatatatatagtccaataatttttaaattaacaataggtcgtggcagtctttccatgtaaacacatatagatccaccttactctttttaatagctacatactatcccctggcaccggtgaagtaagatttattttaccagtacctggatcataaatatttagcttatgtcctccttttttgccaccataaacaatgattccgggaacatctttctacacaagttcaattatttcatcagtatatattttccaggagtagaattcgtagaaatggtatgcatattttaattttagttcgtaggtccagattcctcttgagcaaaactgtaacacatctttttcattcccttagcttaaaagtgcccatttccccacattcttaccatcccaagcatcatcaatcattttgtctttgcaaatccaaaaggttaaaataattctcattttactgttttgtttccttgttaatatacttgagaatcttttcacatgtttattagacagattctagcaatatgttttgctttggatatttggatataaaacagtcacatttacttgaatcatatattttatctttttcctgatatatttctgaatctcattctttgttcttgtttctttttctcttccctgacttttactttattaatgttatattaactttgtaaaaaccctagtttctattctagttgtattaacttttaaatgttttaattaaaaacatcatcgatttaaacaaacaagagtgaagtatataaaatagtgaagttacctttgcctcccttaaatcccattcttcccagaggtatgttaacttgatatattttaaaccaacatttttgaacttgtatttctatgaacatttaaagaataactagtatatagtacgtatcttctttctaatatttctgatgagccctaggtagttccttctaagtcaagaacttaactctttctttaactcaggattttttttctcttttttaaaaattattgctgctttttttccattctatcctcacttttcaggaaatccttttttaagaagtctgggcctctgggatggagttgctacatcttttatattttctctattataatttccatcttttagtctttttattctatattcaaaggatacaatttcctgaattgctcttcagaatcactgctttgattttcactggtgtccattctgtgattttatactttagagagtttttcttttcccactgagtgttgggagagtggttgataatcaagcttttcatttccaagacttcttaatacttcttggactgttcttttcttagtagcctgctctgttctattggtgtttatcatgttactccccctggagatgtgatatagatttttttcatagtttatattttttccatattttcatatctcctctctatttctgccgcttagttttattcggggttattcattagagaatcatcatttctgctcattgtttcattcattcctctggtcactgctcagagcagatcattctttttgtatgcccagctatttggaagactgctcatttttataaatgaaggtcttagctttcaatcctgccatacattagaaccacctggaagtttctaaaaaatactaatgcctggtcctcacacacagccaattaattcagaatttctcacaattgaacattgttttttaatctccccacatttttttttaaatctccctttttaaatcagggagatttaaaaagtctaatgtgcagccatggcctaggactctatcagtagctggtgagggtgctctcagtgatggtatgggccaatggttctaagccatgctgtgcatcagaatcacctgggctcctctttaaaaatacacgcatactggggtggctctgggcgtctgcatcttgagcaagcaccccaggcgttctgaggcacacgacagtttaagaagtcctggtttggttcacggagttccccggcaggctttcccctgagcagttcacacaggagcagggctgcacctgaatgtatgaatggatgggcatagatcaattgccaaggttcccctctgggtcccgggtatgtggtccaagaacagattaaaagattgggccctctcttacagtgagacaggtggcaatgggagtcttggggaggtagacccccacccttcctagtgtgacatccctgcagccaagtgttctactctgtgggtcaagccctgatggagtttctgatgtctttctatttcctcgccaaggtactccccaacaagtcgactcttctccctccactaatgggtcttaggggaacccacttggatctgcgaaagccaatgagaggtggggagaaagctaatgtgtctttaaaatctccctggttcccaagatgttttttctctgtgtgtgtgctgtgctggcaggaacacaatcctctggccttactgtccatatgagaagctggccgggaaacatcccccttaacttagcaaacccttttggccatgtggaacctgatccatgttcctgagttgcttccatatgccccttgtctgatgccacccactgcctccacttccaatcctgctgctcagagctcggggtttcccaaggcttctgttggggacactcagctattttcttctctgatgcctccactggaatcgtaggctgctgtcgatcagatatgtcacaagttcagtctatgtgcttcgtgccttcctgaaatttctcaaagctctcatctgctgataggaaatttctttgcctctacatactgtgtttagtttttttggggtttttttgttgtttgtttgttgttttttttttacttaactgagctctgggcttttgcctgttccctcctcgttggccacttgtcccccagatcctcacatggctggcttcacttctcattcaagtctcactcagcactggtgtcccttcctcagaagggctttctgtgaccaccaatctagagtggccacctcatccctccagctgttctatatcacatcctcctcctggttccctttctaaatagaatgatttcagcgcctaggcctatctggcatacagcgggcaccgtgtgggctggagggaggatggatgaacaagtcattctttatttgatcgtttcattggtatttgggaaaggaggagaggcaaatgtgtgaacctaattcacaatgataaaatgaacttcctcttttgttcttgaaagtcagcaaagaagtatgtaatcatgtaggaaaatggggtcgcatggcctattggtttattccaacctattcagcactttttccccaaggaggtgctacctgccccctactactcatgccctggttctactcctgttgttctagcttcgactctgaacttcatgcctaatctaggatagctacagtgttctgtccacttacaggcagaatcaagtgttcagatacaagtgaaaacgaagccctgtttcttctcccaacagactactcctacccacttagttgctggcagtgatgttaggaaaaaacagggtggaatcagtgtcaacatcacactccagccaagggatggtttctgtccacaaaacgaaggctgaagatgaccaataaaataattgagtcactttctctcggtttcagtttaattcaatacatttgtatagtagtcaactatgtgctgtgttctgaacaagaagggctctcaagataacaaatgtagcaaggtaaataaaacatgctatcttaccatctggcaccagaactcctccttgcttggcaaaggacattaagccacttggggcagaaggtaaggccctaagggcagaagggttggcagagactgaaacaacaaagggagagggttgtgctgtcctgctgagaaaacgagacaaatgtattctctgttcctgagaggggagaactaagggcaggggaaagcaggggagggagagaagccagaggccaacaaaaactaagtctctgtgcaaggccagggaaatgcctagcattgaggtgaccagggacttttcaaaagcaggaatgtctagtatgtgcttttttaaatagtaggctgccaggaggtgcgatatgtacccatttttcaagaccctcaaattcctgtaaggcccccaccctcccaaacgcttcatgagaggaggggtttggtgggtgtgggtgaaggtttgtgggaaaggagagacagtgagaatgcaggactcccttaggaattcctgccaatctcaggtgggctttggacttcactgggctgggtgaaggggtccaggcaggctcgttatgatttccagggcccaggatgtcaccgacaatgtctaaattctgcaaggtggagaatatactgagtctgccgtggggaggttacagacagccaaatggaggatggccatagcagctgaatagaatcacggataagatgacataggatatacaataaatagcagaaaattgtgctttaattctttctccttctcagacaagctattcgatctggaagtccaaggataagaaagttatattcagaggggaaaaaaaggcaactgttttaaaggatgggcaaactacacctcaagtttatgcaacatagtgagctgtgatcgcaccactccactcccgcctgggtgacagaacaagacccctaaagaaaaagagtaaattctgagaagtaaagtttaattaaagaaaatagtgattgccagggcttctcattgaggagaagtcagtcaaaagttgccagatgacgtaattctttatgtcatctgaaaaccaccaggagagtgtcccagggatacgtatgtaaagtatttctggtggtgccactaactagatgctggagtctaatgaaacctggtgttgtcagcagaatgtggtttgtgatttgctctctccgcatgacttcagtttagctctccctctctgctgggtatcaggcacatgagcaaagagctacaaggaacctggcttgtccagcttggccgtaggcattcactcccagccaacctgacctgctgagaggcagagatcatccctgagctgcccatgcacagcgagtttgacagaactattaatccggaatattagtcaagctcctttcttatggtggtggatctccaaatatggccccattggtgccttccctctttacatcaagtaggacaccaagaccaaggccagatgaaaagagagggagcacctttttccctctctcaaactatttgagaaccagtaatccagaacccctgtggtggcttccaccttggtcatttgaaatatttgctcttgagacattccttcttggaatccatctgccatgcttggagaagcccaagccgttggagaggccatgtgcagacagtctggtcagtagcctctgctgagctcctggtcagcaactagcatcagctgttaggtgatgagccctcctggatgcacagcccagtcaaatctccaaatgaccccacctccagctgccatccaactacaaccatgtgatccccaagtgagaaccacccagtggagcctagtcaacccataggagagtgaaagagactaataaatggcttttttaagcccctggattttaggatggtttgttacacagcgtaaataactgggccaggcgcggtgacttatgcctgtaatcccagcactttgggaggccgaggcaagcggatcacgaggtcaggagtttgagaccagcctggccaacatggtgaaaccccgtctctactaaaaatacaaaaattagctgggcatggtggcaggcagctgtaatcccaggtactcgggagcctgaggcaggagaatagtttgaacctgggaggcggaggttgcagtgagctgagatcgtgccattgcactccagcctgagcgacagggtgagactccatctcaagaaaagaaaggaaaagaaaagaaaaagaagtaactggaccactcttcattggagtattcaggaccctcaggttgttcttgaggtattaaataaaattatgattgtttctttagtagccttggctctgagatggggacattggattattttctttttaaggaattgccttatttcgtaatttttctaataacttgtcttagtctgttcaggctgctacagcaaaaatgccatatactatgtggcttaaaaacaatataaaaatttttttcacagttctggaggctgggaagttcaaggtcgagatgccacagattgggtgtctggtgagggcctccttcctggttcataaatgtctgggtcctcacatggcagaaaggcaagagagctctggggtgtccttttataaggacactaatcccactccacgtgacctaattacctcccaaaggcttcacctcccaaaaccatcacattaggggtcaggatttcaacatataaatttgaaggggaacacagacattcagtccacaacattctacctcaagatccccagaatttatgtcatcttgcatgcaaaatacattcattccatctcagtagtccccgaagtcttaacttgtcctggcatcaattctgaagtccaaagtcttatctgaatatcatctaaatcagatatgaatgagattaaagataccattcatcctgaggcaaattcttctccagctgtgaacttgtgaaaccaaacaagttatgtgcttccaaactacaatggtgggagaggtataggatagacattttcattcaaaaagagagagagagagagagagaaataggaaagaagaaatgggtaatgggttccaagtaagtccaaaatgcaacagggcagaaaacattaaaccttaaggctctaggaataattctctttggctcaatgctctgtcttttagacccactggggcagcagccccacctccatagctctcctgggctggagtcatacacccatggctttcctgggctgatgctctggtcttccaggcccatttgggtggcagcatcatccccacagcttggtgggatggccctacagcagctttctcctggggtccctattgctttcccaggctggggttcctcacctgcagctcttctgggcagcccagtccaccatggctctgctgggtgcagcccatattgcagctttctgtggggaccccatcccaagtcactgggcaggagcatcctgatctacctaaattgaagagacgagttgatcctttaaaactgttctgctctcctactacatgtcccttgaactctgggcctatggtgcaagtggcagccctgatgaactctgaattgcttttgagtaattcttccattgtcttgaagaatagttcctggattctgttaagatgactcatccatactaatatacttatcaaacagtcacttggccacactattagtggtctcattttttgcatatgaatagacaaagaatttttcagatcttcaggttctggtttctttttgtgcttaacaattctgtctttaagtcacgttttactataagtagtcaggaagagccaacctgcaccttcaacacattgcttagaaatttcctcagctaaatatttaatttcgttgcttgcaagttttacctttcacagaatactagaaccaaataaaattcagccaaattctttgccactttataacaaggatcaacttttctccagtttctggtgatatatgtctcatttatgtctaaaactcatcagaatggcctttaccatctatatttctaccagtattctgttcaggattatttaggtattatctaggaagattgaggctttctttatagctctcctctttactttctgagccctcgccagaatatcctttaaaggcctggttacagcagtttaggttcctctcccctcctctcccctcccctcctctccccttccctctcctttcctttcctttcctttcctttcaagatggagtctcactgtgtcacccaggctggagtgcagtgtcgggatctcagctcactgcaacctccgcctcctgggttcaagcaattctccttcctgagcctcctgagtagctgggaattacaggtgcccaccaccacgcccagctaattttttttttttttttttttttttttttgtatttttagtagagacggagttttgccatgttgtccaggctggtctcaaactcctgaccttgtgatccgcctgcattggcctcacaaagtgctgggattacaggcgtgagccactgcacccagccaatttaggcttttgctgacatatatctcaagacccttccagcttctattcattacactgtaagccacgttcacatttttagttgttcattacagcagcttcccactcacagtacgaacttctgtcttagtctgttaggactgctgttacaaaaatactatagactgtgtggcttataaacaacagaaatttatttctcacagttctggagctaggaagtccaagatcagagtgctggcaaattcaatatctggtaaggatctgctttctagttcatagatggctgtcttcctgctgtgtcttcacatgacagaagggaaagggagctctctctggtctcttatagagtactaatcccactcatgacctaatcacctcccaaatatcctgcctcctaatacgatcacattgtggatcaagatttcaatgtattaatttggagagggacacaaacatttagtccttaacataattcttaagtgttttgaagatagcttgtatattccccaagtcttagtttagatattgattgaggcaaatgtagtagaaggcaaggtaacagagtggaaaaaaagaataggctttggagacaggcagtcctgggatccaggtcctggctgccacctaccagctgtgtgaccttggacaatctgacctcttttgaactctggatgtttaaatacaatgtcagcctccctggcttatattaagatttaaatagggcactgtaaggaaagctccttacaccatgtgtagcactatgaagctcctgcagaaatgagcattgatatagacaattgcttcctttgaatctggctttcttgtcctcagtttggtaactttcctccatctctagctgggggatcagcagaaatgaaagacagacacccttggagagctttgctatgtgttggtttgggctgtccagtgggaggcaggaacttgataagaatgaagaggcacagaggacaaataagagttagaaaaaggcatccagctagcgattagaaaacactgtcaggataaggacacttcatccacatcactatacacatttctaaactgatttcattttagtgctgaacacttgccatgtgaaaagtcctatgctcattacaaagacacatgaaatatggtccctgacctcaaagagctaaaaaaaaatagctggaaagacaatggcataaactctcgaaaatccaaatgctgacataaaactctactagagaatatgtcccaaggaaatatcgctacacaatggatgtaaagagactgtgcttctgtggattgtttgcttgaatttggctgagggacagttattgtaccacttacctggagatggatgttgaaagatattttaatttgcagaattattttataaccataagagaccattcagtggtaacaacatgttcaagtcttttcttaaaccttgaagtggatgatattgggaatactcaagtgatacagaagagatatgtatagggaagatgtatctaggaagcttttaatagaacagactcccagtagtgaaatcgtactaggaaaataaggaagaaatgtggatcatccagttgtagtaatacaattgtgaataatggatagttgagggaagccaagtatacatggttacattgtatcgactaaaaattcatgtctttcccagaacctcagaatctgacttatttggaaatagagttgttgcagatgcagttagttaagatgaggtcgtacttgaatagggtgggcccctaatccaatatgactgatgactttataagaagagaaagcaggctgggcatagtggctcacgcctgtaatcccagcactttgggaggccgaggcaggtggatcacaaggtcaggagatcgagaccatcctggctaacacggtgaaaccctgtctctactaaaaaaaaaaaaaaaaaaaaaaaaaaaaaaaaaaattagctggccatggtggcgggtgcctgtagtcccagctactcaggaggctgaggcaggagaatggcgtgaacccaggaggcggagcctgcagtgagccgagatcaccccactgcactccagcctggacaacagagtgagactccatctcaaacaaaaagagaagagaaagcagagacacagacacttacagagcaaacaccatgtggagacacagaaacacaggaagagagagtgcagtgatgcatctgcaagctgaagaatgccaacatcagaagttaaggaaaagtcatggacctggttctcccctaaagctgtccaatagagcatggccctgtcaacaccttgattttggacttctaggctccagaactgtgagagaataaatttctgctgttttaagccacccagtttgttagtcctttgttatggcaatcctaagaagctaatacaccagggtatcctgtctctctagacccatttatttctgctgaactatgaccttgccattttccagatacccccaccttctgtcctaagcatccctctgattctacatctacagtgacaccccaagatttctggcccactccaaaaattgcccttctcccactcttgccaccaccaaggaatctggtggaatgaatgtggactcaccacttgggtaccagaaaggggtgacactggtggtgggtgtgcatccatgaggcagtcactacaaagtctgagtgaatttctacagctgctaatatgggcacagccctcattcgagtacagctgccactagtaccatccctggagagccctgaatcctcctctggtaaagagtaaatggttgggtccatccttggtcatagcatgaccttggcagaaagagacaatgtcctgcagtctctggggcttaaatttactgccagcctcaaccccaggggaattcttccacaaacagtatttttggttcccttgaaagttattgagtttgattaggtctgtggcttgcgtttgagagaatccaggatttgtcttcatgtcttgttgtgaaaggcctagcctggtactttggaagaggtgtttcatggagtctcccattgtttgacctgatggggttagtctaccaccatgaccctattggactatgctggaaatgcagagttgcaagccagaggctccctgacctccaggctcatgatctattggtcatcatcattgtaattagaagatactgctgttgctgattatgtgtgttggtgaagaagtagttgggtttggatgcggtatgtctagagctgcataccaatatagtagccactagccacatgtagctatttaaatttaaatttgaatcatttaaaattaaatgaattttaaaattcagttcatcagtcacactagccagttttcaacagcccaatagccacatggggctagtggctgccatattggagagcacggttatgggatattttcatcattgcaggaaattacactggacagcgccagtctacagttatttgctttcccaagctttccacgcacacaagctcctttttttttttttttttttttttttttttttactaagtggaattttccaagtattgagaatatgtcagctccataataagaggaaacatgatttaatctcttactgtctgttggaaataataaaatatatgcatctattttttaaaagaggaaaaatgagtattgctagaccaatgtttcccaatttgtaatgtggacataaatcacctagggttcttgttgaactgtaggttctgatttagcaggtgcaggtggggcctatggttcttcttctggttcacagaccacaccttgaatagggaagagttgtagcatgtgacttgtgagttaggaccttatcactgtttaaagggccaaggacataaatacagcaagtgaactttaaatggaaagacagaagctgaaggaaatactcttatcgcccaacaccagaagaattagaccaatgcccattctttagtctgaatgtgagacagcatagcaaagatgagctatgcagcatggcagaattaagaactggggccgggtgcagtggctcacacctgtaatcccagcactttgggaggctgaggcgggtggatcacgaggtcaggagattgagaccatcctggctaacatggtgaaaccctgtctctactaaaaatacaaaaaaattagccagacgtggtggtacgcacctgtagtccccgctattcgggaggctgaggcaggagcattgcttgaacccggcgggcagaggttgcagtgagccacaatcacgccactgcactccagcctgggcggcaaagtgagactccatctcaagaaaaaaaaaaaaaaaagacctggtgccctctggagccttgctgtctagatttgattcttgacttcattacttcctagctgtgtattcttaggcaaactaccatgagacctcaccttccctatctggaaaatgggaatcatactagtacatttttcacagagcagttgtgaggactcagtgggttaacagatgtaaaatgcttgagacggtgtctagcacacggtaagcactgtgcatggttgttaaatcaataagtgcatgtaacattctgcttctaacaagagaatatgctttactctggatgtgtcaatacatttctgaccagttgtacatcacttggcttgaaacaggaccataatttctcccctgaggattgaggaaggggtgggaggtggaggatagtgtgttttgatgaaagattgggtccatgaagcatcctgggttatagtactagtgaaaaaattagagtcaaaagttgagtccataattgataggaatggtccagggagtttaatcaatggcatggtagacagcagccatttgaagggcatgccggcaaccatcacttaacatgcctccttaaagaaactgttcatcattggttactgttggtgtaccaaagtctgcatttggaatttgtgcagcttttgtagaatctgccccttaaatatgagatgtttccctttggtgagtgactgcaaaacagacttgagtcactgaagagaatatgacacgagcttttctctggtattgatcttctttaaaccttcttccttcaccccaaagcaaagagcccagccaacagcgagtaaaaagatggggcttctctttcgatgagatattgaaggaccaggtggggcgggaccagtttctacgattcctggagtccgaattcagttcagaaaacctcaggtaaatctctcaaagtttgagctgtgtgcggaatgtgtgtgaagaaatttgcataatcggtctctccatctctctctctctcaatgaaacgttatcagggttcaaattcaaatgccagctaatctggctgaggttgaaatggagaagaacaaattaaaatatgtaactctgtcaccaccataatagcacctactaacaccagcatgtttcagttcaagtctatatgacctttgtgcgactaattggaaataagtcttcaataataattagtcaaacggatttgacaacatcattcattaagtacagccatagaaccagggagcttcagagtggagaggcatctcagaggctgtctcctcaaaacttcccagtctggggtcctgaatatctgagaagctaaacggaagagggagaagtcagtgggctcatttcagaatttcaaagagcaaagtaaatatcactcagtaactggtgatgtaactgtagcagctacgtaacagtagcagctaataaaaacatgcttttttcttttagaatgacttctgtcgactccaaatagtggttactctgatcatctgacgccagtgagaacacctgattgttcctattggtctataactaatacttgatgagggaaatgtattaataattactatttaataggagaaaaaaataagatattcaaaacctcaggtccaatatgagaggaagaaaagggggtgaattgaaaggaaaagtctccttggttatgaaaaatttgggaacttgtttatttagacttttatggtattagatgaagaatcagaaatctgcagaaaatgtgacttatctgagacttatctagtgatcttagcaaactggtgactttttaatgggtaagatggaatctctctctttcttttttctttgtaccagattttggtttatatagtagagtaacacccatcttccagtgctgttttctttaaagatgtcttaataatgtttcaatattgtattactttaaaaactcagagcatgtgctgcgggcaaaggactgcccctccaaagttaatgtgcaacatccatgcacttatttgaagttgagaccatcggtcccatacgtcaatcaagtgatatttatgctacacctgtgctgtatcaagccctgtgagagtctgctgagagatgcaagtcaagatgtgtgatctttgcctgtaacgaccttgtaggtccttgaggaaaaaacacaagaaatgattaaatcattgaatgtctataaatgagtgtaaactctaagaaccatttcgaaagcatttaaaggagaagaatcaaagctgaagtagttaaatcataagctggactttgaagaatacacaggataatagtagacgaagaagcaggagagagaatattccaagctggaggaccaaatgaggaaagaggtggccgtgggactctcccactccataaggtcctgagaggacacgtagatgccgactagctgtatggagcgtgctgttctaggcatccacgtgtctgttataaaccagacaaggttgagtatcttattttgggttattatacaagagcctttccttgtgctgaagcatgattccaaacacatctcagagcttcatttcaatgcctaatgaagcatttgtaacagaaggcttgacttctaatactcttcactagggtggtgctcagactagcctccctgtataggaaggaaggctctctgtggccagcttgatggacccaggtggcctctctgtgtagccagctcagtcccagtttccaccccctccatggtccctatgagccacccctgggagtccttctcatcttcccttcttacctgttccccttgggtctccaagatggagcggtatagaggccccctttacctaactacctctaagcccgtaagtagcctcaggaccctctgctgcctgcactcttgcagagagcttgaagaatgacccagagtttggtcattgtgagggtcccaggagcatccactggctcagctgccaccttgcctggtcagagcattcattctagaaagtcccgagtgtagccagaaccacatatcagttcagactagtttcacaaattatgcatcacacttaaagcccagagtgcaccaaggagtgtgtccctggcaggtgttcagtgcttcttcctgccatcacctcctgcgcctctgccagctcctttccccatgccaggagggctacatttaatcttgggtgaaagcatgcatgtgagcatgtgttcatgtgccagagcctaagccacacccccagaatgcagaaatccagacttcagagggtcacccctgctccatgacaggaaaggaaatagaatagcagggaggaaaaggatagccaagagcctctaaaatcctctctggatgcccaaattccatttttatgatattcagcataactggatacatggtgggtgagagagaagctcagtcgtaaatcacataactgtaggactcttcagtcacccatcacagggcagccttttccccgttccattgcgttcatcccttcagctgcagatatcatcttagcaccaaccgtggcacagggctggcggatttagagctgactgagtaaatatcagggtggccaggcatggctatacagatgcacctccactgtggctcatgccatggaggcccctgggagttgtgcaatatggcacaacttgaggatcctgccaacctgtcatgttggccgtgctggagtcgtcccttctccgcaggattggtgaggggcccaggccactggcattggagcatggcaggaaaaagcctgaccagaactcacctgggtaaattacaaagtgcttctccacttcctctgtcctcctgtgctccctctcatctctccagtgaaagggctgcttagatcataacattcttgcacaacccacggggtgccagttaagtagccaagtggctgaatttctatcagagcttcagaatgcggaatggaggagccccaaagtgtcaccctggatcctttaaggaacaatttctatgatgatgtaatagaagttgacatcccctttgatcagtgtcttctgggtgggtctgtgagatgagggtgggggcatcatctctgtggactgggtggggtatgaccagcagcgcattttgctgaagctgtgagctctctgtggcagggtctacctctttttctccttttctgacccacctgagctgggtgcaggctccctttgcaccgagtggacccacagacagctgtttgttgagtgccttgggaatgctcatggcttctgtccacaaggcaggggcctcacagctctgatgcagggagctccgctcagtttcttggcctcatccttcttcctgctttgtgcattttcccagaataatgacagtcactccttcccatctttgctccctctcccacatctcccctacacaaatctttgtcctccctggcttgacaccctctgctgcacagcagagaatgagttaaaaatcaaaacccacagcaaagagtgtcccccgtacattttttgtgagctgtaacatctcctgagagaaggtagttgttcttctaacctgcagattgatgatccgagttccacacagtgtcggctgaagggagaagcaattaaaagagaacacagtggggcaccaggttcatctcgagagctcttgtctctggcagttgccctgagtccaaggaagacctcagaaggttcactaggcccagcaggatccaccacttaccaaacccatgattaataggaacagaggtgactcccacgacaccacaaccatctgcagtgtttcagtcactgcccagtgaacagaactcagcttcagtggtgctgggggtggttactaacgtaggcaccccggaattttagccccaccgggaactaaaccaagtttaagctctgctgcctacgtctctggttgaccagcagagggcatagaaacactttcttctctcctggagtttgctttttctctgggagcgaaccaaaagctgtattttctaacccatgaaaattctagtttatgaaaagatatgtaaactggtgactgagggcctgcccagacctcctggtaggatggagaatgatcaagggccaaatggtttgtcttacccagccagccttgagaaaatcctcttccttgaaagcctctagggagaaaggaggctcccactggggcagcccctggatggtcctccagccctgttctccactgcttcgccccagtggtatctgagcccaggctgcctcgctccaaaagctagtttccccgccagcatttctaagtcatgaacacggatcaaatgcccgcacaggggctgcctccctactgcagctatgacaattggcagagaccaggggcaggtcaggacaggtggtctcccagatattagtccttgtggcctgccagtcacaacggcccttctgctgcaagccatggaggctcagtgcaggatggatggatttgatgcagctgctggcatttcactccctgccgctgcccttggggaggagcggtacctgcaggttttttataagagcagaagcttccaaagcttcaaggggcttcccatgggcagcagatgtgcagagaggagctgctgtggctctctgcagcggggaatgtggcctgggctctgagttcccagctcaggcctgtggggctcgaagatggccaacactaaccaaagcctgttctgaatttcaaattgacacaaaggttcctcaaaaccagtgatggtaaacacatacgggatgtcaggatgctgctgtgacagcagttttgctgttgcctgagagagacaaggcaggtcaactccaaggcagacagaaggccagggagagtccccagtgtgtgcagggagagaaaactgctgtctagggaatgttaccccataccttccccctctcccttcttgccctttccccctccttccctccctttctctcccctccccttcctcttcctccagcatgcctgttgttttcacttgtacttaaaaaaattcttggttttatgtgacaaagaaaacctttttatttttacataaaagtttattaaatttgattccgcggcctggtgcaatggctcacgcctgtcatcccagcactttgggaggccaaggcgggcggatcacttgaggccaggagttcaagaccagcctggccaacatggtgaaaccccatctctgctaaaaatgcaaaaattagctgagcatggtgacatgcccctgtaattccagctactcaggaggctgaggcaggagaatagcttgaacctgagaggcggaggttgcagtgagccgagatgtagccactgcactccagtttgggtgacagatcatgaccctgtctcaaaaaaattgattatgaaatttgtatttccatcagctccggtcatctctatatccagctgagtgatgtacattttcatgtggcacccaaatcatcctgcaaaaaggaccctgagccctcaggaaccgcagggagcctgcagagctcccagggtcctcagggccttcccacaggggctcagcagctcctcctcagtgctgacagaggtgacagaaagtgacctcccatgtggcattgattgagggggcaggaaatcacccaggtgtcatccatttgtgtgagaagttgcaggggcccagggggcgtgggaagacgctgacccagaaggttgcttccagccagggattcagcccagacggcctccctctgtgaacctggttctcctgtctgcctagcatggggctgaggaagcctcactgacttcgtctctggacatttgaccccttctgggccttggaaaagccaacactggcttcttcctatagagccaggttccccgcatctttcacctactggtcagacatggccttccaggcagagaaagccttgtaggtactctcaccagcagatggccattttcacttggcaagcctcccggccacttccttcttttcacagcagacctgagagagtggacagagagccctacagaacctagggcaggcctgggagatggaggagacccatgccccagctcaagagtcaagggcccacctgaacaatgaggtaggggaacagctcctttcaagcccttccttccccaccctctctggactctggataaagaaacacgactgctttcctctcacccagaagccagaaggacctgagcacccaggacttgtggctgtcagagagctgtggaagggcaggggacaccagatggcagcagcaagagctgggcggcagcatctgcccaggccacctgcggagagaaggctggaatccgagggatcacactgggccagcattgagcctgtggccaccacactgacccctcctcagctccccctcacaggacctgaaagcatttctgagttaagtctgcataggaagttttccagagccatgccacatatccctccatccactcagtgcccattttacagatgaagagagaggcacccagaaaggtacaccaaggcaagatatggcgtagacaggatgagggcagagccagcttcctgatctgatggaagtcatgaagccttctctgccttacgcttggctctgcagggtcgctgagaggttcctttaaggagatcatcagaatcctaaatggcaaaaaatggcaaatcaggggaagagttggagcccagcatttggggacacacacacacacacacagtcgtcttgccttgcagaaattgggttgcattactccagtctgccactgagtggcacctttgggccatgcacttggctccaaagacatttctctgaacagcaacagaaaaacatgtttaaccctaaaaaaaaaaaaaaaagaaacaagtacatcttactttggatgaaatttgatgacagattgaatgcactgtctgcactttccaccacgtcatgtttcagcttcgcttgtccctccctttctgttgactagactacctgtgattcccgctgctctcggaaccagcacaggacctactctcttactcactgatgggggagctggcctgtccatgcacagggcaaaggatatgacacccagacctggatcctgctgcaaggctgccttgggaaccatccttaagacccggtagctgttgtccaagctttggctctggctgctgctgctctcagcagaaaagagctcactgctcccatgcggatgctgagggattaaacagaggcaaatacggaagtgagcagatttttctctcttgctctcagcagaaggagaaccattctgcagagaagttttcaacatatgcctcttcagcattgctccagatgcgtccgtcttcactctgaaacccatatattgagcacctactatttgccaagcaccgtgctgagcactgatgtgaattggctcagtttctccatctataataggaatggctggttcattcttacacagatagtctttatgattccaggacactgcctgcttctgggatctctcctccattttgatgccatcacttgatcccaactagatttgacaaagggtctcacactgtctgcatggtggcatgtatgtagcactggggttctcaaccaggaatgagttcatctcccaggggacattgggcaatgtttggaaacatttttagttgtcataacttgggaaggggggttgctattggcatctagtgggtagaggccaaggttgctgctaaacatcctacatttcacagaatagcctcaacaacaaagaattatccagcctgaagtggcaatagtgctgaggttgagaaaccttcatgtagaaggagagaaatcccgttctgataacgagaagcacattgatcttttaatatgcaattcttttctgttctgcaccataggaacacctttgatgttttcacaatctccatggtctttgcagctcatgtagtggcatcagggcaggctgagagatgcagcagaatgggtttcatgggacatcagctctggggccatctcaggcaacatcccgatgctgagccccctggaactgactgtgtttctgctcccacttcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggtttgcttatctactcaagtggttgtcataaggtgttcatttgtccccttcattgcctgacctattaacacaagttcaaggcattgtgggtagttaaaatttcagatttggttatttttaagttcatcagtggaaaccatttcagataggcgcacagcaaaatcccaggatcgttttcctagatgggttatgtattacatagaaaccaaaatgtgcagttatatgctttatttgttccaggaaagcctcaaagtgttttacaaaatctgaaggcttgtaataagtcagtgatagaatctggaaaccagaacacagcattggggaagtgggtgtagtgagttagcagggccatgagtcaaacccacatctgtctacctctgaagcccacactgataaccacctctctacactgcttccgcagtgatctccagctctgcagtgaatattttttaagcacatctatattccaggctctgcgctatgtgataagataccacaaagaacaggcaaaacccctgttctcaccgaggttgagtgggagacagacaagtaaatgggcaacttcaacagtgtgaaaagtgccccaaatgggtgaaccctaggttaaagcaagcctgcaggagggactcccaaccctgtaggacacaattaagatgctcacagatgctagtgatgctggctaaagaaacaggaaccaccctaaccagcagactaaattttgacggctgggaggtgccatttctaaaaataagcattgggttggtttcttacttcctggcccctaatttctatttcctgtcaccatcccacacccagtgacagggcttaagattttgcttatctccttgaccccacttacttctctcacctctggggcccccagtagagaatttgggtggtttgccccttgcagacattattatctgatttaggaaactcagtgtagctgcaccaatgcaaataatggcatgagaacagtgtcccttatcatccagaattaccttgtcatttgctcagaacttcaagatggaaacacctaccaacctcaacaccataactatctacttctctccccctggtcacgagctccatcaaatgcctgtgccaatcacgaaatcatgactccttcatataccccttgcagcttcaaagcagaatgtttgagtcatgagagctctttgctgagatatttttgcttatgtgtatgtacgtatgctttcaagcaccatattgacatggccagagaggagagtgacaggggagttccgtgggggttccctgcatgaacaagctgaagctcaaactccaatatttatgaaacacaagaagagggatactggtcaaaaccttgatgcatctagcacagtattaacactccaagcatgacatcaggagggatttattttaattttttattatgaaaacttttaacacttggaaaagtggaaacagcaaaacagcaaacatttatagaccctcatccagcctcaaaaatcatcagtacacgtctgatcttgctttatctctagccccatctactttttcacctgccaccaggttactttacaacaaatccaagatgttgcatcatttcatctgtaaacttagatatgtatctctaaaaaaaagatccttttgttttaatattgccacaatatcctttatctccctcccttcctcacatccccttgcaatttatttgatgaaggatttagatcctttgtcctgtaaagagttccaagctctggatttttctgattgcagccctgtggtgctatttagcatgttcttctatcatctctctttcctataaattcgttttataagatatttaatcagatttaggtttgatttttatggacaaaaccacttcatggattgtgtggtgctctcctatcagaaggcacatgtctagccacctctctttttgacctttttgcagatattgatgtctatcgcttatatccattagttaattagaggttacaaaacaacaacgtactaattttattctttcttcacttattagctggaatactttcataaagagaaacttccctccaccactatggtattaactagcagtacaattcacataagaaaagcaggataaatatttgattctctcccttcatttgccagttttcaaaatgagtggtttgctattatcttcctatggtaaacattagggtctattttggttttactatctttgtaaactcatgagtttaaacatatatgctatgttttaatccattttgctgattacttttattgatgcttggattgggccatctctggccagttggctctttctgacacagccctaagagtgatctttgacatcatccaaatagcagggaagctaagatattccagtctttgcccttacccagaataagctgtttctccaaggatccctgattcctcttagtgagaaatggtatttagagactaaaatctaggcacttagagtgtttcattgttcctggattgtttatcatttccagcccttttcagtcgacagagctaggaaatgtgttgctgtttataataaaaatacatcctgagttcatactgatacttttaattcaaattctgacctacaggggattttatttaaccgcttgtttcttacacctgtgcctcttttctctatgctgacaatcctgactttcaagggcactggatgatagcataattactcatttgctttatactacacagagcagtctctaaaccacaatgctaaaaatacagcaacagtatgattatcgcctggttctttaattgttgcatagtattccgttgtgtggaggcaccatagtttagtcaaccagtcctctcttcttggacatttatgttgtctctacttcaagaaagttttgatggaagaagtggggaagtcagcctaacgaaggttacatattgacaagtatctcaatatccaacctacagtgctctaccattttccaagtacttctaaatacattctatctaatttctacagcaatctagactagacatgaggatgtcttaagcatccccatcttcttcattatctgctaggattagtctcccatgaattcaaataaaacactcttcctaagccaatccctattttcagaccaatttcctattgcttctgaagtgtatttccaccataaatatacaaagtgttcctttctagcagagtgaccttggacaagttgcttaaattccctgagtcttcctttcctcatctgtagaacagggatacaatggagcctacacataggggtggaatggggaccaggtgaaaggaagcatgtcaaccactaacgatgtctggcccacaataagacagagtaaatactaccatcttatttttctaatgtcactaatattctctttttaagccgtagtgtttaatgtatttggtaaaaatttttaaataatttcacataaccttagcacccagagataacccctattttggtgtattttcttccttgatttatgtgtgtagctacgtgtaaggtctgctcaggctgctaccacaaaatagcacacactgggtggcttaaactacagaaatttatcacagttctcgagactgacaaatccaaaattaaggtgtcagcagatttggttgctggtgagggctcacttcctggcttgcaggtggccgccttcttgctgtgtccttataactctggtctctcttcctcttcttataagaacactaatcccgtcataagggcctctctcatgacctcatttgaacctaattacctctcaaaagacccacctccaagtaccaccacactgaggatcagggcttcaacaatatgaaatttagggagacacaacattcattccacaacagggcgattttgcaaatagcgtgatcctgtaacctgccttttacctaaaacaggggtcagttaaaaaactatacttttcctaaaaagagccagatagtagacattgcaggctttgtgagtcatgtggtctatgtcacaactattcgattctgcatacaaaagcagctacaatgcaacaacatagcaatgtaaacaacataaatgaggacctatggctgtgtttatttatgaacagtgaaatccaatttcatataatttttcacaaaatacaattcttcttttagtttttttcagccacttaaaaacataaaaactgttcttcgctcatgggatgtaaagatctagatcacaggtctgtatctgtagatttgaatcacagactgtagtttgtgaccctgtgctaaataaaatctagcacatggtcatgaaaattattgaaatgcttcaagaaatccagaaagctacaggatagaggattgggcataaaggatcttcagtttttgggggagagtaagttagaggagacttggttttgacgcagccatggcaacacagcaatctgaattgtgaatgtttctacatgaggattgagtgttgcggagcagaggtcagcaggtgccaagagactcacactgccttaccttcctggacagcactggctgcctgccccagcaaagtaggtgcagttcagaagttcccaggtataaaaaggaggttaaaatcctcagcagcccatgaccagccaggacttgcactcagatgtcctcgcttgctggccaagattctgctcagaccacactgtccctggattgttagtgctgagggcttggtggtcgcactgagacctggagaagttctagtccctagagaaaggccaagagtctgggagttccttctagaattatccatttaagttctttaaactttctcttctcggtttgcctctctgttaaatggggatgttaacacctcagcccatggggctcaggggctctgggtggcttcctcagctggtcatgatggttctcataaaccccctgcagtggtcatatgctttaatattagtgctcagtagcctgagagaaagtacagccagatttatggattcactggaagcagggactgggggtggggtgcagcctctctccaatgggttttgtttcttatttgaccacacgcattgttagagccaagttaattgcctgtatttgcttcctgtggaaatatttcacaagacaccctgttatcgtgggcccagcatttgtacttgtgttttgctgatccgtttagcttttttgaaaattttgggccaagaccaaatcttccataaaggtctgtgggctgtgaccatagtcctcagctgtttgctgtgttgttccaatttcatagatttagccttgtgaggggagaaaaatatataggccatgattatttttttttaaggactcagttctttatgctatggatttaattctctgttcccaaccatgtggccttaaaggacctgcattgtcacctgcttgctatgtggtctgaggcaagggccttgaccttttgtgccttagtttcctcatctgggtgatgggggtgatgtcttctttacagcccgctaaggatttcagagaaatcagatgagctaatagccctgaaaaatctttgaaaaagtaaaaagtgctatatatttgtaagtgtgaactcacaaaaattaatgactttagtactctctggggtttcgtaattctaagctggatccaaaagaaattctctcaaaatatctgcccttagatgggaaaaaatgccagaaaaggatgtaagaactgaattttcaggtcctggaatgcatcctaaggaatttgagcttctcatcctgaagacagtagcaaagcattgcaggcttttacctggaagatggtgaatcccatggtgatgggcatagtaggctggagccaagagagagttctgaaccctggggcatgtcatataaagctctgctggcagttgttggtggagagaattaaaccacaggaagtattgagaaccttcagcttccttgtagggcatttgtctctttccaaagccttcacaggctctagatgagatagaaatcaaatgccagcacagtggctgcctggcttccattttaaatctcagagtaccaaggatgttccaaggactatctccctggatccattcaatcatttgtccatctgcccatacacccatgtcatgaacatccattctcccattcaagttgggaaaccttgacccgtgcggcataatattctgtgcagagggaaataacatgagaaataggaggcccagatggctttttttttgccatcaggcagagcttatctaaaagcacatcattttcaaacaaaacaaaccagacctaagaaagcacttcattgagataggattggattggaaatctgtcctttaagtggactgatagtggaataggacaagccagtccagccccattggctttgatccttgcagtttcccacctcaccttcctactcgtcccagccccactgctttcctgacctgtggtacctgctaagatgccccaccctgccctgtacctggagtgtctgggccttccagacctctggatttgaaagttatttcatgggagcagaaatttggtcttctttaccttttataagttcctgcatcacaaaggtaatgctgaatgctgaatgtcagctaaatgctgataattcattccagaattataacattttcagctgtgcctatcaaagaagcgggggacaatttgtcccttagctttcaactttggagagacaaccttggggagtacacctagtagatagtcaagaaaagcaggttaaattaaattcctacaatgtgccgattcagcaaaacttggaatacccactaagtgtcagatgttctaggcgctgtgaatatacaaatgcgtagggaggttcctttccttaagcggccctgggtctgacttaccacagctctgcttggccttgatgaactcacaaaaggatcaaagagcatgctcaaggccagaatgaggtctgcgtgataaaagagctgagaaagataccgtcaagtccacatccgccatgagcagacaagaagcctctagcaaaacgtttatattattacctaagtgtagatgtttaaatgcaacttgattaaggaatgcaaggtttctaccatttgctttgtttaaaagccaaagcccagtagagtatgattttaggtttgcccagattattcagaagtagaagtcttcccagctgttcatctttgctccagtggtggaggtggcggcattgcgtgccagtatcacaagaccacaccaagtttcctggtattaatcctctattggaaggcatttcctggtagactctcatgccagacatattttaataaggaattctgtgacactgcttgctctgggggttgctcattttatcctgtaggtggttttatttttgggagatgaacagcagagggagggatgcattttgcagagaataaatcagtcatttgtgatccagttctgtttattaccacacagactagtagttcctgacagctactgagagaagacgtcaaagagttcaattccaaaatttcttggttgctacatctaagcatagattccttataccaaaccccatgacctccttgaggaggaaatgaaaatacttttcttcttttttttttttttgagaaggaatcttgctctgtcacccaggctggtgtgtggtggcacaatctcggctcactgcaagctctgcctcctgggttcacgccattctcttgcctcagcctcctgagtagctgggactacaggtacctgccaccacgcccagctaattttttgtttttttttagtagagtcggggtttcaccatattagccaggatggtctcgatctcctgacctcatgatctgcccgccttggcctcccagagtgctgggattacaggcatgagccactgcgcctggccaggaaaacacttttctaagttaacatccctggtatttgggtaggtgaaagacaatatgcaaagctgtctttgaagctacacttttctaagagtagggattgaacagcatgaaaatactgtgccctttggccagttaaattaaatctgtttttatagatgctttgcagagtaaaggcaaaggatcatttactctcacatcctcttatgacctggaatgatgccttatgtggaaacacagggctcccatgtcctacttaggaggctaaggaaatccaaagggggcacttcccattttagatccacatgatcccaggttgttcatccaaagatacatccagaaggagcaacagcttcctatctttcacttatgtggatgtccatattgttgcggtatcttttctgttgcctcttctatgtttgttaagcagatactgatttgtgatccacttcaagtcctcaccactgtgctgtcctgcaagaaccgtgctgaagaaaagctcattttccctaggcttcagctaaccatgcctaaggtctgaggacctttggtcaaacatattcaagtctcttgaaaggtgagactcaaggatacagacttatgacttcctaagggcccatcagccctcaacgctttaccaggttgggaccttgtttccaaagatgttcatagctcccttcaagtatagatggcaagttgtgcatggactgcctgttaagtgagaaaccagagcctgggccatccctggtgtcttggccattaccattgctaacagcagtgatagtgaatagtacccaaaagggaattgtaagcagtggccacaccttctactaggatgactcagatttaggactcaagaggaggctcctaactttcctgcaaccacacatggagggattttgtctcagccaaccagtactgactccccttgggacccaagtaaaggacaatgaaaagcagcacttcaatgtgagaagagcgtgagctttggggtcacagagctctgggttcaaatcctggttccatacttaccttgggtaagccacttgacctgttagagtttcagtatcctcatttgtaaaatgggggtgtttaaacctaagcactacttcagagcaaacatcaccaacaactgaaatagtacagctagactctgctcccaaatcctctttgcttctttctccagaatctctctcatcccacaaatcatcccttgcaaggacagtcacagcatgaaattattattgccacttgacatgtataatcatttttgtagtgcttccacttctacttccacatttaattgtgtgattgacaggactagaaaggtgagcttttggctcccagtccagttccttgtccatcaccccacacagcaacaccacattctgtccacacagcctcattttccttcaagagactacatgggacccaaaagctcccaaagtctggatgtgattctaggcagcttaggtatggagggcagagatgaggcacacacacctacaaaaagaaaaataggatacttgaaaatcacaagaagagctcttggccgctgtgcaatgctccagctgggtggttctccactccaggaggacgttctgaagctgggaaatgagatctgtgctgtcttaggagcccacagcacaggggaggacataagggtcttcttgaggagttcagctgcatgcttgtggcccagggccccagtcatttgtctgattagcttccccacctcttgagagagtcactgtgttttgtctaaaaagaaaggagatttccaaatgaggactctctgagcaaaatattgattttcagcaggtgtggttttgagacagtttgtactgcatgctctctccagctctcactgtgcctcggactctattgattctagttggttttgatcctgccttagcattccaggaaagcagagctctcctagcccaagaagagaaaatgaaggtggagtggctcatcggggtaacatccctccactacagccatcaaccactccagggatatgatgcctcccactgctgaggactctggctaagacactggtgtgatttagagccctagagcattggtttatcatcatatagagaaccaccctcatcttctttggaggaggtgcctctccactgcatcccaaggtgggagtgacctctggtagttctgcttgttcatagtcagcttagtcatctctgttgtagaaagagaaagagagagagggcaagaaagggaaagacggagggagagaggaaggaagtgggaaaggagggaagaagataaggcaagacaaaataagacaaagcaagaaagagagagagcacgcgggccagcacgctttttctccatccccttaggaatttactctcagcaggggcttggcttggctggttttgccagtgactcccttgcactttgcagattctgaatatacatttcccttaagactggttgtctgcagaataggggaaacaaaccagcacccccataaatcagcagaggtcactgccaagagctttgtacacttgctgtccctggcagtgataaactcattgcatttgggaaatggccaaagaccctgagtccaatcttaattctcattcccagaaaaatctcagttttctgttcacccacccccgtttactgtctttgtgtttcctagacaaagctggcaaggaggaaagaacacagttcaataactggatcatcaaaggctgcatttcgttgcttgggggaggagttgcagggcaggaaagagtcacagatccctaggctgtggaaaagagaggcccaggccagagggaggctgaagccatggggtctgcatggggtgtgagagatccgcagaggttctcagattctggttttctcagacccgcaccttggatctgctattactgctgtggtcggttgttcccttgaagggtggttcaggctgttataatggtggtcaagggctagcagtgggattggtgtggtgagaccacctcatgggactcatgctccagtaggttgtgttcttattctcttatctttctccccacaccatcctcaccttggtatctggctttggagttggccatatgacatggagaagatgagagtggtgtccaaactgctcctctgacccacatgggcctcctgagagtggacaacctctctctgctgccctttcctccttgccccttgattgtctttctcctctgattgatcagactgtgaagctgcaagaccagacccccccctccctgcaatcccacagaattaggagacatatttctgtctctctacacagatctttccactttgatgaggatctttctggttgagagaccaccattccccacttgtagcaggataggtcatccccaggtatacacattcataccctgtgcctgtacttcatctctgcagcccttagctgaattggctaaatgcgtctctgtgcaaagtctatcttgcctagttggatctaagctttatgacattagaggccgatttgtcttattcaggctgttatctcagcgtctgacacagtgccctggcacctagtaaatgctcaataactatttgctgaatattattttgattcagtgtttagacatctgctttatcctgctctattttgattgacaagttctttctcttcatgaaccaggcttttccctcctacaatgagtctataagaattagctagatcagaggggaatttggtgctgagccagaagagctgtctaggggaggtttcctcacttcttatggggcagcagaggggtattgtgagatattgagaagtcagaacaagaagcagggaactgttgctttggagaagggtctggagaggttccaggcactatgataggcttttccagatgactcaggagccacctggctctgtcagccagaaagaagtgatgcctgacacaaggagacagtgtgtcatttttactgtggactaacatttgtacctaagctttaaatgttaaaataatttggctgggtgtggtggctcatggctgtaatcccagcactttgggaggccgaggcgggtgaatcacttgaggccaggggtttgagaccagcctggccaacatggtgaaacaccgtctctactaaaaaatatataaaaattagccaggcgtggtggtgcatgcttgtaatcccagctacttgggaggctgaggcaggaggattgcttgaacccgtgaggtggaggttgcagtgagccaagatcacaccactgcactccagcctgggcaacagagcgaagactccatctcaaaaagaaaatgttagaacaatttaaagagacaacaaatgaaaccaaagaccaatgatacccctcagcctgggctctgagaccattagggatggctgagccaagattttcatgctcctctgagctgagtgtaatcctcattctccttctgtgcagagagcaggaacttgatgcagtcataaacccaagcaagtatggagccagtaaacttgctgaacattaaattccaaccggcatttcagtgaacatgtatattcgactaatatctgagcctgtgctagacagtatgcatctgtaaaaataaacacatactgttcctcaaggcacttaaacaagagtgagctggatttttgtctgaaattttcagaaaaacacttagtgaagtgtgttcacactaagtttgttaaatcagaatacgtctggactatccaagtagtctcagaaccaggccactattggaggctgggcgcggtggctcacgcctgtaatcccagcactttgggaggctgaaacaggtggatcacttgaggccaggagttcgagaccagcctggccaacatggggaaaccccgtatccactaaaaataaaaaaatcagctgggtgtggtggtgcatgcctgtagtcccagctactcatgaggctgaggcacgagaatcacttggaacccgggaggcagaagttgcagtgaactgaggtcacaccactgcactgcagcctgagtgacagcaagactttatctcaaaaaaaaaaaaaaaaaaaaaagaaccaagtcagtatttaatttcatttgagtccttccagtgggtttattcccattagtggggtaactcccctgcttttgtaaatatgagggtatctcaggaagaataagtcccaaaacaagattctttgggttccaaccaaagatgaaaccaagagggcctcacatgtgaccaagacattttctgctttctactttcactttctttttgtttattttttaaattgagatgtaaaagttgtatgtatttatggtatatagcatgcaattttgatatatgtatacattgtggaatggataaatcaagccatttaacatatgcgtggtctcatacacttattgtttgtagtgagaacacttaaaatctactctcagcaattttcaagtatataatatattgtttttaactgcagtctgtagtcaccgtaatgttcaagagacctcttcaacttattcttcctctctaattatgtggtgtcctttgaccaatgtcttcccagtccttctcactccccacagcccctggtagaatggccattctgctctctgcttctgtgagtgtgattgtcttagattccatatacaggcacatctcgttttattgcacttccctgtattatgccttatagattctgtgttttttacaaattgaaggtttgtggcaaccctgcatcaaacaagtctatcagcaccatttttccaatagcatgtgcttactttgtgtctgtgtcacagtttggtaattcttgcaacattaagcttttttagtatgattatatgtttatggtgatctgtgattggtgatctttgatgttactattgtaattgctctgggggtgcccaactgcacccgtataagacaatgaacttaatacatgttgtgtgtgtgtgttttctgactcctctaccaaatcagccattcccccatctctttccctctccttgggcctctctactccctgaaatgacaactatattgaaattgggccaattaataactctgcagtggtctctaagtgttcaggcaaaaggaacagtcgcatgtctctaactttaaatcaaaaactggaaatgattaagcttagtgaggaaggcatgttgaaagccaagataggctgaaagctaggcctcttatgccaaacagcctaggtgtgaatacaaagaaaagtttattgaagattgaacatgctactccagtgaacacacaaaagataagaaagcaaaacaaccttattgctgatatggagacagttttagtggtctgaatagaagatcaaatcagacacaacattcccttaagccaaagcctaatccagagcaaggacctaccttgcttcaattctatgaaggctgaaagaggtgaggaagctgcagaagaaaagtttgaagctaacagaggttggttcatgtggtttacaaaaagaaaccaagtccataacataaaagggcaaagtgaaacagcaagtgctgatatagaagctgcagcaagttatccagaagatctagctaagatcattgatgaaggtggctacagtaaacaacagatttgcagtgtagattaagcagccttatattggaagaagataaatctagggttttcatagctagagaagagaagtccatgcctggcttcaaagcttcaaaggacaggctgactctcttgctagggctaatgcagctggtgactataagtcgatgccaatgctcatttactattctgaaaatcctagggccttcaagaatgatgctaaatatattctgcctgtgttctataaatggaccaacaaagtctggatggcagcacatctgtttgcggcatggtttactgaatactttaaggccactgttgagacctactgttgaggaaaaaaataatatttctttccaaatattgctgttcattgacaatgcaccaagccatccaagagctctgatggagatgtacaaggagattaatgttgttttcatgactgctaacacaacatccgttctgtagcctatggatcaagaagtaatttcaacttttcaagtcctattatttaagaaatacatttcataaagctatagctgtcacagacagtgattcctctgatggatttgggcaaagtaaatcaaaacccttctagaaaggagtcacccttctggtggatgccattaagaacatttgtgtttcgtggaaagaagtaaaaatatcaacattaatgggagtttggaagaagttgattccagccctcatggatgactttgagaagttcaagatcctagtgaagaaagtaactgcagatgtggtggaaatagcaagagaactagaattagaaatagagcttgaagatgtgactgaattgctacaacttcataataaaactttaatgaatgaggagttgcttcctatggaagagtaaagaaagtggtttcttgagatggaatctactcctaatgaagatgttgcaaacattgttgagatgacacaaagaatttagaatattacatcaacttagttgataaagcagcagcaggatttgacgggattgactgcaattttgaaagaagttctactgtaggtaaaatgctatcaaacaccatcacatgctacagagaaatctgttgcgaaaggaagagtcaattgatgcgacaaacttcattgtcttattttaagaaattgccacagtcacctcggccttcggcaatcaccaccctaatcagtcagtatccaacaatgtcaagacaagaccctcccccagcaaaaggattatgactcaccaaaggctcagatgatccttagcattttaacaataaagtattttttaattaaggtatgtaccttgttttttcagacataatgttattgcacacatcattgactacatatagtgtaaacataacttttatgtgtactgggaaacgaaatatttcttatgacttgctttattgtggtggcctggaaccaaacccacaatacctccaaggtctccttacataagtgaagacaagtggtattttgtctttctgtacctgacttatttcacttaacctaatgttctccaggtttgttcatgttatcacaaatgacaggatttccttctttgttaagaccaaatagtattccattatgcctatatactgcatttcctttacccatttatctattcattgatggactcataggttgactccatatcttggctactgtgctctccctttcttttgtgctgggtaaggagtgagtcttggtgaatccttgtcattgctctgtctttttctggccaggcatctctaaaatgtgtcccccagctgatgggaggtctgtgcctcctccttcgatcccttccctggaaagagcaccaaggaagaggtccttaatgaccagtcctgcctctcagatgagcactctcctcctccctgaccagctctccatccccctcaccactagggcctttgtctggcttcatgagaagaacaatgagcatacatgggggaagatgcttcctccaccaggacagccattaactaacaagcccgccctccccagtgaaggccaacctccctcctaacacattctctcttggaacagccaagctttcctgtgcagctgagctgaattccacttcaatggataaataatcttgcccactgacaagtcctcttttctaagggaccaggattttccaacccttgatgaggacagatctgtttggaagggaccacaagattctaggaattagctggaaatcaggggtgaaattatttgccaaggccagaatgtataacaaatgcccctgggagccgaggaaaagaggcggcaccttgctgcagcacctgcccctcctgggtgttagttacatgtcctgtgatgtggttgccaagaactccttccaggacgaggtggtggccctgaaatgcacaaactgacccaattgcattattgcctgtttttttaaattaaactttttattttgagatacgtattgattctgatgcagttataagaaatactgtgctgtttacccagtttgccccaatggcaacatcttgcaaaactatagtaccatatcacagccatgatactgacatggctacaatcccctgattttattcatatttcccagttttacttgtgccccatgtatgtatgtgtgcatttagttctatacaactttatcacgtgttaagatgtgtcaaaatacagaaccattctgtcaccacaaagatccttcctgttgccttttataaccacacctcccttgctccctctacttcctcatctctaaccccaggaaccactaatctgttctttgtctctataatttgtcatttcaagaatgttatgtaaatgaaataatatagtttataatctggagcttggcttttttactcatcctaattcccttgagattcatccaagttgttgttgggtgtaagaacagtttgttcctcctcattgccatgtctggttttaatcattaagcaccccaacatggcacccaagcccaattacaaatccctcaggacatgatcctcagggaacttttattctaagagagcccatatgttttgtttggtgctgctgagtttgggggtgtggggatggaacatgttgcaagtttttctaggtacatgcaaacatacctaggttccttcatctccttccccaaaacagtgatcaattggattgtaatattctttagcactggttgacagcccttccttgtgtctccttgtcaccttcctccccaggagcacatctacaagctgatgaagagtgacagctatgcccgcttcctccggtcaaatgcttaccaggatttgctgctggccaagaagaaggtatctttgggaagggcaggcttgctcttagcactgttgactcttgcctgctgcttgctgctggtttgaaatgagaatatcatcccttgggttttatttatttcctactttcttctttcccttctctatctgctcccattctaatggaaaacagttaggattgtcaccaccccagccccactgcaaggtccaggatggggcatcctacctccacatccctactgcctctctctgcatgttctgcccatggtgggggtgggtacgtagggtgacaaaagactaaggccacagtggctcagcataggagtgcagggctggcagtaacaccagcaaaacccttaggacactggagagagcccctcactgcaaagtccagccccttcacctcagacttctctccctgaccagcccagagaggagtatgaggccagggttggggcagctctctcactggtcagaaagccttgtcagtttcaagagcacaatcaggtacctaaagtcatcctggggtttctccctccttgacacccccttcctctcccgcacctgccccacggtgttgcctttctctcttaaccaagaagtaactgcacccagctccttcctcctcctccttagaactcagccatggttccttgcagcccatggagtcatggatttgaggtgcaggggccctcagcatgcaggtgaggggtgacagaagcaggaataaattcagctagattcctgggaagagaggaggaagagtaggcaggagaatagggtccaggaagggaatggaaggcaagagagagggctcctggtttcagtacacctgcccaccctctgtgcttttcagctctgatctgaggcccatgtgtggttaagtgtggctcaacttgcaccaaaccctatgacttctgtgccatggcacttagggagcacaggcatccctttctcctccctcctggactcccagccccaggccctaagcacgtggttgcccatcacatgctctccgctgggctgcctctcagccacgcaagccttctctctgtgtgctgtcaccctcatgtgccaggatcctgtctgcgtatctggttgggaccacacaactccagagtcctggagagcatttataacctgctctcctgcccttgtgtagccctggaaagaggccatggagtctgagaaaggaaagaggacttctggggtatcccagttgtcagcagctctctgggtttcctgcatccctccccacaggtgtggctactgtgatgggcagtgtggagcctggcctcctgtcgattcccctgctggaggatgccaatggaggggctcctttggaggaggccgacaccctcatacatggctctaatgcccattttttctaagaactagaggaaagaaaaattataggaacttttgataactccagcccagatctcatggatgaaggtcaaagtaagtttttcttattttctgtggctcaagacccctgatctgatcacagtttggtgactttctaaggctctggtagtttaaccagtctaggcctgtctacacacctagaagaagagaagctagaggccattgattctccttgtgggtttgaacacaaaggaaaaatgcaccccaaaccaggctgagacccctgtggctgcagatcctcccttccaagaagaaaacctctcagaggaggtcacttgagtgaggaaggaactggcaacctgcctgggaaaagttccttagagttatcctcccagctcccgaagtaagggatgttcttgagacagaaagcccttgcagataccaacaacgtctcaatactgaggagttgtttcccaaaacagtgacaaaacctgctttctccttctgtttcttcctgagagtctccaggtatggatctgatttgtaactcggcactttcaggtaggcctagagtattcttctgatttcagggacgggttcaccgtatccaggtcataaaaggtatgtgagattcacaacctccggcggagagagggaatatgaatcagcctcacttttctgctgagaactgacctggacggagtcttgaggcacagccttctgatccttcatccctaattcagcctcttttctaatattttccaaataaatgatagtcacactgaagaatcaggttctcagggggtaggtgagctgagtcctgagggctactctaggaaacttcagtaccagtgatgatggttttccagggcagctcaatggccagtgcaaggcagaggagccaagtgagccagaccaatggccaccctctgtgagccagaggataagaataacaggccgacaatgccagctgcagggcccaggactggcctgacttgagccaagtgtatgccacccaggctggccacagggttcaagctgagtcctgccatccccagaatagagacttggtatggtacccggggccaagcatgagtccttcagttcctagtacaagaagaaaggccagcccaactctgtggtgttatgtcgtttgtgttgtattttccttctgcaacctcatatctgtcttctggcagccagctgagctgacaaggggcctggctgccaaggaagccccccaacttcatccacacaggcggctgcctttggcctgtcccctctgctttcagcacagtccgcagacccacagacctcaggctgcctctttagctccctcatttcagttatttgctgggtgtatgtttgtgtctatgtgagtgtgtgcactctccgaacttctcagcctcgggctcaggaccctggaacgggatccaggatacactagcaggtatttgagcggtcattctactctcccggaacccctgcagctaggaaatgtggggtgaaaggaaagtcaggagcaccccacacctctcttcctcctgtagtagagggaggctaggcctggaaagacattcaagggctttgcctctcctcgctcctgttctgggaaccccagctaagagttccccacaatggtttctgagcttcctctagcctgtcgtacgtacatcttggcaggtgttatgtcaccttttggatactgagaaaacacacaatccccatgttattgtcttctgagacccaagaccctttgtccatggcaaaggctatgagtagaccctccttgctctaaggacacagaacgagggtcactaggaagtcactgaagttagcaaactttctggctgcctctgggcaggggaatctcaagagagaaaacagtcctaaggcagactcatggatgagtagataacttcgcttccccggcagccccttcctgacgtccctcccacaccctgctggctctcagagccagtctgttctgtgtcaggacttggggggcccccagggccccagggccacaaccaccagggctcctgcctgtgggcacggcaggttgaaagcagcaagcaagctgctcaaacccaccgactgtggtcctgcagcaaagtcatgatggttctgatccaagccccgcaagcaccattcatggcccccggagaagcaaagcccccctctctgctccctgctccaaggaggcggcaccatttctcgtgggcttctgtcttctgtctctcccattgactcttccaacagctctggctgcttctcttttcccatttttcgccccattttgctttggtttttgttattctttagctgcagctgctgctgtttgggaaccacgtataagctgaagattttttttttctgtatttttctccctacccttttttttttttcctaaagccagaaagtgagcaaggtcgtagaacttccctagaaaagttcactcgcagtgtggtaagttcagtcggttttcttccctcagcttttcttttggttttggttttttctttcttcttcttttttttttttttccctttggttgttgtttcctttggggtgggagggagtccagtgctttctccctcgactcagcccttttcttttgcgagtgtctgcagcttctcttctagggatgaaaatgcaaaaaagagcaagcggctccctctgcagaaggtgcacccttgatcgcccagcctcaggcctgggcatttgatcatctgttcagggctttgaggaggagggaccctgctgccctcggggctgtgcggtttgtgcatcttctgcagcagctcagggagaagccatcgaactataccgtgaaataaattggctcagaaccatagctcatcgaaaaaaaaaaaaaaagccaaaatttccctctgtgaaccctggcagtcacgccggtgtgggtcgcgagctaatgttgctgtgtaggcggcttttgctgtgtgcagaaagcggccgtgctgcatgggtcctggcgatgtggcctagctggcgtgtgtgttagtcgcctctgcatgagtcccttccagcccccatcagcctcatgtgcacagtgtgatagggagaggagggaagtagctgaatccctgcggtgtcctgggtactccccgggggcaaggtcctaccggcctcctcaggccttgattctaacaggctgggtaaagatgggcttcagattcctacaggttcatggtacgccccagctagagaggtagagctccccacagtggcacataaagacagccgtggcaacaggtgggagtggggagtccgtggctgttccctggggtgcatggctgagactctctaccatggtttgtagaacaacacaggccaatctcctctttccatgctggtcggcccaagatttgaacattgagctcagtgcacaagaaatactcaatcccgctcaatcacggggcccatcctgtaccatgaacatcaaaccagagggaaccagggagcagggtcccatgcagggagctggccacattcccttcccaaagggtggcagcccattgatattgacttgcctttgttccacctctgttgaggaggaaaatccttgtaaaacctgactactgtgtgactggtatacgtatttcatccttttaagaaaaagtctaaggctcctgggttgaaagcagcctagtcatttacgtgtcgtagctagatgcattttaagtgcatttaaacattatcttgaatttgctacatgtaaacctcaaataactctagtgggtggcaattaattaaacatcggtatccatcccttcccttcctcggtcttccctctctgtggcctttcctcatgagaaatcagaatgtgcagaacacaaggcctgcgggtgcctggtctatcttcatggctgctttgccaatggccgtgtggctccgcacaccaagaagctgccacgggctgtcagagtcaaggcttctgggacttccttcactccatgatggcctgagagaaggtagtgggatcccatctctctctgtttgtctcttttgaggactggctactgtgcgggtggaggatggttagggattttgctgacaagccaagggtgcctgtgtaagcagagccttgacagcccccggaagctcttgagggtgaccgtgcaggccacgggtgtgagaggggaagcctggtacttggacaaaacgtccagacattttcaggctgtttttcaagagaagtgagtatcaagaaaggcaagaatggtctcgcgaagctctgtgaggagcatttattgatttcctttcatcccagaagtggtgttggcttgggggttctcccaaggtctgttagcaaagcatttggaacaagaaagcaccaagacacccctaagtgtctgaagtgcacacatgggagagcttccagagggagtttcagagtgagctgaaggagaaaagtatcctaagctcctgagggtgtggataaaaggcccaaactattaaaaaaaactaaattcctaaattccctgctattttatgaacaagaaactctaacaggtgatgcattcagaatttggggttccagtggtggagatggattgccatccatccatgctcctcctgctcttggggtgacaccatagccccacaagatgtggctaagtttggggaataatatgacccatgtgttggctctcagattacttaagattggaacccaggaatctggtctcaacagcccagtggtctcatcaaacagaactaactaactgatcaaccaatatgccttgcaatttgatagccattctctgactatcatatgcctaaagtatttgatttctctaagagaagatctacgtgaatgttttatctgctatatactgcaagctataaaactaaatgaagggccagttcaatagcattcctgtgttgctgggaaagatgtgtaagaacatgacccatgtcatggggctaataatggaaacaggggagtgaagctgggcagctcacggaccaaagacgtgaggccaattaccatttaggattaattgatggcaaaaagaaataatgttgatccaggtgattggataactcattcagctggaggcttgtcaagactgaatctgaattcagaatttctccccagaacatgccaatgtcctttcttttcttggtagaagagaaacacttggaaaaaacaaattgttctttccaagtcttatgttgtgccatgacatagagggattatctgttaagaccacatatgcccccttttccatgagatcctaaggagacatttaatatggttcatggaagcttttagggccatgttagtttgggtgacgaaggggcctggtactccccagtcaatagaggaagtgctgtatgagcttctctttccaatgcaagcttcattccaggttactcaggacttggatatacaaagcaaatgtctggggacactgggccaagcatcctgtcattttgcagactgaaaccacaaaccctgcttatttgataaggcccaggttctgaactaaacatgactgaagtccacgacagggcgcaactagcctaccatgtacgttcatccaaaatggaaaacaagactccctctggtgggcccagcctcacagatgcccagctgaccaggcaaaacacaggctgggtttcagcccctattgatcctcagctgccctggtgcagtgaataacccacgccactgtacatggccacccttgtccgaggagcctgtttcagaaagagctgtaacacacagcagcttctccagggcccccaatacatggcctcaggtcatgtgatttggagcctgtctctgcctaatcctgctcatggggaagcttcctttcacagtggctgtaacatatgaaaaccacagtaggagaaatctggctagtcactgtgggttgcctttgcttcaccttccagctgttcttcagattctttggtgggaagtctcaggcattactgaccagggagaggaggtgccttctctcactgaagactctttcctgttgcttggtgatgtctagcctgccactctctgctatcttcctggttttgcagttgacagaggacaataggagcatgaaggtggccagagctgaaatgctcaccctcccactgcttcttgagacagagtctcactctccgagcctggagtgcagtggcacaatcttggctcactgcaacctctgcctcctaggttcaagcgattctcctgcctcagcctcccgagtagctgggattacaggcacacgccaccacacccggctaatttttgtacttttagtagagatggggtttcaccatattggccaggctgttctcaaactcctgacctcaagtgatccacctgcctcccaaagtgctgggattacaggcatgagccaccacaccccgccctctgctctctcttaagtgtgcttgttgcttcagcttccacagagtctaccacagtggggtggggggcctcaccaaagagggcctggctctgacatagaggaccaggagcatgcgtgggagggagagggggcaagaggaatcggggccaagccacagcagcagctcccttgttgagatagatactggctgaagccatctggtgagagctccaatctggggaggagaagctggagaaagtcctttgctcctctgtccagttccacagaaaaagccgcagagggtgatagcactgaagttaggagaaaatggcagccccgagtgaggctggtgtcagcctccctgggtacctttggaggctcagttgaaaccttacctgccctcttgagagcttcatcagctccagccttgggctccaaagatagatagatagaaaatggggttgctggtgccagagcaagcactggaggccacggaggagaagggagaggaggaccaggcgttcatccacctcctaagagagcatcgaagtttagctttgccaaggtgctccttggaattgcggcaggaagggccggaagctgcagaaggcttggcatgtgatgggtggcatctctgcgacaggctttcctgtcctgcctgcctgccaaggaatgcagcaggcaagtcagatggggagcgggaagctctgggagccagctgccactcagcctccctcgccccctccttccatccccctgttccttcccctgccaaaagccaaggaagagctaatgagagccaagaagtcaacagctcactcatccccctccaggcagctctgcagagagaaactcccagctccaggcccaggtgctgaccggaagtggagggctaaggctctccgcaggggagggggcaggcaggcaatcagggcagtcagccaaccggcagaagcagctcctgcccccaggaaggcggtgttgttttcccctcctcctcaaggtttcatggggaacagccttgcaccctggtggaatgagttcccaaatacctagactcagcagaatccccagagggctttgacctcagttgaaatgatctttctgtgcctctggcaagggccaattggctaaaaatctttccaaagggttagtttttattgcaaacagtccttggactcctttgggaccactgggtcacaaacattagtgccagcctctcccatctcagagcactgagatccagctgcagtgaaaccctggccctggctggagctggagggagacttccatcgaagtgtttgggaaggaaagcagggaaacctgcctctctggagcagcaagtgcatgtcctgggactctgagacacctcagcagccctcctgcagactggctcctgcttccagcctcagcttgctagctatgtgacctcaagcaaatcactagccctctctgagccctggttttctcctctgaaatgacttggactaggtcgtctcgatggtcccttccagctagcggtgttctgcaggtctgtgcttccctctgtcctgagatttctgagttatataactcattccttagaatgggagaggagctgtcttcttgcccagttagttacctgattcagaagtgcctgccagcctgtgaggctgggaaataaactgtggatagacttgagttgggtgtatttacaaagcctggacatgcactggcaggagaactgagtgccccaggctccccacacctacaccacaggccctgctcagttgttcagggttcactcgtccacggtgagtcgccggagggtcagggaggactcacagagaacagggtgagtgccctacacccttcagcttgccagttctgcagtccccacccttccggtctggatgcccagctgtgtgtgtgtgtgtcaggtggggtcagctgggcagaaaggtggaccccagggtcggtgttgccgcatcactgcatgcactgtggggtcccaggggccctatgggtataggaaggaatgaaatgtgagcacttgggaatctcagcacactctgctgctcacctgctaccaggctttctggttccccagggaaccctgggccagcttgttgctgtcctcttttagcgatgggaaataagagtatgagagacagtgttatcctgtttacaatcagtggtgaagtccgtggttaagaccaggttacaactcctctatgcttcgcttcttatcttgactctgtgtgaaattaggaaaagcatatttactgttatagttttgtagctggaaaatgaaaatataaaagtctattttttataaactacaaaatgtaaaacaacagactcagtatggctggtgggtacagagaagacaaagtggctcctcacggggttgacaggagtctcgagacttttatcaaaaaaggccagaagttggttgtcatttttgagacactgggccctagaccctgacgtttccgttggaaggaggagcccccagctgttcccgctgatggttcaacctgtccgccaaaagcagccaaaatgctctccccacggagtgcccacttggagaaaaaccccactggtgactcaccttctggacatgtggggcaatcagggcccggtggaggcagctgctcctggctttccctggtgggccctccctcgacccccgcccaggccctctcctgccttccccagaccccaatgtgccaagcagtcaagtgaaaatcaaatcctctgaggcagaaagacacagctgtgtgtttacagccactgattcagatccaaatcgcgtaccctgccagtctctagcaaggcaggctgggggcaaagtgtgtgtatgccaagcagggatctatttcgggaggtgacctgcaggccttcgccatgacagtgccttcctcccacccactctcaggaaaggtgctctcactttacaagcggctgatggggttgtggggtctcggcatgcttgtcacttgtgcagtcagaccccagtgccatcctcgtgcagccacatgggaactgtgtgggctcccacctgcctagtaagaaggcagagagtgaaggggagtgcagggccccccgcaggataaacagcgggaaggccgaccactcagaagacaggatgcccgcctctgcctaggacagagcctgcctcagtcctgtccggggagcagcagcaccgcagcagagggggccagagaaagagcatccaatggcaggagtctggcaaggcgacagcactgccaatgtcacggtcaaggagaggagacccaactctgcctgtggtccagactggaaagttcaaagagaagtcagagagcttcaagtctgaggacttcaaaggctaagaagtaagacccccccccgacccatggaagtccccccaaaatgagctcctggtggaaacaacaggggatgcttcccccttttaaaatagtgatgagtgtccctggtttgagttgagttaggaaagcatgacattttggaaggaggccaggatacctgtccataggtaggaatagcctgtaagatgttgccctcctgcagtgtggctaaatgggacactgccgggggtgggactcagagcagtgggatttttagttttgtcatgtttgcccaaaggtggatgagagaaagacccttgggtgtttgcttagtggcttcccaatgggtgggaaggtgagacggggttggaagcatggagccaccccagcagtggcagggccacagggcagcggttcttccatgccccctaatcatggccacattgtatcagcctgagcatgagcaacagcaccatggccacatacgggaatgggcctcattggtgtaatatttggcagattctctccacaccccccgtggcggtctggcttactgttaagaagggtaaccttaaaaaatacatttcccactccagaaaatactcatatgtggcctgttagcagcacaagaagggtgaaagcaatgcccattcctgcctccctccccctgctcacctccacgtccctgtttgcccctttgtaggtgaagtgagtatattcagcgtcttcatggcaggggagagggtgtattaatccgtctatgtccgctggaaaggcagtctctgagcgggccacaagggttcagccatggcccatccaataacctttttgatgacttggatgaagagacaaacattccaaccacattcaaagatccagacctccaaagtgtggctcatttggtagataatggaattatatttggaaagcatttcccgcagctgggatgatgggtcaaaaacagatagcattttaccagatcatatttgtgtgtgtgtgtgtgcgcgcgtgtgtgtgtgtgtgtgtgtgtgttttaaattcagtttcccaactacaggatggcatttgtagcctttcctaaaaatcaagtttaaaaaaaaaaaatttcttgggttgtaattgacgataagcttagtgtaagcaaatgcagaatgcagctgctttccaaagggcagctttaggctatataacaaaagtgggaaaggaaaagtgttccattgctttttgttgctctaagcaatattaagtcttggttctaagcccccacattatcaggaactttaacatctagagacaattgagagagaagagctagagagagaaagtgaccctggaagccacgtcggaagaggctggagtaaaaatgtctagccccccagcagacttgatggccaccgtgagctctttgcatttgtcttcaagagtggacacttccgggttgctccagagagcaaggctagaacaaatggctagaagatagataggtagatactaaaaatattctaacaataacagaatattccaacaatagactatgtcccctcaaagggcaacgagctccatgtctagccgtttagaagctgaatggccaaggatagtgcagagtaggtttctacaccagatcccatgatcttttgcaactggaattctatgctgccccaaatacttgttaaatggatccgactgcatttcattctgtggtttataaataagtcctggaaaaggagaatgaattataaggaaggagtttgctgagattggaggagagggatctgaaagactcaggactagactccgccttgagggagaaaaagccacaagatgacacactcaaagcaagggaaaccgtcaggaagtggaattactgcccttcacatgtcatccttgccttcttttctgttttttgtttttttttttggcatttgctgccgcagcagctgagctctgggcaacagggctctctctcccgaatgtctgaaaggaggtcagcaagtggaggacacaggcgcccactggcacagggcattggcaaccatcgtgcagtgagccccagcacagccagggtggccatgtgcgtggggcgtcctggcccaaggttgaagaaaactcatcctgtcatagttcccatccggaaagggtgttttgttgaaagcaaaaaggatcataaagtcatttgccttttacccaatgccagttccagattccaggtaaatgagctaacatcaaaaacacctcagccggctgggcgtggtggctcacatctgtaatccgagcactttgggaggccgagacaggcagatcacctgaggtcaggcgttcaagaccagcctggtcaacgtggtgaaaccccgtctctactaaaaatacaaaaatgagccaggtgtggtggcacatgcctataatcccagctactcgggaggctgaggcaggaggatcactagaacaagggaggcggaggttgcagtgagccaagcttgcaccacctcactccagcctgggcgacagagcaaaactccatccccatcccacaaaaaaccccccagagacctcggactgaggagaaactatgcccccaccctggcttccctcctctagggccctgccagggggacttgtcctcagcccagctcagggaaagggaagggttcccatgtcacattctttccagctgtcctaagaaccaccccgattgccgatgacactccctcctctcttgggcttcaccagggctgctttcaactcatcgtgggattgtgtaattatggtgattacagcttgtgacttttttcctctccatcttttgctttcaaattctttgaggcctctcattaaacatggcgatcccggtaaagtcagcaaagttttaataagacactttttacagctaaagaaagcccagtcagggttgattgctactatgttctctcagatactccattaaaactctatcaggtgcagttggtgcctaggtataagaggtgggggagagggaaggcagggaggcagagggcacctgtacttagtgacagggctggagaaccattccacaccatgcccctggctttttttgtttgcactaagcaccaagtacatctgagcccccgtgcctaacaggaaaagacagactgtcaagcaaggaccgaaagcctggccttaacatcatagcacattacactgggaaatggagatggagcatccaagacaacacttaacccaaccttgtaatcttctgcagcaaaagtggtgggggaattctgatacgtgctctgtcctggttaatactagaaggttctgaggcatccataattctaaataattaaaggagtcaatcaatcactagcctttgtgagtcatcacaatccggtggttttacacctgatggaggttttacacctgatggaggtttccttggtagtgattcagcttcacatctcattcttggctaatctttaatcatagcttgcttgcttgctttttgttgttgttttggtttggtttttgggggggtgttttttttgagacagagcctcgctttgttgcctaggctggagtgcagtggcgcaatctcagctcactgcaacctccacctcccaggtttaagcgattctcctgcctcagcctcctgagtagttgggattacaggcctgcaccaccacactcaactaatttttgtactcttagtagagacggagtttcaccatgtcagccaggctggtctcgaactcctggcctcaagtgatctgcacacctcggcctcccaaagtgctggagttacaagtgtgagccaccgtgcccagctcatagctttcttgaatagttatcatagctgtaggacatcatgagaaggaccatcaaggagtgtggcttgtgtgtgtgagccccgtgacccacccttcagcaggttcatccaggttcccctcatttctatattccctggggactacacagatgcccgcacagtgaagtgcatcttgctccagcaggactgtgtttctgagaggtccctgattggctgctcgtggctgaccgtcccataccaaccagactgccttttaccctgcaggtagccagttacctcactacctgtgtctcaaaagagcaaggagctggattgtgactgagcagcaccaaccacctggagttaaatgtcaaaaacgtggcagggacatttcccccaactgcattcccatccactactgaaggtggcctgctcgtgtgaccccttgagaacaacggtccctttagtacccaccagaatgcagagaagtaagctaagttcgagacaggcaaccccagctgaatccctttttctccacctgatattatgtgaccctgggcaagtcacttgcatgtctgacaggtacaacaaagcccactgcacagggtagatgttggcattcaatgaggatgtgatcacaagagctgccatttattgggagctcacactcacagtgttggactgtgtcatgctggctttgcctgggatggactttggttctacttcagctccatcacttagttgtttgaattgcacagcttctctaagcctcagtttcctcatccataaaagggagataagagtaaataagtaggaataaaatgcataacgtccttagcacactgtgtgcagtgcgtgtgcttaacaggtgtagctcttagaatcagtttcatcattatgatattatttgcagctcatacttaggctgcgcttattaccttatttaatttccaacaatattctgcaagataggcatcattatatacatcttgtggttgagggtgggtacgtgggtatctcctatatgacagtctgcacaaggtgcatgtattacagagatcagctcatggtaactactcaataaatggcagctatgattgttggcttatttttaaagtcaactcagagagttagtttttctgcatttcctggaaatgaagggactgtggtgcccagcaggccagcttctgttctatggtcgatttcctggggcccctaagcacttcccgggaagctgtgggaactggggggcttgtcagcctgtaaggtgctgggaggtggggagggccaccaggcaaatggtgcacgtgttgtggggatctggcatttggccgcctactgagttgaaggactcgaaggtgcctcctgctaccagagacagataaggaatgggtctacccaagataagaagatgaaatccactcctccaaatgtagccctccatgtgacagaaacactcacctctcagctgtctgcttgcctggagccaccctgagcaatgcaacctcaacaagtccagttgctccgtcagtccaataaacagaggtttctcttttttaaccacttattccaaagcgaggtagtggaggagtcagaagcacgtggcaggggatgctttgaaattccttgataaaccggacccctggggtgggcactcctactgcctatagtaccgacagaaacagaagtggagaagttgtttatttccaatgaggtcaataaatgcctttttcatgggggagaattccatttttatatatgtattttaaggtgaatgctttaagtttgcagtatttgtcagagtggcatcttaggagctgatagaaaactctacagccaaacaagcgattgcctgtgcaccttgcatgagatgcttctgtaagtgcctgtggtctcaacatgcacatgaacgcatgcactggtgtatgcacatgtgcacaggtgtatacacaggtgcatgtgccgcctgcctgatgttcgcctctgtgttcagtgtatggtgtgcatataaccataagctgcaaacctgcaagtatctctgttgcatggattgcatgccctctgcagctgtgtgtgtgtctgggcaggggctcctctaaagccacaggtcttcacagtttcagctggataagttattcttcacttcccttcctaaaaacacaattgcctagtgctgctggcgcagagtcagaatggccgctgcatttcacccccgaggtggcttccttccagcagtgggtgagtgatcccggcgttcgcacactctctaatctgtggaatccttctgcacagaaggtgttccaaaatccaaaagagatgatctgtttgtccatggcatcgtctctgcccaccactcctgttctcatgccctggttccagggacagtcggcagcacccatttcttggtgtctctgttttttctgcccattttttgtacccatagtttttctctcctaagaaacaaggagctgaggggtccagaaatgatgctgagatgagtcccttgtcccagaggcaatgtgcagataacatccttagatattgacccagtaactctcttctcctagtcccattccctagcagaacagggaatacccactacctttgaagatgcttctaaatccaataacagcatccttaggcttcatttcctggtgaaagcttccataactcttcctctgtgggccctgggccaaatcctgcaggaaacgtagcaatctcacatttctacacactacaccatcaggggagaaaaaagctgggaaaccgcccatcctctgtcccatggggaccaaaagcatctcagcagcacgtgaaaagagcctgtagggaaataaggttctctgtagctaagagttccaatgacctaagtttctgtccaggtatctcctgaaaacgctgcttagtctgttccctggtgtacttcctccggttaggaatccatgtctgataagtgcctgctaaattgcattcctgatagtggggaagaaagaaatgagccggccctctttgcatatgcatccaaatgggcatggacattcactgaattgttatgcttttgtggggggatgagaggtcagcaattctaggctccgccttttcagctggctaaaccaaggaccccaagaaatgtacgtgttttgggtgaacacatttgcaagagataagtgtcctcaggaggatggggtcagagtcctcataggtcctcaggagaatcacatactgccaaccaaataactttctcttgccgctttgtccacaatatcaagtaactaaattccagcttcactgtctcccgtagtcatagtcaagggttacttgaatttcctagttggaaaaaagtagcatcaacttgttgccaatagcaacacagccatgtccctgtttcctagagccttttggtctttgcctaatttggagtgaaccagagcttagatgccagagtccatttgggaaggaggaggagaagaggaacaggcgggcattaagtgggtcacaggaaggcatgccaccgagaggccttacaggcagaatgccaccctcattccactcctgaagccaccaagaatttcctgcaagctgagagaagaaagagcaacagggttgttccgtcagatgagaggagggagagaagagagagctggtgtgaaaagggggcatttccaccacacagggatgcagagtagcagggaaaatggagatgcacaacttggacgcgagaccggggagtctggacctggcattctgccactcatgtagggctcagctgctgagtccttgtctctcccaccatccctacccagctccggatttgtccctgcacagctggggggccatggagaaaggtcccccatcactcagcaaaactgacaggcagaagaaagtgatgagcatggtgaggccagggtcagagatgccaggaacaccagcagggagggcttcctccacctggctgggcaccccgaattaggcacttggcctagaatgatttaaagtggggttggttttcattagagtaaggccaccctgcctgccccaccttagaaagggaaacatcacacctgctcctgtcctccctggggcatttgccatgtgtgttcctagaggcatcagcatcagtaacacagggccacaaacagaacggtgggttcacccagcctgtccagcagctaccacctgaaatctacatgcaccaagccatggtgacctgcaccccagctcaatgcagtaaccaaaagccccttttgccaggcttgtcagccagcagatggcacctcctttctctcaggatttccaaatgggatgaggggaagccgcttcgcagcatagaacctgcctgagataagctcaagcatgctcaagaacttaagttcttttctcagggaagttgagaaaatcaccctgcattgcccagagaggttgcccagtacgggttgggcacaggggactccttcatccctgagtgtttccatctgcctccttccttgagagtgacagccatgtgcaaagtaagaggggcatgggtcgtgaaggccgaccaactcagctttgccactgactagccatgcactcccaggcaagttactcaaactccgtttgagtctgtttccttgttcgtttagtggagtttatagaaatgcctaactggcaagcatgttgtggacataagtaagtgcgggtgcttgtaaaatgcctcgcatgcttgacagacacacaatagttgctcaatggtccatcagcaggtggctgtttgttagtaactgtcctcacagctacctgtgtacctagtgggggaccattcccaccatgccactgtcaaggcctgagtgatttgaagaacaaggcacttgaggagagagggtccatgagctacccgtgccattccatcaaacaggcccatgggagatcaggggataggtgggtccttttacatttaatccagataggagaactggcaactcttcttttgtagattcaaaaactttttaaaatattttaaagcactggtagttgccaattatattagtccattttcacaatgctataaagaaatacctgagactgggtaatttctaatgaaaagaggtttaattgactcacagttccacatggctggggaagcctcaggaaacttacaatcatggtggaaagggaagcagtcttacttggcagcaggcaagagagagcgagtgtgtattaacacttaaaaaaccatcggatctcatgagaactcactccctatcacgagaatagcatgggggaaaccacccccatgatccaatcacctcccactagttcccgctctcaacacatggggattatagggattacaattcgaagtgagatttgggttcagacccagagccaaaccatatcaccaatacaggatagagtaaggtgtctgagcctactagtggtcccagtgacattctgtgggaattgctttcagaagacgtgactgctgggtacctcctccatccccagtgtttaccaggcagagcctgagtgtttacaccacacacagcctgagtctttataccactgtacatgagaaggtaggggtcgggggggcggggtggggggtgctgttgcaagaaaaaaaaatccattacgtttattttgatcaaatttattattttttaaacaggttcagttttaagtattcatgaatgtaccatttattaattctttaatcagtgaacgtctcttttttgattaattcacttttcatctatcccttgacttttttaaaaaaattggggtattgttttatgtttgtgatatagcttcctatttaaaaggggtcaaataaaaaaatattttaaaaccacataaaatgcccttaagcccctgcgagagttgaggaaggttgccaaggccctacaagtaacacagaccccaggaatgggtcagccacaggctcccgcccctcctcactgcggaagggtgagaaagacaggaatggcctctcttccttcccatgctgctctgacctacctctgttgtggaggaaccataacgggttccatagcccggtttttccatttcctatgccccaccttgtttcacagagttgagttaatagagggtgataagaaatagagaatttaaaaagtgttttgaaattattctaggttaagtgtggattttcccaccatcccctgccagcgtttctccgacatctcagactgcactctctctccccagttttagacatcattgaggaagaagatgccacggaattctttgcattcccttttaaaatcatttcttttgctttgctcagtggagaaggagcaccaggggcagcaaccttccgggagtcacccgatgaagtcaggcaggcctttggcttctcccatcctgctgaacccaagccaggatcccctacctttccacctggctcttgggctcctgacccttatcctcagcaagtctcccccaaccccaccccaggcctctaattccacacgtatacatcctttatgaacttgagcaccatctattcaaaggtgaccttcaggctccttgagagcacgactcatctctctctggggcctccacttcttgcctgctaagttgcatggtgagctgtattcaacgaaacacgatttttcatgagcagggatggaaaatgcctgtgtgtcacaccaaagggatccgtttgcatcaatggaggctagaaatagtgttccacattagttctgttgcgagttcgaattccccaacagaggaatccaggttcctcctgtactggagggggaagcattgaatttctccaaacccagggatgggcccagcaactgaagaagggtaaggagtgggaaattccaaggcatagatgtcatagctgggacttttttttgtcctaattttttttttcttttgagatataattatgcacggtaaaatgaacagacctgaagtacatggctcaatgaatttgacaagtgtatgcacccgtgtaacgtataccccatcaccctagaaggctccttcatgtccctttccaatcaatttcatccttctcccccaggggcaaccgtggttgatttctttcccccataatagcctggattttgatttggcagacttgagatctgtaacttcggtcttagttcatctgagcagatcagcaaaagaatctcatcagaagctcagatgtctttactctcttagcattgaaaaagatcctccctgagccgctagtgcttggctctgctgtcccccagtatgccccaatctgacccccagggctactctctgagccacagccctcctcccagccaaagaaagagtttagcatcagtctcccaggtaagtaagtggcaaaagctcttggtaacccagatagtgcatgctttgttgattaatatgtggaagtgcaatgcacagagccacagcatgtcaagcagcatgttgatttttctcactgcacaaaagggggctattccttttgtgtgtttcctttcagaaaacaaaggattccatgaccaccttcttccaggctcctagccatcaagatggccacagagctgaaatgattaatcagagcggagggtgggaattgaatgtgtgggtgttagtgaacccagcactgagcccatggtccatgaaattgaaggatcccaaattctactggattacactttgccaaatgtctcaaaggtgaaaagcactttgtcggtatgcaaagctttggtgtctctggaatgtaccttctgcagctcagttcttaatcactgtatattttttcacttggacaaaggctgcctgctaatagcattttcaaccatcctcagctgcttcgctcagctacgccaaggcctcgggctgagctggctgcggtttcctggcaccatgatccattcccaactgaccaacactgaggaacattacacactcacaccctgaaaaaaacctgcttcctctgtaactatgcaaatgccagacacaggcaggcagaattaccattccccttctgaagtggttccttcaggatcatccaaactggagacagagatgagagtaaagagacggggcagtgccctggagggtacaggcaggagctcccctctctctgggcacagcggattcctcgggagcttcctgcaagcctataggggcatgcactttggggcagctcatctctgaacacaggtagcctctactatcagatttcactttgatcactgaaaactacaggagtctcagctcttcagaagggaagcagctgctgagcaagtgtgattgcagtatttcttccccaaagccccgggccaggcatctacccatgcccgcatcctgcatgattaaccgccttccagtctgagcctgccctcactcacgcgggaggtcactgggtagcgagtagattgcagctgggctgagctgcctctcaagccgacctgaaccctcatgacctccatctttagcagcaagctggcatttggtaaatgcgcgaaagcaggagtggggagagggagacaaaaatgccaagcagcaccgcctgggttgctgagaggttgggaacaatcccaagggtggcccctaagctggtcagctgcaccatcctaccctgaaatcctgggaaataaaagcagtcgggggaagcgaggagcgggcagtgacaggctggccacaggtccttggagtcagagcggtgaggctgagctccaggatttagtcaggaagagaataattagcaccttcaagcccagcccagcccagcccattctgtagaaaggggaagggttgagggtatggaagcctcagggccaaattcacctaaaacaaatagacacataatcctccagaaatagaatctccaacctccctcaacccacagtcccctctccagccaaaataaccttgttaataggaatgaggctgcagtgaaggtttgggcaactggtaaacctcacctcctttgtctctgggctttgaatgtactcattggcaacagactcttattcagaagcttgagtgattttttttttcccatccaccagctaaatgagagccccaaacgctgtggatagcaaactcagaacatatatatttgggtacataatgtgtgatttgtggccctggcgaaggagggatgggaggaggaggaggacctgatattggtgtgtggtggttatcacagcaataagtggcacctaaaaggagagcaaacttcctttgtgcctttcataggacagggatggacataggtaaccgggggtaggggaggtttgtaagagctctcacacaaggaggcccctaggctcagcagccccgtgtttccccagcaaggatgccccacacccccatgtttcctgccttcaggcctgccccaggaaggcacattcccgagtgacaaatgcctcacactctatgtaagaaagggcactcaaggagagtcaccgctgggtgtgtgccacagaacccggggctggggggagcccttgaaggtcagcctctgccttctaagagctattgttgtacctaacctggtctagacaaaggagtagtcattcttagtgattttcaaagactgacaccataaccctcttggattttttaaaaatctgattaaaaactccttagccaagtataaatgtatcctgctgcaggctaagtttagtgcacttgaagattcagataaggttgctgatggggtgattttgtggacgtgtgtgtgtgtgtgtgtgtgtgtgtgtgtgtgtgtgtgtgtttaagatggggagaaaaaatgaaaagttttgtctcactagtgaaaatggggagtgaaagcaatggggaggaaaaaggtcaaggagaggtagggaaaggcagactttctgacagctcctgagggcaatttcatttttggacaaactcccatctatagcaccagaattctcaaagtcaggctggccatgcctctccatggagatctaagccagatgccacattgtcctgtatccagcaaatccacagcccgtgttgtttattagataaacccgttatccatcaattcatcaatcagcaggtttattgaggaccctaccaggcttcacaaacctgatcaattttttaaattacatctagcttacacgcagccaagcccagtaaacaagacgagccctcacaccccacttggaaatgaacatgaggaatcgctggcccttgcaatctcacggccaaacactgcagccccatgctgacgagctatcacgtgctgcccttcacagatggcggtggtgtcgctgacccactgtcaataatatgggtttggagtgctttcccagacacagtgatcaatctgcctgggtctagccatactgtcctctaaagccctgtgcaatgatgcggatttctaaagagggtgagctggagaacgggcacacactatgtaagggcaataagcaaagcgacggagcctcgctcgtgcccctcaccctcctcctggtgcccagtcgcaactcccctcctagatcaggggcttctccgccatctctccagggcacatacacaacgggactctcctggcacctctatggctgatgcaccaggcctcatgatccagttcactgttttagtttttgagaagaactgccacatgggttatagttgaagggcttgtaggctttcctggtatggggtcatcaaactctgcctctgggtgccacagatgggaagccaagaacataggagacagcaggagtgcactgccctggggcctacagtggctctgagccccagcaaatgccccccactttcatggtcccagaactggtcatcaagaggactcaaggtctttgtgtctaccctgcattccaaacaggactctgccttcttaagactagttcattcattagcttctgatcagccagatccttggccaccctctatttgagtcaagcccccgtccctgatctcagaacaccccaagtccaccttttcctcccccacgtgaacaaaatcaatttcagggcagcccgccggcattaaaaattgctctacctaaaggtttaaatacctggtttttggtaagtaaaattcccataccacaaaaagagtaccaacaacacaccctcataaggggaccctccaggactccctgaaccttccctggagccctggtttctccagctgtccaaagttaaggctcccatacacctagagatcaaatatcaagatggtcagttgggttggttggtcgtttggcctacatggctcatgcaacaattaattcacctgtctggctctctgtctctgtccctctgtgtgtgcgcctgtgcgtgcctctctgtcgctgtctctctgcagggaaagtcgctggcgggcaagcgcctcacgggcctgatgcagtcctcctgaccgttcctaccgcaggtccagggcctgggcccgcggaccccacaggcaggcggcggcgctccacatctgcggacagagtttccttacgaggagacttggtcactgtgaaggagaaagagtgagggcaatgaagggcgatggtggggagactcggtgggtgaatggggagaccagaaagaaagagtccacagagcctgggctgggcccggtggaggctcctgtttacagccctctcttctttgtacagttgtattccaacactccactcgctaagaggccctgatcccagctcattcaggggagaacacgtcgtggggttcctgtcacgactatcacttgagattatattattatcctcactccctcgctgtctggagacggtcacaccttctggcaaattcaagaggcatgagtggaccgagagcacatccagcatttgcatcacctccctggcacctcccatagttacagccactacatccccaccgccgcctgtcatccctcacgtctctgtggccacccgggtgtcactgccagcaccaggcactgctttcacgtaaaatgtccaaatcacatcttcagcaagaaagcaacctcacggattgccccgcctcaaggtctttccaccctctttgagatcagcgttcggagaggtccccgccagcccggtggctgccctcaggtcccgtcacatgtctcaagggtccagcgttcgaggaagcactgttgtagatgacagagctttttgtttcacagctgcggggattctgctgaccatcttttagaaaattatttcataatttattctggctttgcccccttgctccttggtttattccctcatgttttactcaaaataaacatggccatgaactcaggggccattgggattctcccctctggcagccccaggtgggagctgggagggtccccagcccaggaggtggctggattgcagggctggcagcccccacgtggtggcatcctgacaggcacagtgagacccttgctgggtcaggtctcctttgtgtgtgaagctggggcagagtatgctacgaagggaccaggccaggccacagggctctcctcccagtctttatctgaaggcccagccaaagcacccctctaaaccggtcacctaggggaaatgcaaaaacctgcaaaagatccacctgtattccctgtgtgtgtgtgtcaaaatgaccatttgccaacctggctgtgaggtaatgtatgtaaagcaccgagtcaggtgcctgatacgcagtaggtgcttagcaaacggtagctaatactatcatcattgtcattgttattgtgacacccatgagcccacagacagagctgtattaagtaacctgttttgaatccagacattcactcccccacttgctatgactaccctcctttgatctatttttggtcataggtaaaaaaaaaaatctctcttgggagcatataaacaaaaaacatagaagcaataaagcgatcgctggtatttcttttctcatgcagccaaattcgccagctggtgaccaaaggctcagatgcttgcttatttgcagacccggcctcctgggtgctccccagtgacccatctttccaccccaccacctccaagtcctgtctatgtctgcttccacacagccctgtccccagggcaccagccttctgtccctcacagcagtgccatcgcgggcattaggagtcttcgttatgttgtatccttgtgagttcttgactaccatgcccaagtttcccccactggcaatggttcctctcttggaggtacagtggaaaccagagagatgacagatgttgagtcctcagtgtctcagaggcagcaattcttgctggacacctgcacatgctcagcacagaggctggtactttggaggcactaaccacttgatgagtaaatcaatggcataaagccccattccaagttatggggtcttttgacaggcccctttcatcctctttctctttgtataaacctcatgtttcagaacaaaattacagtctaagttcatttgcccccagccttgcccaaggatccccgggctgtgctgacccctaggcatagggcaaagggtgttcccaagcagcaggcacctcagtgccctcagttatccagggcaaggggcctggctgccccctgctcctccccatgatgcaggggctttctaagccaggctgcagacagggcagggttggcttcttggccattccctctgtgcccccttctccttctgactggtctcaccctggagatccccagaggatctgaccagagccaggtggactgtggccctgagatggagctggctgcaggcttacaagcacctctggggacatccagaggggagggtcagtaagcacaacggagctagggagacttcagatggactcaaacccagagcaataatactctcacaccaccccacagctaaggcactcatgttccccagtagatcaagccagaagctttgcaagaagggagtggaacgaggctgcctatccaaggtccatctaccacgcagaacttggtcatgcaagtacatttggaaaatctggtcttggcccgtcccccattggcctggtctacacagccaaaaattcagactagattagatgtttgcaggcaattctgtagcaaagcaaattcccctaccccgtcccttccccctagaagctgccttagcctccctgactgggtgtggtctctgggcctaggactcctccctatgaggaaaagtgctctccagccacatcttggcagccccacaaccacagcatcagggcagctgcagcaagtgaccacccacccgtcgggttagacacacaaggcaccaggcactggcatctgactaaaataacctttccctacatgggaagaggaaagcttgtaggctggcacatataaacgtccagccgcagccagatggcctgaactaagcagcaggaactctctgggctggggaggagcctcctgcccttctagaaagtgatgcgtcagctttgttctcctgggaaggtgttgctataccccaggaacaaagcagggcccaactgccagtgcagtcagctgggcctgcgctccaggctcaccaccgctaagtggtcaggtaccgggccagcatcctgggagggacctcttgcgactctgagttgcagcttggactagctgaacacatggggacatgctccaggggcttcttccctggcaggattcctgggatttcaaactacctcaccaacaggacgctgaaccaggagcctgccacccaactggcccccttggtgattgtggaaggtgatgtttttcctaaaatgcatccctcctgttctgctccatatacatgtgcttcaaaaaccaccaccaggaaagccttcccagaagagggaaaggattaagggctctcttcctttgggccctgcagaatgtattggagggaggtgttgctgcaaggtccaggagctgggaaactctgggctcggggggagataatgcaccaccagcctcaaaaaggagctgcccaagttgaatatgtagcaaagaccatgggataagttgaatagtggccagacgaatcactaataactcaccatgggaccctctgaagagaggcctgtgctcgtgtaaccatagcaacagcagatgccagcaacctactcattagtaccacccagtgataaggcatcccctgggctagacccaggggccataaagtagcaaagtagcaaatgtagcaataaagggcccgggtctatacggggacagggtccaaatgaccaggacttggccctctccccagccccgatgagggctcagagccagctgctgtcagctgtctggggagggaaggccctgctccataccaggggtccctgttctatactctaagcccactcaccgcatgatcacggactcatcggaatggcctcctcttagtgcatgtggttctctttagtttatttttctggaatttggggattggaccccagaaccaaacatgctggtacagtctaaaaataaatgacttgaacccacttcaatcca

SEQ ID NO: 2371 - DNA, 634084 bp, Homo sapiens
cgcgagttggggcagctcctcgcgctcggccctgctcggcggcgagagctccgcctgggcgccgcgttcctacagccgccggagccgccaggcgccgagggaacggacagacctccgcgcacccttgccgaccggggcgggcagaggcgggcaagcggcgaacgcctgggagcgcggagagccaggccagcccggagcgcgccggggacaccctgtgcgccccgagtcccggcaccatgcgacccgccgcgcgtcctcgcgggcccggggcttcgctcttcgctcgctgagcccctgcgctcgccaccacggaaactcggaaagaggaggcgaggctgtggggagcggcgcggagacggactagacttcccctccgcccccaagaggctgccggtccccggttccctgggcttctccagctttatcatgaacctggcgcaaggttggctttaggaaaaattctggagccagagggagagtcaaggcaattctttggttgctaaggtaattgtagttgtgataaaaaatgggcaagaaacaaatgggggaaaaacatggtttaaaacagtatcctccctccccaccccattaatatgtgttgatttcatctcctgggtgtgggtgcttgtccatttcagatgcgtgacaggtgcccgtgtgtgtgtgtctgcagtttgggactgtggaagcacgagcttacataagtggttaggcaagctggcgtgtggacttgtgtgggatgggtgcaggtctgcatataaatcatgttcctgggtttctgggtgtgaagcgcacaccgacggggacgagagcgcagaggatggcgcttttagatacttccagtcttccgatgttgtgatcgcaggtagggcagctttgcctctaatcaggcgttcattaactttttccctgaacaagctcgcccatttgtggtttggaagaaaagaaagcgagtctccgcggtgaggtgtggagggcaggggcgggtggggaggtttgttgtttgggaactgcgctagcaaaggaagcggtggctattcgcttggagaggatgacaaatgaactggttgcgtgaggagtgaagagaccgtgtttacagtcaccagcaggctgcgtaaagaagtggcccagtgagacagggaaagtgacccagaaaatttagttttgttcagaatgaaagctgctgtatttcatttttgtttcttaatttgacggagtaggaacgttattttccttctctgtcattgagaccagtagcatttctatgttacaaactgaagatatttggggtctcgtcggcttgggattatcaatgcttgggaggtgagttctgatcaatacctttaacaaccccaaagaaaaacgcaaaaataatcaagtttaggtaaaacttccactggactttctttccagggagggtgagagatggaagaactgggcttgtaagtatcaaaatggagttagagaatgagctacaagtttgtgtgtgtatggtctgtcaaaaagtgttaagactgaaaggaaactgttaggtttagttaaatgtgttgacaacacggctcttacatatcaattttcataggcaaataggtaattacatagagtgggaactgggactatggtgggaaactttctgtaagatgtatattctttattcttaatttatcactttttcaatgggtgggactactctgtgaaggaaagtagagggctgagggacatttggtgagactcttgagagagaaacctttgcaagccaaatctcgcatgctatagatgataaattctaagttctttgatattgtaccactcttaagctaaattgtcctgtaaatatgatctcatgcaccataaactatatatatgtagagagagtctattcccaataactcatcctttcctgaaagagtctgcaagttctataaatgtcagctgttgggaggtattgtgatgaaggagagaggccaccagtgtttccttttatatatttattctggcagatcttaactttacttctgattttctttaaggaatttcagttaacattcactgaatttatattgctgagagtttcagtaaaacaagactagattttctttgaagcaataaattcatcttatcaagtgaaacattatgacaatgcttttgtggcagaaatgtttatttaaatgagtccattttaattatttatttatttttgacttgcagaataagatctgcaacatagatgtttttgaagtaagtagacgtttcttgagaaagaaaaataaatttaggttactgtggacaatttgccagtaattttggatgtctctttgtctacagggacataattttgtgtgaaagtagaatcattccatttcttatgtctctcatcttctcccatgcattttatcccctgaactcctaagactttgccaggaattgctgaacattctgtttcgtgccaggggttaaatatcaggggatggaataaggagctgtgtgtcacataaacatttttcaaaaggatgctgtcagagatctcaataccgggattaatttttcctttagctttgcagttagcttgtcttaattggtattgctctgaacctaggaatgcatttaacctcttcattttcagtttccagctggaaggaatatatttaccaaatttcatcttctttgtaacatatggcatgatataaataattactatacacacactatcctgctgtaaggaaagaaatagaattacaaaatcaactttcgtgttgagtgatatggatataatatttcaaaaaacaattttaacttttcccctgattccaaaagtaatatttagctattgaaacagttcaggaaaatacaaagaaaaaaataaaggttatccataatctgctagggagagggagccactgttaacatatctttaactgtatattcttccaaatattattctagtcaattatttctacccagtccccctcccccacacatttttataaatataaaatatagcttggaaatataacttggaaatgtgttaaaggcttgggaatttactgcttgtttacagaatgattttgatcagatattagtttttactggtggtccttattttcaaaaagagtaggttctttctttttctgttctttgaaaacaagtgtttgcactttgggctggtaatgcttggggcttccttttgaatttagggattaaagcatcagaaaagaagtagaaaggtcattggccattgtgggtgggagacctgagttctggttgcagttactccaacttctcctgtggcctctgggcctctgtttccctaaagggcaaaaggtacttttagatttaactaattaagctaatgacgtatttattgctttgacatgagaatgatctttgaagagggcttattcaaacacagaaacacctgggggtcatcctgggagtctctgattgattctgtctgagatggggcccgagaaggtacatatctaacaagtccctggatgatgctgactgctggtttggtgacagtgaaaactagagggttaagtgtactagggttctcttagagggacagaactaataggatatatatatatatatatatatatatgtacatatatatcatatatacatatatgctatatatatgctatacatgatatatatacatatgatatatgtacatataccatatatctataaaggggagtttattaagtattaacttacatggtcccaaggtcccacaataggctggctgtaagctgaggagcaaggagagccagtccaagtctcaaaactaaagaaattggagtcagatgtttgagggcaggaagcatccagcatgggagaaagatgtagggtgggaggctaggctcatttctccttttcatgtttttctgcctcctttatattcgctggaagctgattaggttgtgcccaccagattaagggtggatctgccttccacagcccactgacacaaatgtttaatctcttttgggcaacacccacacggacacacccaggatcaatactctgtatctctcaatgcaatcaaggtgacactcagtattaaccatcaaaagcccaccccttgtcaacttgaacccatacatatctcctgagatcatacataatcttcaaataaagacaataatgaggtcaaaattgtgcataacataatacaactatcctttgtacaaccagaaatgcaccaatccccaatgcaaatactattacataaagttaacaatacttacatgctgttgtgaagtcaataaatcttatgtcacatgataaaggaaaaggaaatgaagatattttcttagtatgagtgtatatatacacaaacatgtttttaacaaaagaaggaggaaatactcttgacaattacagtctgtttctgcagctggtcacatggtcgtagctggtattgatgactaccttcttctacccattcagtattccttttgcctacagcaagcacctcagcaggttcttttccctggtggagtgacccaaacctttattcctgaaggatctggaccatttgtagtcccgcctggattgggctgttgtagtttcctgttgaccttaatcacagggcatggtaatactgagagatgccctaatggatttcctgtgttccatatgtagtcttccttacctctgctgtggagtagtagactgatttcctcttgatagtccaggtcaatcatgccagccaacacagtaattttcttcttagcctgttgactgaaagataggagtatcccaaactgtccaggtggcaatcttaacttccagtttaatggaatcgttgtgtttcctggtggcagtgttcctccctctggaactaagatctctaggccagcagaaggtaatgtcttgggaacaggaagcaaaaattttgctagtggatcagtaggggtgatggtgagtggtgccacttccacttccgccccttgattcctggacctgtgaatcctggctataggagaaacagtaccatatattggatgctgattcagagcatacacggccctctggagaactctgccccagccctgcaaagtattgtcacctagttggcattgtaattgtgacttcgaaaggccattccaccattctatcaatataactgcttcaggatgatggggagcatggtaagaccagtgaattccatgagcatgaacccactgccacacttctttggccataaagtgagtgccttggtcagagacaatgctgcatggaataccacgatggtggataaggcattccgtgagtccacagatggtagtcttggcagaagcattgtgtgcaggataggcaaacccatatccggagtaaatgtctattccagtgaggacaaacctctgccctttccatgatggaagaagtccagtataatcaacctgccaccaggtagctggctgatcaccctgagggatagtgccatatggaggggtcagtgttggtctctgctgctggcaatttgggcactcagcagtgatcatagccaggtcagccttggtgagtggaagtccgtgttgctgagcccatgcataacctccatccctgccaccatggccactttgttcatgggcccattgggtggtgacgggtggctggggaaagaggctgagtggtgtccacagaacaggtcatcctattcacctgattattaaactcctcctctgctgaggtcacccgttggtgagcacttacatgggatacagatagcttcacagtttttgaccactcagaaaggtccatccacataactttttcccaaatttctttgtcaccaatttttcaatcatgcttcttccaagtccctgaccatccagccaagccattggctacagcccatgaattgatatataatcgcatattgggccatttctccttccatgcaaagtgcacagctaggtgcactgcttgaagttctgcccactgggaagatttcccttcacctctgtccttcagagatgtcctagaaaaggcctgtagtgctgcagctgtccacttttgggtggtgcctgcatatcgtgcagaaccatctgtgaacaggccctagtcttctcctcctctgtcaactgatgatagggaactccccatgaggccgtgggtgcaggctaggggagagaaggcagggtggcaggagtggagaccatgggcacttgagccacttcctcatgtaacttacttgtgccttcaggacttgcctgagtcagatcacgtatataccacttccatttgatgatgggatgctgctgtgcacaacccactttatggctagatgggtcagaaagcacccagttcatgatagaaagttcaggttgcatggtgacttgatgacccagtcaaacgttcagtttccaccaaagcccagtaataggccaagagctgtctctcaaaaggagagtagttacctgcagaagatgacagggccttgctgcaaagtcctagagtactccactgtgattcacctatgggcgcctgccaaaggctccaaacagcatccctatctgccactgacaactcaagcaccattggatctgctggatcatatgtcccaagtggcagagcagcttgcatagcagcctggacctgttgcagaaccttctcctgttctggaccccactcaaaactggcagcctttcgggtcactcaataaatgggccggagtaacacacccaaatgaggaatgtgttgcctccaaaatccaaataggcccactaagtgttgtgcctctttcttggttgtaggaggggccaaatgcagcaacttatccttcaccttagaaggaatatctcaacaggccccacaccactggacccctagaaattttattggggtagaaggtccctgaattttagttggatttcttatcctctggcttgcaaatgtctcaccagtaagtccagtgtgtttgctacctcttgttctctggatccaatcagcataacgtcaatgtaatggaccagagtgatatcttgtggaagcaaaaagtgatcaaggtctctctgaataagattatgacacaaagccagagagttgatatacccctgaggtaggacagtaaaggtatattgctagccttgccagctgaaggcaaattgcttctagtgggccttatggacaggaatggagaaaaaggcatttgccaagtcaatggctgcataccaagtactaggagatgtgttaatttgctcaagcaatgaaaccacatctggtacagcagctgcaattggcatcaccacttggttaaacttatgataatccactatcattctccaagatgcatctgtcttctgcacaggccaaatgggagagtcaaatgggaatgtggtgggaatcaccatccctgcatctttcaagtccctgttggtggcactaatctcctcagtccctccaggcacatgatactgtttttgatttgctatttttctaggtagaggcatctctaatggcttccatttgggctttccccccataatagccgtcaccctactagtcagccaatgtgggggttctgccagctgctaagtatgcctatgccaattatgcattctggccctggggaaatgaccacaggataagtccagggacccactggacacactataagctggacctgagctaaaactccattaattatctgacttgcataagcccctagcttaaatggaggaccacaatgatgttttgggtcccctggaatcaatgtcagctcagagccagtgtccagtagtccccgaaatgtctgatcattttcctttcccgagtgcagttaccctggtaaaagaccagaggtctccttggggaaagatgagagaaagatctactgcataaattttcagtcatgtagtggagtccttccttaaggggacccagcctcccctttgtccaaagggttctgggtctgtaaactggctcaagtctggaaattgaatgaggagccgtgattctctgtttttataattcaaattagtcttttgtccattcaacctagaagttttctgtttgtgtaattgaagtaggaatgcagtaggcttcctatcaatttcacttttaggaacaccatgattaattagccaatgccagagctctacatgagtcagactattctgattgccactttgcctctgctgtccattatggtagttatgctcaccttgcctttgatggttgagtgctgccacttgacccctgccacctggtccctgccacctctggatccaattattcccattttgtagttgagtgactgtggttcccaccattagatctgacatacagagaatggcaattacagggctcttcaaagatgcaggtgctgccctcccaagtctattttgcaaggcattggtcaagggtatatcttctggaccctcccagctgggatgagtaggtctaaagggactaatccactccaccaccccaatctccctaagcctttggattccttcctgtacattaagccaagggagatcaggcatttccagctcactcacagtgggccgcctttaagagcttgtgtctatttttccacaatttcggctctttctctaggagataagactctcacttagtgtaatcttagcagatttgaggctcagtatctgcttctgaagctgggagacagaatccctgagttcatcattttctttcatcactttgtccgttgaacttaagagcagccaacctgcttcactgtgttccttggttctccacatatggtcaaatgtgctatgtacagagtcgctaaactccctgcctctcatgagcggtgaattaggagtgtcaaaggcatttattttgcataactctctaaacagtttctgccaaggactatcagtgttttctatactattagaagtagagtccttagcatttttgggtctaatcatattaagcagccaactccagaaaccccaaaaccaacgaaagaactccattcttaatattctgttcatctagaaccactcctggtaccaaaatctgtattaggtttctcttagagggatataactaataagatatatatgtcttagggagtttattaagtattcacttacacaatcacaaggtcccacaataggctatctgtaagctgaggagcaaggacagccagtccaagtcccaaaactgaagaacttggagtcagatgtttgagggcaggaagtatctagcatgggagaaagatgtaggctgggaggctaggctcctctctccttttcatgtttttctgcctgctttatattcgctggaagctgattagattgtgcccaccagattaagggtggatctgccttccccagcccaatgactcacatatttaatctcttttgggcaacacccacacagacacacccaggatcaatactccgtatccctcagtgcaatcaagttgacactcagtattaaccatcacagtaagctccttacaggccaaaatgcctgtttgacttttcacaggctttcacagtaagctccttacaggccaaaaagcctgtttgacttttctttgcagccatccatccagtgccccaaaatatacctgccaataggtgttcagtaagcattggttgaatcaatattagttttctcttatggaggaatatctttctggagtagtcaagacaaaagaataatcatccagaatttggaaacattaagcctgtaataagagttataatcattcatggaccacactacttcaaactgcaaagaaagcaaaaatgcttataagtaggcaattaaattgaacattaaacctaatgagttacattaaataataactaggaatacctgtttgagatgttacaaaccacaaagcctaccaaatacttcaccgttacctctctcaggtctggaagaggccatttattttctaccacatacacatatttcaaaaaatggaagtttcactattaattaccctaattaccaaggcagcagataaagcaagcaatctccttgctcccctctcctcatcccccatccctcccaccaagaaaaaaggctcattagaactctaccaccattctataagataggtcccaattttatgaatgaagaaatgtaaaactttagagaaagaaattaacctgcataaatccacaaagtgaagtagcagcatcagaagtaagatccaggcctcctgataccaaagggtgttgttctttaccacttccctctggtgacattgaatgtgtatatttgatagctgggagattctagctggctgaaataccccagttagaacttttgattatccttatgtggctaccttttatatagaaaatatatcttttccttctacttaggtgttagtaacatagggtggtaccaagaaccaccatttttatgtgtggtaacttcaaaaaaagtgtaaatatttggatatgaacaaaatagatcctcattcattaatagctcaggctatgcaaatgaattgtcttagaggctgtcttggcatttcacagtaatttggttaaactatcaaagagaaagccacctttaaatctgtccatggtagagttcactcattcactagtatctgcttgacccaagaacctattttcttgcacacatggaagcatgcattctacaaagccagctgaggtgaggtcccctgcatgaatgagagctggtggtggcactcccttggaaataccccaggcacctgtgttgctctcatgaagacctggctagtctggagctcagacagagaactgctattatttgttcttaaaggagcacaacaggcattttaaaatcctgttaattgtgtttctgaaccttagttttctcgtctgtgaaagaataatttaaaaaataccctttgagtatgtgtgaccatgagaatagaggaccctgtatgaagtatggggcatagaaagcacagacacgtaagaagatgggactgtcacagcacagttcctgttttctaataatttttagagtgagtctgttgagaaataagtgtttcaggataatggttcctctttattttctgttcctgaggcattgctgtgttagtcaagcatttgatggactcccaagtctctgagaatcctgctccatagttctcacattgggatttgaggaggcttgtagaaagcaagtggcccacacatctaagtgggagaaggcagcgtgggcaagatctctgtggtagccaaagatgcctctgtttcctggaggcgaaaggccattaatcaccagcaggaagagaagtgaaaaaggagactgctgctgcattgatagggcttatgccagacacacagagcaagcccatgttttttctctgcatccttgggatttcttacagtgcttggcacatagtaggagtttggtaaatgtttgctgagttattgagttgcagagtgacagctgtgggtggaggaggaaggatgggctagtattggtaggaattcatggactagtgggggtgcatggattggtatgagtgtggatgcaaggtgcacgtggttatagccttcattcttattgcttgcttgattttgcctggcaagatccacttcatatccatgatatagtgagactgtcatcctagtttcacattattgtgtgtctattccattgggctttggtcggtttggcttttttgttttgttttataatttatgtttgtaattttatctccacctctagcacaagaccaatacacatagtaaatgcttgataaaaattcgttgcctaaacaaaaacttgctcagcctacaaaactatgggtccgtcatatggttgtgggctgatcttacaaaataacaatcagcatttgttaagctttttgcaaatcaaagtcctttaagagatgttgggtggtattatgcccattttatagatgaggaaaccgagtggaaacgaggttcagtcacttgccctaagtcagatagtcattgaggagccaagatttaaactcagatcttttctgaccccaaagtccttgtgctgttttatatagcacaaggtggggaataaacagagaccctacccttgagatcatttcagttgtattggagagatgataggaataaatagaaaattagcaataaaagatgttaaatgatagtttaggaaaaaatgcaggggattttgtaagtcagatttggtagcaaatagatgatgaagacagtaagcacattatagtttagttcagagacagcattttatcatcagatctggaagagacaggcttcaggaaataggaataaactttaaaggtgcaaaaagggataatggcaaagttttcagatgaaaggtgttaataatacagtcacgtgtcacttaatgaccaggatacatttggagaaatgtatcattaggtgattttgttgttgtgtgaacaccctagagtgtacttacacaacctagatggtatagcctactgtacacctaggccatgtggtatagtgctcctaggctacaaactgtgcagcatgttactgtactgaatactgtaggcaattgtagcgcagtggtgttttgtacttaaatatatctaaacatggaaaagatacagtaacaatatggtgttataatctcatgggacccccttcatgtatgtggtccatcactgacttgtggtgcatgactgtaattggttattaaaacaattgtttgatttcagagtaagggctaatataaactccttatagttaaagccatctcagaccaccctagctaaaataataactcctgccccttctcattgctcttcattgtcttacttgccctatttttgatcacagctttatcaccatgacattgcattatatgtacttatatattgtctgtctccctctgctagaatatacattccataaaagcagggactcttttatttcctgttgtagattcagcatctgtcacagattctgattcatactaattgtttaagaactatttgtgaaatgaaggaagaaaatgcattttaaaaatgagttgcaaactcaaacactcaatagaccagttaggtaaaggaaatgagggaagcaagtgaggtttcttccacaatggtaacaagttgtaatttttacaaatcaaaagcatgttttgtttgtacattacacagatagaaagtttttactcccagaaatacatttatatctatttttcttgaaatatggggtcatctgactcattgtcaagagagacctggataccaaataagatttccttttttctagaagcagaacagccatccacgtgtgatgatgaatggcacctgaccttggatctcagggttggggttgcattagggacaggtggagaatgtgtttaagcgagaagtatgtgctgctcagaaagccctgttgttgccaaattttaattcatttaaaaattattaaccaatttcaattagaaaaatattatgtatatctacactgcccaatccaagagaaacaccttttgagctggctgtattttatggtgtgacctctgtagaaaaaaaagattaaataacatatgcaatatattttctccttaaacttctatggaaatgctacagtgtttagattccaaatcaagcaggaagatgccattatattattttgctgaccatacatcctaatacaaagactgattcagcagctggtcaaaatagaaaggacgcattcacaaagaataaatatattgattacattttagacttttttttaggtgaagggactttcattttcaggatagcaggtagtttagggcttggctgttggtttctgccgatagccaggggtatgtgacaggagacaaagtagctgaactctcttgatctgcattcttcccagttgcagaatagggctgagaaattgtgattgctttgagatggttactgaaagagagtgtgtacctggaaacaatctctggtttagtcaactattaatggggttgcgggggcgggatgttccgtaccccaggtcacagctggcctggggtctctgctgctcctccccactccttgtcctgctggtccgtgtcagacagtgcatctatcttcctaccaaggactcatttccagataatgattaattggatatggctcctgtgttcaagaaacttaaaattctgaagaaggaaaacaaatggagagacggaatgtggtaagcaaggcctatatatggaaagttagggagagatgacttcctgctgagggatttcactgaagaggctaagtagatgaattggactttggaggacctagaggtctggggcctgcagaaatggggccaggggacagagatggcaagaatgtacttggggcatttcaatgtaaacaaaattatacaggtgatcaaatgcaaggaatgtgcaaagaatatttaataccccccatacagagtgaggtccttaaaaacctttctggcaggaggagtccgtgttgatgaacttaaaactttaatgaaaacaaggataggggaaacctaggtttaagcaaaactgttcaataagtatttgtcatatttactgaaagtaaaatgagaaaacaaaagtagattatgagtgacattttactcaccttatgttggtaagagcagtgtgccacagtgaatttccagttacttcttgctgtttttcaggctgtcagccccccttacagtgaaatgcttacaggtagttttgctttattacagttagtgtacaattcttatgcacaagggcactcctccatgccaggctcactatacaaatgttcaatgcctttcagtcagagaggctgactgctgactcctgggtctccctgtggctaaagggtaaagtggatagatacatcttggggtaaactttatttaacttagttggcatgactgatcaggaagtcctcagatacctcacccccatgcctagggtatttagtgtcatgccaaagcatatgctgccaattccaggttttcattttttggtttcctttaagctttcaaaagcttctctgcaaaaatcacttccgctgcctgccatctgccttaaaaccccctcccccacttaaaaaaaatctgtttctaatcccaagagtcttttttgttgttgttttcgagacagggtctcactctgttgcccaggctggattgcagtggcgtggtgttggctccctgcagccttgacctcccagactcaagtgatcctcccacctcagcctcccaagtagctgggactacaggcgtgtgccaccactctgagctaattttgtgtttattgtagagacagggtttcatcatattgcctagactggtgcgagattcttatattttctaattattcttaaaatgaccaattgactatcaaaaatgtatttggaaataggtataagttgaactttgcttattgggaattcttggttgggggagttttctgtagttgagattaccatgttgttgggtatatgaagatgaacagtgacggataaaactagaagtgcaagttgaggccagtgtgcgaaggaacttgaatgccatataatagtgttgatagtgatggggatttagtcttctctctgatgcagactaaacaaaaaaataccaataacccaactgaactgaagcaaaatccaagtatctcgagcagaaataaatttatctgaccacataatctgagaattcaggcttagctggatccagggacttagatgatgtggtcagcactcttactcaacaccttgtcttcttgacttcctccttctatggcacgagagaagaagaagatggtcactaatatttctaccctcacatcttttcaacagtcacctcacaggggaggaatcttctttcttccagcgtccttatctcagtctcagggaaggactttggtcctgattagtcacatgtctacgatggttcgatctgtgtgtctgataatgaggcatactctggccaggacagtccacagtggtaacagacacaacctctggctccttcatcatccctgcaattataaccctgccatgatgtcattttttgcatcactgtatgtgagagggctgcaatgccaccttgagaacccaatatgctgcatccttcctccagatctgcatttatttgcactattctttttcaaacatacagttctactgaagtataacatatttacagaaaagtattcaaatcattgttcaataaattttcaagcagtaaacacatccatgttatctctctgagatcaagaaagagaatattaccgttcttccagaaaccacctcatgggccctcccagtaagtacatatttcttttttcccattggtaactgctaagctgatttcctttctctctctctctcttttttttttttttttttttttttttaaagagatgaggtctcactgtgttgcccaggatggccaggaactcctaggctcaagcagtcctcccacttcagcctctcaagtagctaccactaacctgatttctaacactgtaactttctcttttttgaaacaaatgaaataaatatgaaatcatacatatatgcctgtacactttctttctagatccttatgcacaacattgtttgtgaaattcatctatgttgcaatgtgtagcagtagactatttttattactatatagtattctactttgtgatattccacaaactattcatctactgttgagggacatttgggatatttctaggttagacatatgaatagtgctgctatgaatatttttgtatgtgttttgtgacacacatatgaatgtgtttctgtttgatatacacacctaagactggattgctgggccatggggtgtgcatatgttcagctttattcgatccttacaaagagttttcttaagtggctgcaccaatttatattcctatcatcagttcatgagtgtttcagtttctttatatcattggtaagacttgagattgttaaatgtttgaattttagccattctggtgggtgcgtagtgatgtcttattatggcttcaatttgcatttttctggtgactgatgatgatgtgcctttttaatttttttttgccacttttatttgtcttttgcagtgcctattcaagcttattgcctattttaaattagatttttaatctttttctcattgagttgtagaaatcttcttttaaaaacaaatttttaatacaaatacttttgcctgtcatatgtatttaaaatatcttttcccggctctagtggtttgcctttcactctcttttgatgaattggagatctcactttgaatataatctaacttatcagtctctttctttatggttattgtttcctgtgcctacttaagaaattgttgcctaccctaaggctatgaagctactctgttttaatttatagaagctctatttttttttttttttgccttttagccttttatctttaggttgtaaaaatctacctgtggatgattgttgtttgtggtgtgataaaggcatccgtatttgttttgttttacttatggatatccaataaacccagcaccacttattgaaaaatctcttcatttctactactctgaaatgtcacctttgttatcagtcacatttgtggtctgtctctgtgttttctagtccattccatttttctatttctctaatataatattgataacgcactgtcttaattacgtgagctttataggaggtcttgatattcagtagtgtgcaccctctagtttgttcttatttaagaataacttctaaagaacaaagctggaggcatcactctacctgacttcaaactatactacaaagtgacagtcaccagaacagcatggtattggtacaaaaaacagacacatagaccaatggaacagaatagagatctcagaaataagactgcacatctacaaccatctcatcttccacagacatgacaaaaacaagcaatggggaaaggatttaataaatggtgctgggagacatggctagctatatgcagcaaactgaaactggacctcttccttacaccttatccaaagattaactcaagatggattaaagatgtaaagtaaaaccaaaaactataaaaaccctagaagaaaatctaggcaataccattcaggacataggcacaggcaaagatttcatgacaaaaacatcaaaagcaattgcaacaaaagcaaaaattgagaaatgagatataattaaggagcttctgcatagcaaaagaaactatcatcagagcgaacaggcagcctacagaatgggagagaatttttgcaacctatccacctgacaaagatctaatatccagagtctacaaggaacttaaatttatgagcaaaaaacaacccaattaaaaagtgggcaaaggacttgaacagacacttgtcaaaagaagacatttatgtggccagcaaacatgaaagaaaagattaacatcactgatcattagagaaatgcaaatcaaaaccacagtgagataccatctcacaccagtcagaatggtgattattaaaaattcaagaaacaacatgctggcgaggctgaggagagagagaaatgcttttacattgttggtgggagtgtaaattggatcaaccattgtggaagacagtgtggtgattcctcaaagacctagaggcagaaataccatttgacccagcaatcccattacagggtatcaacctaaaggaatataaatcattctgtgataaagatacatgcatgtatgtgttcattgcagcacttttcatgatagcaaatacatggaatcaacccaaatacccatcaataatagactggataaagaaaatatggtaatatacaccatagactactatgtggccataaaaaggaacgagatcatgtcctttgcagggtcgtggatggagcggaaatccattatccccagcaaacaaacgcaggagcagaaaaccaaacactgcatgttctcactcataagtgggaaccaaacaatgagaacctgtagagagagggaggggaaaaacacctgaggcctgttggggatggggggatggggagagggacagcatcaggaaaaatagctaatacatgctgggcttaatacttaggcgatgggttgataggtgcagcaaaccatcatggcacacgtttacctatgtaacaaacctgcacgtcctgcacatgtaccccagaacttaacataatatataattaaaaagaatagcttcattatttctaaccatttgcattactgtataaattttaaagtcatcttctgatgggattttgattgggattgcattaaatctctagcctaaattgggagtaaattaatgtttttacagtgttggctattttaatccattaatatggaatatcccttcctttatttagatctgtctctcacgtctgtcagcatttttgtatccctctatattgtaaaattattgcacatcttttaaatatatattcctagtatttgaaattattcgatgctattataaataatacctttaaaaatatatcattttctgattgttgctgatatacaaaaaatacaattgagttttatatattgaccttgtattcattgactttgctaaattcactgaatcctaatagttctgtgtattaggttggtgcaaaagtaattgcattcataaattattatgaatttccatgtacacagttaaattacttgtaaaagagttattacttttacctttctaattatcacgacttgtatttgtttttcttgcctgttgtataggctaagacctcaaatataatggtgaatagaagtggtgatagtgagcattcttgtctaatttccaatctcagtgggaaagttttccatgttttactattaaatattattaaatatttctgtaagtgttttacaaataccgtttatcagatcaagcaagcccccttacatttaaaattggccaagagtattttcatgaagaggtgttgaatttgattaaatgccttaaagccataattgcacagaatagcgggctcacctctgtacttcctttttctcttggatcatgatcccatgtgtcctcattgccttgggagctcttctttttataccatatctacctttctagattttcttgagggttggactgttacaagttagatcatcattgtaggaattggtactgtaaattcaaattgtactatttttgtctgccatctacacggtatgagtaaaactgtaaaacccccgagaacctattcaattgttatttctttgatctatattgcttttggctggtaagctttatgaaaagattttcttttgttaaattttgctatcttaagaggaaaagtctaccattgctgctacaaatggaggcattatggagtcattgaaagggtgcaccttatattacatttaaatgccatgttttacatataaacatactgattttacctgttcctttttaaaaaagaaagaaaacaatgaaatcccaaggaataaaactgacattctttaaaaaagaaaaagccaataggagtgcttttcttcttaggtcccctgggaacatgtcatcctcttcatctcttagtcatccacttcttgtgtataaaaattggcaacgcttctctgtcactcccacttcttctctagcagtgatacaatctttcatgcgaaataagagaataataaaatgttatttctgcagtcccaatagtcagtagtattagaaactataatcttggaacccatacttaacaaaatataagccctctcatgtgagaagagagggaagacccaagctctaaatgctgactcattgctaaccaggagggtggcattagaacgcaacttgaccttcccaggtcttagtgccatcctctgaaaaccaaaggcttggacttgttcaagggacagaaaaaattgtaatgtaaagggctaaatagtaaatattttgagttctgtgggccatacagtccctgttacaacaactcaattctgctgttgtggcacagaagtgatcatagacaataagtaaacaaatgggcatttatttataaaagtgtatttatggacacaaactcaaatttcatacaattttcatgtgtcataaaatactgttctttcaacttttttttcaagcatctaaaaatgtaaaaacaattcttagcaaagagatcatataaaaagaggtaacaggcttagatttgtcccatgggcccaagtttaccaacctttgagtcagttaaattgtcaagggctgttccagagctctgtgttaggcattcatatgctagccttttaaaaaatattttttttgtcctatgaacattattcaaaagggtctatttttttcttttagaccaattatgaataagaaaaatacaatatgttgtttttacctttattccttcatcagtgcttgttctttctttttagagatccaagtttctgacctgtataattttcctctgcctgaagaacttctttttgcatttcttgcatagcaggtttgctggtgataaatttcctcagtttttgcttgtctgtgaaagtctttattttttctccacttttgaaggataattgcactagatgtagaattctaagtgggcgtttttttttttttttttttccttcaacattttaagtatttcactccacactctggcttgcatggcttctgtaattcttatcctcattcttctataggtaaggaatctggcttcttttaagatttcctctttgtctttggttttctgcagtttgaatatgatatacctagatgtagtttttctttttttgggtgtttgtcctgattggtgtttactgacttttctggatctgtgatttattgtatgtcattaattttggaaagttctccgtcattattccttctaatatttcttctcctttctttcttctcttcttggaattctgattacatttatgttacagctttttatattgttctatagttcctgaatattctgctctggtttttttcctcccttaattctctctctctttttagtttggaaattcatgattgactttcaagctcatggagtcttaaaaaatttcttaaatttttaatttttatgggtacatatgtgtatacttatggggtacatgagatatcttgatacaggtatgcaatgcataataaccacatcatggaaaatagggtgtccatcccctcaagcatttctcctttgtgttacaatccaattacactcttttagttattttaaaatgtacaattgagttgttgttattgacattagtcaccctcttgtgctatcaaatggtaggtcttactcttcttggccatttgagtctgctgatgagcccatggaaagccttcttcatttgttacagtgtttttgatttttagcatttccttttcaaaggagttttaaaaaaatgtttccttctctctggtttcattaccatttactttctccattagaatccttaacatttttcatcatagttattttaaatttcctatctgttaatgacacagataattccaacatccgtgacatatctgagtctgattctgatgattgcttgtctcttcagaatgtgtttttcttacctttcaccatgcgttgtaattttttgttgaaagccagacatgatgtgttgggtcataggaactgaggtaggtaggcacttagtgtgaggttttacttaatctggctaggagttgggttgtgtttagtgtttgctgagctgtaggtgctagaggcttcaaatccccccaagggtccttgtttttgtctcctctcttgactttaggtttccctaactactattcctcagggacgctgtgtcttggaagtcttttatctgtaatccactgttacacctgagcccggctggtgtggtggtagggcatatgtgagcagtaatgttctattaaccatctaattaagagcaaggatggaataacttccctttggtaaatggtaacgttacaggaaaggggtcccaatccagaccccaagagagggttcttggatctcacgcaagaaataattcggggcaagtccgtagagtaaactgaaagcaagtttattaagaaagtagaggaattaaagaatggctactccatagatagagcagccctgagggcttctggttgcccatttttatggctatttcttgattatatgctaaacaaggggtggattattcttgactcccctttttaggccatatagggtaacttcctgatgttgccatggcatttataaactgtcatggcgctggtgggagtgtagcagtgaggacaaccagaggtcactctaatcaccatcttggttctggtgggtttcagctggcttctttagtacaccctgtttatcagcaaggtctttatgacctgtatcttatgccgacctccagtctcattctgtgacttagaatgcgtaactctctgggaatgcagcccagtaggtctcagcctcattttacccagcccctactcaagatggagttgctctggttcaaattcctctgacagaaaaactttcccccataagaaaaaggaagatggagaacatggtggcttcagtgagggtgtctgaagatgagggacttgccttctgctggcttccatttcttccatgaattttgaagtgagctcatcagctaagactatgtgttaaatatgagctgggaaaagatatgacatagccatctcagaaagggagaaacaagcttggtaggaaaacattttgggtttggcaggcagtgttgactattcatttaatgtttgtggccatgaatttaatgcagctagtcagcctggttgtgtgacttcctctccatcccaaagtgttcatctgtttggatgggagcttggggttggtggatagttgggttccatcagtgttggaatttggtaaggatagtgtgacacagaaagggggtgtattagtgttccctagagggacagaactaatagtgtgtgtgtgtgtgtgtgtgtgtgtgtatattctatttttatatatacaatagtatatatataacagtgtgtgtgtgtatatatatgtaggagtttattaagtattatcttacatgatcacaaggtcccacaagaggctgtctacaagcttgaggaagaaggagagccagtccgagtctcaaaactgaagaacttgtagtcccaagtttgagggcaggaagcatccagcaagggagaaagatgtaggctgggaggctaggtcagtctcaccttttcatgtttctctgactgctttatatttgctggcagctgattagattgtgcccaccagattaagggtgggtctgccttccccagcccacggacttaaatgttaatctcctttggcaacaccctcacagacacacccaggatcaatactttgcatccttcaatctaatcaagttgacactcagtattaaccatcacaaggggagatgcaggagtagagggtatgtgcaagggagtgattatgagtgagtataatgatggagccagtgtgaatagtgaaggtgaagcgaagggtaggaatggatagtaaaagtgctgtgtgttcaatggattaaatgtctaaataagtttgaagattgtttgcagtgaatgcagagtaagtaagtgagctgaacagaggaagggtggacagagtggaggatgcttgtagtgggatttgaggtgatgacaaagtttaggatgtggccatgtgagatagtgactcagaaggaaaaagcttcaggtgaggaaataaggaactgagaaactggcttttctggtaggtctttgactctgatgttaaagtcactgaaagtggtgaaggtgttagggaagcagaagaaaccctctgagaggcggaagctggagtcttcagggaatgagaaggcataagcaggagggaggtgaaaaacagcagtgaggatgagcagaaagtggcagagccagatggcctgagtgccacagagcagggatttgtgttggagggagggagggaaatcatttgaaggagcggtggagagccaggaggctgcctgccctactccctggtcttcagatatatgacgtgaggacagagggctgtaggagaggagaaggcaagtttccattaaggtcacagaaggttaaagttcagagaggagatggaaggacatagtgggcatactatttacagaaatgttgaaagggtgggatgagtctgtggggagtcggaggggttggggtttccagagcagcgtggagttcagagccctggtgagagaggatgactgggtagacctggctttccagcagagattgcagtaacaggactcccagggccagcatgccctgttacatggctatctttccacttctccctcctagcttaatttttagaaactttaacagatggaatgcaaaatttttatttttatttttacttcagagatcagtcctcaccctgtcgccctggctggagtgcagtggtgtgatcatagctcagtgtagcctccaactcctgggctcaagtgatcctcccacatcagcctcccgagtagctgagactacaggcaacgcaccaccatgcctggctaatttttgtatttttttgtagagattgggtcttgctatgttgcccaggctggtcttgaactcccaggtttaagcaatcctcatgcatgcatatatatatatatatgcagctttgataatttaattagtttagcctgtcaggcagctgtgatagtgtagagaacgttgtatttatttgtaagtcttaaggtaggattggaatggagaagtcaacttcactgaaaactagcaagtagaatgaaggaaacacagattagttgaggacctactatgttccaggctttgtgccaaacatctactttatgtaggtgatttcacaagatggacatgttggaaaaactgtgggcattggaatcagtcctgggtttgaattttagttgcttggctgacaaactgtgttactttgggcaagttacctgtgctcttcagtcttacttttctcatccatagcgtgggaataataacatccacctgttgtggttgctgtaatgagctgtgcaagaaattctaatcagcaggccgggctgagaaccactgctgcagagtgattagcatttgttccattttataggtgaagaaactaaggcccagtggggctaaatatgttgcttacggccacacagcacttaaatgatatagccaggattgaaagccagttttttttgaccccagaaccttgttgtatccatttcattgagtttttgccttaatacatgggaagctaaaggagcccccccattagcatgtctgcccaaacatcaggcagcatgggatgggaggaagggatcaagtgaagggaaggcaggctccatggaatctaggtcagcggtttccaaacctggctgtacttacaaatcatctggaaaatggttaatctgtaaatctccagggaccaccctaggcctattggatcagaacttctggagcatgggaaccgggagtatgtatatttagaatatctcccaggttattctgagactgctagcctagttccggtccttgggcaagtttttgggaaccactgaattctaatcgatgtcctaaaatgattaagtgattatatcccagtaaaatactgggtgtcttccagtgccaccaaaattggcctttaggggttgagtgctattgccgtactttaagatcttggtgcattacctgaaacggacactctgtctgtcattgaacatttgaacttcgaatatataggaaatgtcaagttggcatactctgctataacaggaagagtgatttgttatttagagctgttgttcttccttctttccccttgggattcctgcccactcagtcagattagagctatataaacaagctcgtactactgagctagcacacatcttgtaaattttttttcctgaagtgcttaacgttgctgatgtcagaaaaaaaaaatccattgggttttaatgggctgaggcaaacaatgagaatttgatataatatggaggagaggaaataacttcaacagaaattcttatttggcagcataaatattcaaactatattacagtcagagtttgattgcttctcctacatggcatttccctgaatagggttttgagggctgggcactaagagtggcaggcatgatgtttaaagcatttagttgcaagccatggtaatttcagtgacattgtagggtaattgtagttggttctcctcttagctctgtgtcaggatcacctgaggaggttgttggaccgctgaaggcttcatctctgatgcacgagtcagaacatctgagggtgggggttggggtgggattctccattgaatctgatgccagtggcctgggaatttcacttggccaaaccctggcttagaacaaggtcactggtcagtttcgatattcattctgtgctggggcatttccatgacttagtgtcttccctcttcaaaagcaaccctgcgtgatggaggggtctcatcttccaggcaaggagctggaaacgtagggtgggagagcccattgtcaaaggccacatagtagccttaatgaggctagagctgagatgtgattcccagtctgacttcaaagcccttccttttcctataccatcgaggcccttccttcctgctctgctcaacattgttagctgccgaaccctaggctttgcttgttccagaggggctggcattataaagtaaacagcaggcatttattgtaactgcaagttacagatgcagtgtcagtttggagtagacttgcaggcacaatcctgactttcaatgattcacgaatctgtttgtgtcacaggtgctcaattgtcctattatgcatagagcatccccttcactatattttcttccctcaccacatattccttcttacctaaattgcttatgaattccagaagtggattgctgagtccaggctggttcatatcaataaaccttggggaaaatctttatgtgtgatgctatacatgggtctttgttgatcaagagtcttctttattggccacttttaatggcttgttatccagatgaatcttctggaaggaggacactgcatcctggtggaattttatcagttccatcattcattcaaacatatttaagtaccttctatgtgccaggttctgctctaggtgccagggagagaggggtgaaccccaacgataaagtccctgcctatgaagaactgactttctagagaggaagtccctgatagacaagtaaacaaagtcccgcagattcagatagttgcgaatccctgttatctcactctccacacttggctgtctcccacttaatctttctgggatcagattatctttgtggcttttttctcttgactgtctagcacaaagctgagccgcttctggggcttcagatttctatgcctgtgtgtgtgcatagccttggctggaatggcaaactttgcctctcccaggcttctgctcatctgtcacctcctcctactctgtgccatcataattgagcaaccacatattacagtgtcctttctgtgaacacatctgttattcctaccggtctctgaacattttaaggagaggatctgtgtctgacttatctgtatatccccagggcctagcatggaaccttacaaaagtagatgctcagtatatttgctcaaagaataaatgatgagttccaaagaacctgagggtgggtggtgtggtataggaattccgtcatggggagggatgctgagtcagatgggggatgctccaccgcagtggttttgtgatttattctttgagacattgagtgctgtcatgaatagaggagatgggctgggatataggcagtattgacagagacacgtggcatggaacattctggtgagaacctttgaaggaaagttagaaatgtgaggttctgagggtctagctcagagctggaaggaactctaaggttgctggattttatagccaatgcccaactgaggtccagggaagctgtgtgtcctggttctgatagttggttagttgcaaaggagctaggggtggggtgataccaggactcctagttcagagggctttccactatgctggggctatggtgtgtgacagataacagattaaaggcacagagaggagaaggaacttgcctaagatcacacagctaggaagtggtggagcctggatttggacatggatctgtctaatgagaggcatcttgtaaccatcaagctgtattgtctcttcttgaagactgtgaaatgcaaggtcctagcccattttcagttttcctcttgggttagctgtgagtccatataggaaaataatattaacatgctttctttcttttggtatgcagttacatgttttcagaaaaatgttcacattcttcaaatgttaatattgaagcccctgggttgtttactgtgtgtatatatatgtatatataagtacaatgaagaacattctgtttttctctaccactaaatttaaacccatttctattgtactccatttaaaagaagtattttacatcatactataatgaatgaaaacctagtcctttaatttcacaagccccagctttaatagtcaatgaatttaattagaaaatctttacctatgtaggtttcacatccagttctctataacatctgttgacctatggactagaaagtatattattattttagaaatgattctttctagacacaggaaagctaaatagcttgtctgagtttcaaaacgagttaatagaggaaccaaaaatagaaacatttctactgaatacgaggcttactaaaattcttcacacagagactatctgcattcacttagtagtttccagtctagactctggaacatcagcctgttttaacacacacaaatgcttctgttggtgggagggggtggctgggcagagggaggccgggcagagggaggcctgacacgtttgtttctaggtcatttctaaccttgctattataatacagttttctagatagaagagaatgtgctcattaaagtgttcattttaaaataaagcgacagaaacttaaaacgtctctattacatggatacatgagtatatataaatgaactcaatttttgttttcatgctctgttgtattctgtattaaggcaaaggagtaggcaactaagtagttgtttaaaaataaaactgtgtgttgttcatttaattttaaaagccattggttagaatggtaatcagtgtttccatgtagtactatattcatagaaatcctgatattacagtgtatagagataatattatagaatgatgctctttacctctttatgtaatctaattttaaaaaacattgtaatttataaatagtgaagaaagcaggtagtgttattcgaatgggatattttcggcaattaaattcttagcataaattacaaattcctctctctcccattttccacccaaatttgtttttatggaatgacctttggtagcaacttgttttataataaaatgtttcctgaatttgtattttgaattgaaatggccttttctgtcacgtatggtatttataagagtttctttgatgaaaagcctctgaattttgtgcaaataacccaggcagcctcttagatgagggataacatttgtataggacttttatggctttatactctgctctcatactcagcttatttgacccttacctgcggggaacttggtggaattcacattttactgctgaggacaatgtagaggaaggtgccttggcatgactcagagcatatagcaggtgtttggtatgtttgttttaaagggaaattaacaaaagaaacccaaaagattcttgtacttgctcaaggtcacacaataaatatagtgtcataccaaggattgaacttccttcttcactcaaaacttccatatacttgttcttatctcactgttatcttttcaggcttttcaaaaaggccacattaaatatatttatttttcttaattgaggtgaaattcacataacacaaaattagccatcttaaagtgtataattcagtggcatttcatgctttcacagtgttctacagccatcacctctatcaaggcccctgaaggagaccctgtatccattaagcagtcacccattccatcctccctgcagctactggcagctaccaatctgtttcttgtctctgtggacttacctattctggatatttcataaaaatagactccagcaatatgtgacgttttgtgtctggctttttacacttagcgtgttttcacttagcatgttttcaaggttcatccacgttgtagtgtgtgtcagtactttatttctttttattgctcaatgatatcccattgtatggatatacacgttttatttatccattcatgcactgatagacatttgggttgtttcccccttttaactattgtgaatagtgctgctatgaacatttgtgtacaagtatttgatatttgttttcagttagtttgtgtatgtacttagaagtggaattgctagatcatatggtaattctgtgttcaacttttttgaggaaacactaagctgttttcagcagtgactgtgtcattttacattcctaccagcaatgtttgaggattttgatttccctgtatccttgccaagacttacttgaggttttttttttttaaattataataatcttaatgggtatgaagtggtatctccttgtggtctggattttgatttccctaataaaatattcatattttaatgcatagaattaatcagaaaatgagctttggcaaggtgaactcaacagcaaaatgattggcttcaactgtcttcaggagattatttaagactgccgtggctgggtgcggtggcgcacgcctgtaatgccagcagtttgggaggctgaggctggtgcatcacctaacgtcagaagtttgtgaccagcctgaccaacatggagaaaccctgtctctactaaaaatacaaaaatagctgggtgtggtggcacatgcctgtaatgccagctactcgggaggctgaggcaggagaatcacttaaacccgggaggcggaggtttcagagagctgagatcgcgtcattgcactctagcctgggcaataagagcgaaactctgtctcaaaaaaaaacaaaacaaaacactgctgtatattcactcctggggtgtgcgattctgagctgaaaatcaataacatgttgtttggggattagaagaatatttgtggatagtaagactgcaatcatcccctaactttaaaaaatgtatcatgtaatatcatgtttttgttcatggcatctgccaaaagttacttaattctttgcatttcaaagccctctttatataattccttcgtgacttaatggtttattcatttatttttgcagtgtgagtgaagacactcaggatggctcaaggatccggggatcaaagagcagtgggggttgctgacccagaggagagttctccaaacatgatcgtttactgcaaagtaaggcgcctggtcaagtgccgtgcgtgctgtccgtgtggactgttgtgttctgtgtagggctgataaaaagacaaatgttttctgcctaaactgccttactgataaatgcatattttcttctcacatcctctggttctctagttctaaaattcaaggaagttcatacttgagcacttggtatttaacacttgaaaaatattatgccatttagttttctttaaacccaaaggttgcctaagcaatgcagatgggaagacacattctccttcagtggaaaggccttagtgtaagatgtatgaactgaaagttcttcagactcgtagtatgtacaaaatctgggctgaatgctgtgggagatagagaggtatatttgtatgagatgcttacagttggtaggagacataagatgtacacaaataactgttatagagtctaaatgttaatttccaaaatagatgtgcaagtagagtgttacataatttcagaggaggaggccagttctcccagcctcagaggtgagaatgggcttgtggaagagtggtctttgaactcagttttaaaatatgtgcaggattgctttatgtggaaagcagagaggaagaacataccaggtgatgagatgtttcagcaagggcacagagctgaggaaagtaacagcaaccggaactggttagcttggacataggatgcattacaaggagtaaatggagataggattttgggaagagaggctggctggagccagatgttagtgttgaattagacaatttaatcaagaaaaacttctgtgccaagagttgcaagattgagatctctttgggattatgactgttgccccattgtgctgaatggattgttatcaagatagagcggaggctctaggagagagatttctgtgtctgtgtgaaaggtaaggagggaaaggagagacactaatccagcctgtgaaatcaccttcagaattaagagaaactgataagaggaattaaagtctggattaaaaatgacttggaaactgaaggaatataggcggcaagtagagggtcaaagatgacggggtttttgacgttgggtaaatgaaaatcattggtgctattaattcaaattgggatatttggaaaaagaatacattttaaaggaagaaaatggcacataagtttattttagtacatgctgaatttgacataattgcttcttattgtacacctttttgatgtttgcatgtttgtgaaaatttaaactaactctcttgtatgttaataaggaaataagttaatgttcatttcactaactacttgagtttctactcagttctgtgcattctgagaggctctgtgtattacttatatgggcaatgtggaactagatattcctggatgatcaatatggtgaatttttctcttttccttgtaaaaatagagttctcaaattattctggctttgagtgtaagattctgtaattctttgctttgcaagagaatgtctagataacccatctctaagaatcatgcttattaaattgcgataaagaaaaaaataggttaatgggactcagcaattagtgaaacatacagaataatagacattgagtcattgttactttcttaacccacccccaaactgggagaccccgtgccaggctggtaggaacatgggctttggagtgagacttaggttaaaatgccaactttaccactctttagcagtatgactgtaagttagttctttaacttccatgagccacaattttttcatctgtaaaaagaaaaaaaaatgtgggaggaaggtaattgtgaagatcactttagataaatcgaatgaggcatcttatatcctacttagaccacaatgtggtccgtaatgaatatctctttttcttttcatgtttaggtcttgtagagtcagtgacacttggagaggaaataaatgataaaatctctaaatgttggtgctgttaataagttgtctagagcaaatttatacagtgagtttttttttaagacacaggaaaacaataaaaatatttttatattcttcagaggattgcaaattcatggattattaaagaataagaaatgcaaaggtcatgtaacccaaccacctttctactagaatgtttgtattatgtttacaggaaaaaaaaacttcctgcaggtttatgagaacttggtttttactttttggtggtagtaaggggcccttttctggtttaatttagtaactaacatgtcaattgctgtagttctttagagaaatgacaactagtaatgaaactatatcttactttcgtgtgacaaacttgtgtaaagagtatatatatatatatatatatgttcatgtttatttgctatattaattaccataaaagggacattgaattggttcagtctgttagaaagaagacacacttattgcacagtgtgagctcaggtcctgacaccattttaaacctagttaacctgactgacttaaaccatggttgtacttgaactatgggattttcatatagttttctactcctgatgctgtaggctgccttttggctacaaccaagaacttacttgctgtaggacattatcctcaaggtatcatcagtaagggttggattgtgaagccaatgacaattcaaagcattttctttggaagtccttttgtgtaatcaattattcaaagtcatagccataaacccaaacctttccttagatacccacgactacaatttacatttaaaaaattgtgctttcatttttgttttctttctcttgtttgttgttgttgttttttttctcttgttgtcagacactttcagtgtgaaatttttgcttggactgcattgtgttgattcagatgctgacatttaaaaagccaaatctagagaaatgaagcttttgggtaaactttcgagtaataagtggatgattatgtccataatgttgttgtgacttttaaatgacatttaggatggtaacctcctgacatatgagtaatgatgggtgggtttttaaagcccacacttttcagaacactcttcatttccttttcatgttttcatgtcattaactgtgagaagttgtactttcccaaggcatgacttatttattgacttgaacagactttctaatttagtttttcatccctcatattcacagtttggattggaggtgtgtatgaaaaatgtattggtcacattaaagatctatttaaaagaaaaccttaattattcatgaagacacccagacctgttaaccttttttatattcctgtatccttaggatcctgagttactgaattgcccagtgtaatgatgatatttgaacctagctatacatcacatcatttagggtgctttataaaaatgttaatcctcaaaggaccccctccacaaggtatttctatttaataggtctgagctgggtcctaggaatctgagtttcaagatgttctcaggaaaatctgatgcccaactaagtttgaaaagcacttacttagtcttttacaatatccagacatagtatgtgttgcaaagtaatgagagagttggtgttttgaattagatttttgatttcataattatttgtagatctctcaaaacgtagaagaaccaagctcttgtcatagggattttagtagcttttccttagatattttctagtcttattttatagatgaaagaactaaaagtatagagagggtgagtaacttgattaaggctcctcagcactttcccatggaagccataatggtgtccagggagcctggccactccaatcagttgcctttctagcaccctatgcgactaccatgttatcaaccacagactactgttaccacattgttggagctgagtagccatggggcacattaaattaatgaaaataatatgtggcagatctttgactttcatgtttcttctgggagagttgacttggattaatgtctcacttttttattgatttttaaaaaatactttaagttctagggtacatgtgcacaacgtgcaggtttgttacatatgtatacatgtgccatgttggtgtgctgcacccattaactctcatttacattaggcatgtctcctaatgctttccctccccactcctgccaccccacgacaggccccagtgtgtgatgttccccttcctgtgtccaagtgttctcattgttcaattcccacctgtgagtgagaagatgcagtgtttggttttttgttcttgcaatagtttgctgagaatgatggtttccagcttcatccatgtccctacaaaggacacgaactcatccttttttatggctgcatagtattccatggtgtatatgtgccacattttcttaatccagtatatcattgatggaatgtctcacatttttaatgctaaagtttcattctactcattggtgcttttgcttcttcggtaaagattttctaaaatgtttacataggtaagattgcttttgagtaagagtaggttgctttctgattttgtttggatctttggtgttaacaatgcctcttgacaaagttctcctaactagactggtaatttgatttgtttgggtcaggaggcatggaagacatcacactctggatgtcttctacatccagaaggatggaggcatggcagatgtcacactctggatgtcttctacatccaaaagctggaggctctgcctgtctggtcccagctttgtgtggagaacttcactttcctgattctacttcttgttttgttttctaccttcttcattcttttcctccttccttttcaattgtgagatacttctaacacaaaaagaatatattcagtgtccatgtaaagtagaaagaattaaaaaatgaattatatgcactcaccattagcttaataaataaaatgtaatactttggcctcatttccccttctgtaaagggaggaaattggtctaaaaatgtacaaatacctttctgcaatgatttcaaagttccattctataactttttgatctttcgtaaattagtacacttccctgatatcaaaacaatgttgtgagactatatgcacgtttaaaggtcttttgagcttttgaagaaatattttagatagttgtaggtaatctaaattggattgagataaagcccagttaagtcaggcattagaataaaaagctttaattgtaattatttaatattcaacagtggaatttagatgacatcttggtggcaacctgtttctttggcttgctaataacatttaagacatttataaaattatcattttgtagtattaattatatgctatatacataacaagtggtgtttaagtagcaacactgtacattgccagtagtatatagtgtcatagatgaaataggggttttagaggaagacaaaaaaggccaatgttcttgtatatcaacaggttagttgcctagcctcgtcactgatggcttccttcacctattcatttctagttattgactccttttctgctggaatttgagtctagcctttatgttgctctgataccccaaggtcactcttcctaatgatttagggcccttgaagtcctgggcagttgttggtttaggcatacatccagaaagtaaatgtcacactattttagttacattggctgtggtatgcagcaagaagggaaggatctagcctggaagaatccgatgctatggaggaagctagggatagagtgtggtttggaattcatagagggcagtggtagaagccagcacaattgagagtctggggacctgcaggtcctggtgactaaggcatgatgaggattagaaactgtcgaatcaggaaatacgtattgagtgtcatttgtgtgccagacactattagatgctaggaatgcaagatgagaactgagccctgaatgagcccacaggccagctgggggtaaatggggaactagacaattacagtgttggtagaagcaactgaggggcatgggaggaggtagaggggtcatgtagtccatcccaggagaggggatgatgatgtagaagacatccagaggatttggcacctgcttcgattcttgaaagatgactaggaattaaccagatggaggaggagagagaaggtgtaggaggcaggactagcacctgtaaaagagcagatttgtgatgtcgtataccgagttcaggagactttaagtggttgatatgaagctaggtttctgtgatgaaaggttgaggaatagagctagacagatggattagggccagatcacaaaagaccttatgtaccatgccaaggagtttagacattgtaaaagtatcttccctttgggcctccacacccaagttcaactcctttgcatgctgctgtctgccccagaggctgagctgtgaggactacatttacagggctcctgtgacctctgggtttcagttgggtttggttagtaaaagtctggaaagagatgggagggaaggagaatcgcaatgtcagagaatttcttctcctgggtctcactctgcaaaaccttgcactggccatatccgtctactgaagtttgttgattctctcaaggcagactactttcctcttctgggtccggacatcctttttgtctactcatccttttgggcctttgccgactactttcctcttctgggtccggacatccttttcatctactcatccttttgggccttggggtggttccagtttgtatttgttatctcttgctgtgtaacgagttatctcaaaactcaatggcttgaaaacatttattatgtcacaatttctatgggttagtaatccaagtgcagattccgtgagttctccagcacagtgtctttttaaaaggctgtgatcaagatgttgactcggattatggtttcgtctgaagtctcagctggggaaaagtctactcccaaacttacttgtgtgactgttggctggattcagctccttaggggccgttggaatggtggactcggttcttcgttggctgtttgccagaggccattcttagttatttatgacacgtgtctctccatatcgcagctcataatatggcaggttttttttttttttttttttttttttttatcagagtgacaacaggcagagaaggaagatgggtggtagtagtcttagtgttttataacctaattttggacatttttttctttattatactttaagttctagggtacatgtgcacaacgtgcaggtttgttacataggtatacatgtgccatgttgttttgctgtacccatcaacttgtcatttacattaggtatttctcctaatgctatccctcccccagcccaattttggacatattatcccatcccttttgatagtaagaagtcactaggtccacccctcactcaaggtgagggatttacacaaagatgtgaataccaagatccagaattcagaaaatctttgtgggccattttggaagccatctaccacacagctctacttctactagccaggggtttctgagtgttttttttttataatttccctgtaccctagaactcctttaaacttggtccttttggaaatacattttccttaaattgtcctatgtatatcatctgtttaccaataagaccctaacgaatgcaagtattatcccacaagcaaagggaagcgattgagactctgcgtttcttgataagggaattcttcatgaaagggtttgaagcaggggagtcatttgtccaaagtggaggatgggatctgaaatggggaagtcaatgtggagaagattcagtgtggaggtcaatgggtgatcgatgtggaagggttcggtgtggagggagagtgttggagaagtggtaggattggaggtaggaggacagtttagagattgaacaggaatccaggtgaggaaaaatgatgcccaaatcagtggcagtggtaatacagatgggaggatgtgtttgagagatgtttaggaggttcaggcaacagaatttgggggctgagaagacgtagggagaatttgagaataatgaggaggaatgaggagtcttttccctaggctatatctgtgattctcagaaagtctcctgggataaacttttgaagcaaatagctgtagaactggattgcctgcccctctcttccctgtatgtagataaattgagagagcccaagacagagtctgtaaatggaccaggatatctgggtatttgttctggctgccccactccactagctcatttatggccatgcgtaagttgttcctactttttgttaagtctagttctttaatttgtgaagtaaggggttagctatgctgggtgatctctaaagcatttttttagatctaacattctaggtcttttgtaatctaaaatagagaaacccacattttattattttactacttcatagcctcctttactttatttttaattttctttaaaaagtgaaccgagccaaaactttaaaaacaggtaagtcagaatgtttaaaacaaatggcttttggtcttcagcacttagggcttgttttttttcactctttttttttttttaacattaaataaaattcctggccacatgcagtggctcatgcctgtaatcccagcactttggaaggccaaggcaggcagatcacctgagatcaggagtctgagatcagcttggccaacatggcaaaaccctgtctctactaaaaatacaaaaattggccaggcatggtggcacacgcctgtaatcccagctacttgggaggctgaggcaggagaatcacttgagcctgggaggcagaagctacagtgagcagagatggtgccaccgcactccagcctgggtgacagagtgagactctgtctcaaggactaacttcagaaagtgttcagggtaactaatttaattgttcagtctacattttaagattcctttcattaaattttttgaagctttttttattgccttaggaaaaaactgttctgttttccttttcccccaggattagacttgctggaagaaaagctcccccatcacattatcttggttggcaggagacaggcatgcaggcaagtcccagaccagtggtatcagtgtccacagatgaaagggatggtatttttagtgtggggaatagctcagtgtggtttcatatgatgcattttgatgagtataactttctaatttgaaaagcctttggtgtgtttacgtcttcatttaatctttccaatttctccccctcatttcatttcaaggagtctaagatttttcattttggcaggcagttgatcactcttgttattgacactcctttgcagtattcttacactgtggagaacctgaatggctgtaaattccctattggcaggattttggagaaaaaaaaataaaagcgaatagatacctgtgaaagaaaaaataaatacattttaaaataattggaggatagaaggattacttttaaaagttctgttagtttgccagtacagagcaaaacagaaaatggacacatttttttgatcagcattctctgttctaaaaacttatttcaataagggaaagaatatgcaaagacatatatatagatatagacatacacccactccaaaagaatagtgatatctttctggtaaataatatccaaagtttggaaagaaatcaaatatccattgaaaggaaactaattttagggggataggattcacatttggaatgatctcatagttagtttactggatttctgttctggtcaacctaataattgtcttgaaagtgagatggctactgacattctagggtatggttagggagaatattctttatttttaaaaccctacaagattttttcattttttaaaataaaatgtcttatttgttaaatatgatggttatgtaggtttactcaaaagtgattttttccattgctctttattattttctgcatctctgtgcttacagctgaaataatttttagtattttctttagtgcaggtctgctgaagataaattctctcagttcttgtttgtctaaaatatctttgggccaggcacgttggcttacgcctgtaatcccagcacttgggaggccgaggcaggaagatcacttggcccaagagtttgaggccagtctgggtaacatagggagacaacatctctacaaaaagaaagaaataaaataaaaaaaaattagctgtgcatgttagtacatgcctgtagtcccagctactcaggaggtggaggtgggggaatcacttgagcctgggaggtcaaggctgcagtgggccatgattgtgccaccacactctagcctgggcaacagagtgaggcatggtttcaaagacaaaaagaaagtctttgtttcatcttcattttgtgaagggtgttttttctagatttagaattctagattgtcggttattttatttatcataactgtcattgtctcttggctttcattgtttctgttgggcagttggctgtaagtttgattattcctccttcgaatgtaatctgttttttcctttggctgcttttaagatttatttcactttggttttagcagttttattataaggtgtgattttctttttaatttattctccttagagcttatgagacttctttttatttggttggtgcttggggattctttttttttttgatggaggcttgctctgtcacccaggctggagtgcagtggtgcaaccttggctcactgcagctgccacctcctggaatcaagtgattctcctgccccaacctcccgagtagctgggactagaggtgcgtgccaccacgcccaaataatttttgtatttttagtacagtcggggtttcaccatgttgaccaggatggtctcgatctcttgacctcgtgatcctcccacctcagcctcccaaagtgctgggattataggcatgagccaccatgcccgactgtgcttgggaattcttaaccattaacttttcaaatattgtttatgcctagttttctcatttctctcttcttgggattgtgttcatatgttaggacctttttcctctagatttcatgtgtttcttatgctcttttctgtattttttattcctttgtcattttgtgcttcaacatggatattttctaccgacttatcctccagttcactaattctctcttcaatatattagataatctgtggttaaagtcatcccattgaatttgtaaccttagttattgattttttaagttctaaaattttcatttaattttctttttatagtttctagttttctgctaaacttctctattttgtcatttaattcctaaacttattaatcataattgtttcaaagtccatatctgatactttaaagtctttatcacttgctggactgtttctactaaccttttctttcttttttttcttttttttttgttcttctgtttatttattttattttttattttttttaattattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccacaacagtccccagagtgtgatgttccccttcctgtgtccatgtgatctcattgttcagttcccacctatgagtgagaatatgcggtgtttggttttttgttcttgcgatagtttactgagaatgatgatttccagtttcatccatgtccctacaaaggacgtgaactcattcttttttatggctgcatagtagtccatggtgtatatgtgccacattttcttaatccagtctatcattgttggacatttgagttggttccaagtctttgctcttctgaataatgccgcaataaacatacatgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacagtgtaaaagtgttcctatttctccacatcctctccaacacctgttgtttcctgactttttaatgattgccattctaactggtgtgagatggtatctcattgtggttttgatttgcatttctctgatggccagtgatgatgagcattttttcatgtgtcttttggctgcataaatgtcgtcttttgagaagtgtctgttcatgtccttcgtccactttttgatggggtggtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgacctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttctccattgcttgtttttctcaggtttgtcaaagatcagatagttgtagatatgtggcattatttctgagggctctgttctgttccgttgatctatatctctgttttggtaccagtaccatgctgttttggttactgtagccttgtagtatagtttgaagtcaggtagtgtgatgcctccagcttcgttcttttggcttaggattgccttggcgatgcgggctcttttttggttccatatgaactttaaagtagttttttccaattctgtgaagaaaggcattggtagcttgatggggatggcattgaatctataaattaccttgggcagtatggccattttcacgatattgattctccctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatggagttcactcatgatttggctctctgtttgtctgttgttggtgtataagaatgcttgtgatttttgtacattgattttgtatcctgagactttgctgaagttgcttatcagcttaaagagattttgggctgagacaatggggttttctagatatacaatcatgtcgtctgcaaacagggacaatttgacttcctcttttcctaattgaataccctttatttccttctcctacctaattgccctggccagaacttccaacactatgttgaataggagtggtgagagagggcatccctgtcttgtgccagttttcaaagggaatgctgccagtttttgcccattcagtatgatattagctgtgggtttgtcatagatagctcttattattttgaaatacgtcccatcaatacctaatttattgagagtttttagcatgaagggttgttgaattttgtcaaaggccttttctgcatctattgagattatcatgcggtttttgtctttggttctgtttatatgctggattacatttactgatttgcatatattgaaccagccttgcatcccagggatgaagcccacttgatcatggtggataagctttttgatgtgctgctggattcgttttgccagtattttattgaggatttttgcatcaatgttcatcaaggatattggtctaatattctctttttatgttgtgtctctgccaggctttggtatcagggtgacgctggcctcataaaatgagttagggaggattccctcttttcctattgattggaatagtttcagaaggaatggtaccagctcctccttgtacctctggtagaattccgctgtgaatccatctggtcctggactctttttggttggtaagctattgattattgccacaatttcagatcctgttattggtctattcagagattcaacttcttcctggtttagtcttaggagagtgtatgtgtcgaggaatttatccatttcttctagactttctagtttatttgcgtagaggtgtttatagtattctctgatggtagtttgtatttctgtgggatcggtggtgatatcccctttatcattttttattgtgtctatttgattcttctctctttttttctttattagtcttgctagcggtctatctattttgttgatcctttcaaaaaaccagctcctggattcattaattttttgaagggttttttgtgtctctatttccttcatttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttgaaagaacatctttatttctgccttcatttcgttatgtacccagtagtcattcaggagcaggttgttcagtttccatgtagttgagtggatttgagtgagattcttaatcctgagttctagtttgattgcactgtggtctgagagatagtttgttataatttctgttcttttacatttgctgaagagagctttacttccaagtatgtggtcaattttggaataggtgtgatgtgctgaaaaaaatgtatattctgttgatttggggtggagagttctgtagatgtctattaggtctgcttggtgcagagctgagttcaattcctgggtatccttgtggactttctatctcattgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatctgagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggtatgattttgcagcggctggtaccggttgttcttttccatgtttagcacttccttcaggagctcttttagggcaggcctggtggtgacaaaatctctcagcatttgcttgtctgtaaagtattttatttctccttcacttatgaagcttagtttggctggatatgaaattctggattgaaaattcttttctttaagaatgttgaatattggcccccactctcttctggcttgtagggtttctgctgagagatccggtgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaaagttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcacttcatttcattcatttcatcttccattgctgataccctttcttccagttgatcgcatcggctcctgaggcttctgcattcttcacatagttgtcgagccttggttttcagctccatcagctcctttaagcacttctctgtattgattattctagttatacattcttctaaatttttttcaaagttttcaacttctttgcctttggtttgaatgtcctcccgtagctcagagtaatttgatcgtctgaagccttcttctctcagctcatcaaagtcattctccgtccagctttgttccgttgctggtgaggaactgcttccctttggaggaggagaggcgctctgctttttagagtttcccgtttttctattctgttttttccccatctttgtggttttatctgcttttggtgtttgatgatggtgatgtacagatgtttttggtgtgggtgtcctttctgtttgttagttttccttctaacagacaggaccctcagctgcaggtctgttggaatacccggccgtgtgaggtgtcagtgtgcccctgctggggggtgcctcccagttaggccgctcgggggtgcctcccagttaggctgctcgggggtcaggggtcagggacctacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggtgggcacccctcccccagcctcgttgccgccttgcagtttgatctcagactgctgtgctagccatcagcgagactccgtgggcgtaggaccctccgagccaggtgtgggatataatctcgtggtgcgccgttttttaagcccgtcggaaaagcgcagtattcgggtgggagtgacccgattttccaggtgccctccgtcacccctttctttgactaggaaagggaactccctgaccccttgcgcttcccgagtgaggcaacgcctcgccctgcttcggctggcgcatggtgcgtgcacccactgacctgcgcccagtgtctggcactccctagtgagatgaacccggtacctcagatggaaatgcagaaatcacccgtcttctgcgtcgctcaggctgggagctgtagactggagctgttcctatttggccatcttggctcctccctccttctgtttattttttattaagttctgggcattatacaaataatatagaagacatcatttacggctctaggacaatgttacgttacttctgagagaacttaactatttttttcttttatgtcagtcaaaataggaatggattaccttaatcaagtcagacacaaagattacttgtagctggacttcagttcttcttagggctagatatatttctagatctcctttactctctgtagggagcccttctggttccaaccaaaaccctgggtgcccctcctccttggaggactctgacctctaatttttgtcctttaaactctatgacactgccaaaagctctgttcagcttcttgatcatgccttttgtttaagaaattgacaatgctcttgagaagaacaagcagctccaattgctgggctcatcttcttagttttcttctttcaggtcatggcctcacaaactcttactgtcttggttgcttttcagtgccctcaaacatgtttaacaaaatgtttttcagcatttccagttgctctcatcaggagggtgtttctgaaacatctagttagccattgtcagaagtagaaccccagaacattggccttgagagaaggtggatccatcttttatagccttggtttgctcttaaaatgttttagaaaagacatatcctgagtgtcttagtggtctagcgtgatggtggtagaggtgaagaaaagtgaaacttccagtatatttaaaaagtggaattaacccgttattagttttagatggagatgagagaggaggattcagggctaatggccaggatctggactgggcatctggatgtccagtcactaggataagtggttgggttagtgacactggagcctcaagtcaccacagtaacagaatgacattcaccacagcctagttatgtaaaactctggacagagggaataaatccaggcaaatacctctacgtatgaaatggacctgaaaagaagctttacctggaggaaaccttacctgactccagagacctttttggtttagaaaacaggaagtaacttgtatctgtcagtatgacacttttgaacatttctgtattagtttgctaaggtgctgtaacaaagtcccacaaactatggcttaagacaacaggaatatattctgtcacagttcaggaggatagaaatctgaaatcaaggactgggcagggctacgctccatttgaaggcttagggaagtcccctttcttgcctcttccaggctttctgtggctgctggagatccttggtgttccttggcttgcagcagcatcaccctggtcttcgcctttgtcctacctcaccttcctcatgtgcctacctctgtgtttcacatggccttataaggacactagttgtgggatttaggcctacatccccatacccccaattgattgtgacctcatcttaatgaattacatctcaaagaccctaatttccaaatgaacttacatacgcaagtcccagggtttaggactacaaaatatctttttgacagacacaactcaatccacaacaatttctagtttatcaccgcgtgaagcttagtgctctctgcaaagatcaaatgaacaagtagtgtacttattgagctgttgcttctgacaaagcactgtgtggggaataaaaagtagcgtggcacacagtctctgtcctagacaactttactgtccaactggggagaccaagagtgatgcagaactcaggaggaaaataagctttggttggccacctaccatttaccagatactgcagtgggggctatacatatattgagccatttaatcatcagaatagcttgctaggtaagtggtattcaccctatattacagataagggaactgagggtcagaaggagtaaataactagtattaagtggtgctatcagaatttgaatctagatttgttgtattctaaagcctgtggttttggggaagaaactgaattatgttaaaaaaaaaaaaaaaaaaaaaaaacaaagctgttagaaattaaccataagagagttagtgtgagagctgggtgtggtggcttgcatctgtagtcctagctactgaggaggctgagatgggaggatcccttgagcccaggagtttgagaccagcccgtgcaatatagtgagaccctgtctcaaaaagaaaaaaaaaaagttggtgtggacaaggaaggcttattgaggaagaagaaatttgaagagaaatcatctgaactgtgtttttaagaaagggtaggagttggctggtggaaaagagccaaaaactgattccaggtgatgggagctacgtgaaccaaggcaaggggatagaatatatcagatgtatttaggagaaaatatattttataacactatatataagatacgtgctttatataattatagcctcattcttcatatggagaccttgaagtaagaaaacaaacatttttagctctgtgtctcacatggtaaggtattggtaaagctgagccttctgccaatgaattttttttccattcctcttcagaaataatcgctttccatttaaaaagtaataattcaatttagaaagaatcaaaatataaagtagagaaaaaatctcacatattcctatcatgcaaatatgactaaagttaacattttggtctcttcctcccagtccttgaatatgtatcagtagtatacataacacattaacctagagagtaatcatagtgtatgtgctattttgtgcttttctaccataacctaagcactaatctgtgccataatatgtcatcattatcatagttttatttatttttattatttttaattttgagatggagtctcgttctgtcaccaggctggagtgcagtggtgtgatctcggctcactgcaaccgccgcctcctaagttcaagtgattctcctgcctcagcctcccgagtagctgggactacaggcatgtgccaccatgcccagctaatttttgtatttttagtagagacggggtctcactatgttggccagaatggtctcgatctcttgacctcatgatccgcccaccttggcctcccagagtgcggggattacagctgtgagccaccgcacctggctatcatagttttaaaggttgaataatattctaagtagataatgtaccatgatttacttatttagggtttgttattaatagcaaattaaaaaattcctaggtcaaaatgcatgacctgtgttacaactcctattatatatatggttttctggaaggtcaatattgattttggcatatatagactgggcttctctgggttgttgtaaaagttctatgtcattgaactacagaaagagggtgaggggatttctaacaattagggccagtgttttcttcacctctaaaccgcatccccatcctagtgtctgcttggctttgcaacaccatccttatcctgagagctttgttgatgcctggggatattcagaaattttcgacttggaacccttccaagacatttgctattttattctctatttgtttttcttaagcaactaactaaataagaataacatttcaacctctttctactccccacagcattttttcctgcctgcaccacctctgcctacagtttaaccatggggttgcttcttatattttaaagctaaatacaaaagcacagttctgagaagcagccaagttctgcagccaagtttgaagaataaaactttaaaacagctcttctgtcacacacttgagaggggaggcaggctttgctataaataagtcacattccatttctatctcatcctttgcagtcctcttgggtaatgctttttgtatatgactacagtgttctcgaactgcccactcacccctttcaaccttccattttgtgcctcactttatttaaatgttcaatagttttggagtttagggaccctgcatgaaaggagtagacctttcctttcattcttcaggcttagatgtaatgagattcagtggctaacttattagaaactatactttctctttgtctgtaacgttttcagcagctgcctggattagtttcctattgctgccataacaaattgccacaaatgtaatggcttaaaacaaggccaggcacagtggtgcatgcctgtaattccagcactttgggaggctgagatgggattgcttgagctcaggagttcaagaccagcctggccaacatgatgagaccccatctctatttaaaaaaaaaaaaatacaaaagttgtctgggtgtggtggcgtgcacctgtaatcccaactactcaggaggctgaagtgggaggatcacctgagcctggggagctcaaggctgcagtgagccatgatcgtgccaccgcattgcaacctgggtgacagagtgagaccctgtctcaaaaaacaaaaaaccaagaaaccccacaaatgcattttcttataattctagaaatcaggagtgaaaaatgatttggcagagctgcatgccctcagggggctctaggagaattcatttcctccccttttccagcttctagaggctgcctacattccctaagtcatagccccacatcagtcccacctctactcttggcatcatatctccttctccaactctgaccttcctttctctctcttataggacccccggtgattacatggagcccacacacataatccaggggtacctccccatctcagagtccttaacttagtcccacctgcagagtctcttttgccaagtcaaataacatatttataggtttgtgggattagggtgtggacatctttggagggccgttattctacttatcacactgtcttagaaaaggaaaggaaaataattttggaatttttgtctttttcatagctagggaggaggtacgctgaagttttgtttttccttcctgtatttgtgatggttgatatgtggcaatctaaactaagtctgggatgtctgtttgtattggctgaagttcattggagggcagaaaagaggagagtttcagagactggcagtgaggatgggagggtggcttaaagaccttcacaacctgctcactgggtgctcctgttaggccccacaaacaagcccatgccatcgaggagaagtgaccaagcagatacattcaaaatgaataaaaggaagacctcatttactgtagtcccatccagtgtggcttccttataggactatttgtctctaattattttatttattttttattttttcagagagagtctcactctgttccccaggctggagtgtaatggtgtgatcttggctcactcagccttgacctctggggcttgatcctcccgtctcagccttcccatagctgggactacaggcatgcaccaccacacctggctaatttttaaacttttttgtagagacagggtctcactgtgctgcccaggctgggcttgaactcctgggctcaagtatatcctccctcctcagcctcccaacatgctgagattacagatgtgagccaccatgcttgaactatattttaaaaaaatattaattatgatactaaacaatacagtgaataaataaccttctcatgactgtccatctggcatagtagaagactttatgtgcttttttcaaacaatgagagaaagtgctggcatatcgcacttcccttagcttgagagacatgtgccaatctgcttgttgactctgccaaggcctctctttccgtcattttccatgttctggtcaggatttgtgacatatagtggctgacaaaaggcacacaagtgatagtgttggtggccaatctgccagggaagagtctgaccctgggcgctaatgtgactcaaggtagatgagcccttcgaggagctagtcaaggaaacagatgataaagtctaactatcagtgagcgagcagggggtgagcattttctttctgaagggagttattactgtcattaacttcattgcgttgctgggaaggaggggtcagtagttgaaacaaaagtctcctatggctgatgacatgttacaactttaggacagttgtcagcaagcaacttgctgttgggcctaatctgtccccatgcctttgatcccttgagcctcaggatggtttctacattttgcaatggttgaaaaactttaaaagagaagccatattttgtgacatgtgaacattatgtgaaattcaaatttcagtatctgtatatcaagttttattgaaacacagccacatcatttgtttatgaattatctatggcttttttttttgagctaccacggaggagttgagtggttgtgacagagactgtccgtatgaccggtgaagcctaaaatatttactaactggctttttacagagaagtttgcagcttctgttttcggagatttgaaagagactgaaaaagcatcggcaaatgtccttgttgggacaatatttccataggaaccaagacccagtgattccatgtggtgctgatttatttccaggaacccatggagggtctaactggggagggggtatacaagataaattagaaacaagtgcacattcctgtactacaaaaaatatacaagacctgccattcacccctcaaataatatgtttcctttcctgaggggtcacataatttatgccagtacattattgatgagatttttgtttgtttttttaaaataaaaaacaggcatattgagctgctggaagtgttgagctggctgttctgaaatatcccactaggatattccacttgctggctggctacctccatctcagatgcaatgtccaaatggctgtcaatttctgcaggacccactttgtgccaggcattgggccagtgctttgggcacgtgaattgctcacactgagagcactgctgtaaaatcattgttattcccatgccgcatatgaagaaaggagcttacactgggtaaacccatgcctgggcctcccctgtaagtgggaatcccgagttgcaggtcaggctgtctcttcttcacagaccatgctctttcacaagacctggaaggaacaagacaaccacctggggagctgcttacttctgatctttcctctgggatgccagggctatcacaacctcataggcaagatactctaatcactgagttatggtgttcggtgataatatcgacttccatttttataatttcttctagcactctgcatcctgcatgttatatttgtaaaaggcctgtgaaaaacataaggcagacatatctatttctgctttgtaaatgaggaaactgaagctcaggggtaaagaggcctttctaggctcaaccagcttttagtggcagagccagacctcttgacctggggtctggtgcctgtacactacttcccatgggccaggtctttgggaatagagctgcgtcactcacacttaccttagcagaggctgtgatagactctaagccgtatggtttttagtttatcctcagtgaacctcaggtcatcaactgacctccagagacgaatttcacgttgtagatggttttttttgttggcattactttacaactgtgactctgctgaatgcactgtacctttctctttcctattaccacatccattgcttgagtttcagtcctgtcttagtccattttgtgttgctgtaaaggagtaccagacactgggtataaagaaaagaggatttataaagaaaagagggttatttagctcacagttctgcaggtgtacaagaagcatggcaccggcatcaacatgtcagagaaggtcaaaggagaagtgagtacgtgtgaagagacaccatacccaaagggcatcctggctttacataataataaaccaacctaatcccatctcgccagagtgagaacagcagcccagcacgaagtcattcatgagggttctacgcctataactcaaacaccttcccctaggccccaccttctgacaccaccacagtggggagcaaatttcaacatgagatttgatggggacaaaaaatcccattatccaaaccatagcaagccccaatccaaaccaaaagcagatccccattcgtggttcccctttccacatggttccaaatgaggaagggcaaaattcatgtgttctgctcagtaaaaggttgaaaagttattgggaaacacatcttccaaggtttgtgtcctttgggacatgggaatatgttattaaccaggacagctgctcacagctgcacagggatgtactgaaacagctcattttaagcaaattttaagtagtggagaggatcattcctgggcacatttcacaagcattctgtcttggttttaccccaatctctgcatattccttcttcgtcttcattcccggggcagcttcttctgcccaccccgtgaaactttggcccattcttttctgtatgctgtccaggggccatctcctcctctctacatgctgcattgaggatccccaaattgctatcctctctccaaactccaaatgcctatatccagctaccaaaaagacatctctgtttgaatcttcctcacttaccacaaacataacaggtagaacatagcttatttcttgccctgccaaaactgttctccttctgagcttcagtgcttggtgtagcatcctccacatagttggcatcggaggcagaacctgaacctgattctctttgacaggcctaatcactcaccactctacgcaatatgaaaatgacatgccatgtgaatccaatgccatgtaaaaaaagataacattttctgtttgtctccctaggatattgtaaatgcttggcaccaagtaggtgataaataaatgtgaaggacaaacctgttgattaagcgttcctgagacatatcctttatctttctcagatgagattctctgccacatagcttatccctgtattgggtggattgtgtaactctgaggttcaaacattgggtattgcctctaaaccttgcacagttatttatctcagaactattgagtttggcggctgtccacatcatgtaacaattctgctgttaccttcctttccttgttttcttccttccctctctcctcatcttccacattcctatctgtgagagaggatgagaaaaaaacagacaagaagacaaaccaatatttctctcaccaatgaaaaatacctttccgttctgtttttaccattaaatgtggtatttgccctctgtgtctcaattaaaacaggttatttccttcttagtttcttcttttatattttttttcttgtttcagaaatggttcatgttaattgtaaaagaaaaattccgaaattatagataagccaaagaaataaataaaacatgtaacaaccccctgctcagagagttgtggttaacttttgaagtacctacttccatgcttcttttctaggtacatattttaacagaaatagagacttactgtacttgctgttgggaagcttcttttcacataatagattgagaatattttcttgtgacagtcaatattcctctagaccagcaattggatcactttgtttaaagggccacatagtaactattttaggctttgtgggacttactgtctctttcagctaatcaactctgctgttataagtgcagaagcattcacagaaagtgtgtaaatgaatggacatgtctgtattctaataaaactttatgaaaacaggcagtgagccagatttggcccatgggtggggctgtagtttgcctatgcttgtctagaatatcttttttttttttttttgagacagagtgagacagagtcttactctgtcacccaggctggagtgcagtggcatgatctaggctcactgcaacctccacctcctgggttcaagtgattctcctgccttagcctcctgaatagctgggactataggcctgcgccgccatgcttggctaatttttttgtagttttagtatagacagagttttgccatgttggccaggctggtcttgaactcctgacctcaaacgatcctcccaccttggcctcccaaagtgttgggattacaggcgtgagcccacactccactagaatatcatttttaatgcctaaatagtgttctatcttattgatatatcattatttacttaaccagtcagagtaatagctaatgttgtttgaggccttactctgcgcttgcaacattgcttcgtttgttctatttgcattctgacttacacctgcccacagccctgtgtagtgtaggtattattctttctatttaacagatgagggaactcggataaagaacaggtgggtaatttgcctaaggttagatggttagtaaatagaaaactcaaaatttaaatttgtttgatttttagaagccatgctcttaactactcattatgtttttacgcacgttagtaattatttgcttggataaattcctagaattagaataacacatgcattttaaggttttgatatttgttgtcaggttgatatatttggccaacttatatttcttgagtggtatatagcagggctgtgtttctacacccttgtctataacaaggactcttttgacgctttgctactttaataggtaaaacaagcttcatctttttttatcttatgaatactctctatatttcttctaaggtgagtgtctgatgcatgttctttctccattgttcaataagagcatttgtcttctctattaatttgttggagccttttatgtaagggacttctgtggtttttaagttgatgctacatgacgtgttatgaacatagccttttactttaaggagatgttgtctttacaattgaagataattaaatggaaaagtatttagttttaatgcagcattaattagactcctggaattgaaaaaattcccagaaactgtaaggtaagggaggacttactcctgttggggaacttgtccctttagtttccatctcttaagtactagaatttgtgttctttaattggaaccattgctttgctgtggccatggcaacacatcttagctgccatgaacagcgcacactttgacaaaatattttttttagagagtggcttttagatggaattcattttccaatgtattcatggagtctagatgaattaatggatggtagacccatacttttataataatagtaataataatgaaatgaatagttactatctattgatcccttactgtattctagccacaatgctttattttatattatttcatcggatctttgtgataatcttatgtcatagatattgttgttatccttactttatacataaagaaattaacacagaagagttaagtggcttgctctggcttatacagatggtaagtagtggagtttgaccttgaccttaaccttgattttctactgcgtgagtcttacaggtttattatagcctttagggtatatactgaattcaacagtggtagcatggatggcaaatcttgatgtcatctagagtctaagatgacactagcatcagtgggccacagggaatctgacccagactttcataacttgtattattatgaagattagagttctgaagcttactggattagaagagcacgagggggtagctgccccaatatattctaatttctcttgaggaccaccaaattggcagagtgtctctgatagggaaaaggaagagttggaaggcatcttagcctctaggacagaagaaccatttttattggccaccaaagttacatctagttgcctacaaatttatatccaaactccttatcctgccaattcagggttctgcaaactgatgccaaactatagtttagtcttctatcacatgactgcattatacatacccaattatctgggcaaacagacctgatccaaacacagtttgtactttcctttcctttcctttgtttagcctgttccgtctacttggggtgtctttgatttctccagcctcagtctcccgctgttagaattctgggcctccctcaataccaaggttaagtagtacctaacgaagaattttttatttttacagacaaaagcagtttctctcctcctctttgattcttatggttatttatattactctcaagtcaatcataaccttcttatttgtaggatagtttctccctgtaggacttgcaggattcctcgaatacagtgcttttccaaaggtaaatgacgacataccttaatcttgttgttagggattctgactctgagagacatgaaaccactgtttagagtcttgttatgtatgaattgtgtccccctccacccagtccatatgttgacatcctatccgcccatgtctttgaacgtactttgaaatatgattgttgcagatgtaattagtaaagatgaggtcatacaaaagtagggtggactcctaatccaatttggccgtcacactggaaatttgggcttgcacccaccgagaacattgtggaaagattggaatgatgctgtcagaagccaaggaactaccagaagctagaagagaggcctgaacatacccttccccagagccttcagagggagcatggccctgccaacacctaggtcccagacttccagcctctggaactgtgggacgatacatttcttttgttgaagccactcagtttgtggtactttgttgctgtggccccaagaaagtaccacaagcctgaggttttcaccgtccttacagccagcaagacgggatgtttcagatgaccctgtcctatgtggaactgggggctgaggtggggtggcctgataacagagtcaccaaagagctgcctctcttatctgtactcctgagttctcacagccttctgggcatcttcagcaccagcaactcagcatgtcaaaactgaacatctttcctctccaaaccccttttccctcataagcccatctaaattatggttaccatgtccctctcagtccctctggaattcttcccttttctcatccccaattgaaaaaaaaatctggaattctatgttcttctggaaaataaggaagatctggcaacaccaggcctttgttactgcatggctataattggccagatggatgggctgcccctgaacatagagaatgtgtcctgggtcctgtttgacatcgcatgccagaccctgtgggcattggagcctggcccctggcagggtggaagtgattgcctctgcctcacagggacataagtggaaagcttcagatcattctctgagtcaagctgtccggtttatgtcctgctgtgtcgcttactggctgggggcagccatgggaagtttccttgatctccctgtgcttccgtttcccagtctgtaaatggagataataatggtgctcgcctcataggggtgttgagagaattaaatgatttaatgcgcatcaggagattggaacctgacacgtagcaggtgcacctgaaatgttcccttatattcttatgtagtcaagaaaatcttgtcaccctttatctaaactgctttattatttttcatgacgcacggcatatttacttcttggttttactttgctactctccatcccccaccagcttgacacacattcagaaaatgtggccatagtttatacacatagattcagggctggcctaccaaggagtttggacaaagctcccgggatctcacttggtggagctcctgggcctctcctggctgccgagtcccctgtgctttctgccttctgtgttgtttcggttccagtgaccaagggcacagcttggtgactggcctcccgaggccttccgagtcaccgggggatccctctaattaggtacactgttgagcatgcaggtgtatatcctgcaggcaagaagggctgctgaaatagtagcttaacatgaaatccaggcagcaagtcgggtgttcgttagaagtgtgtttttttttttttgtgatttgggacactgacaaagcccagacaaacctccccacaccaattgtttcccccagctgtattccccttattgggccactcctaagcagtgctgatgacttatttagctaatatttgttgactgaatttttattaatcaatagagatttgttaagtaaatggagcattattcagacatgtggcatcagatccattactagatgtaagtgataaataaagtggtaggtaagacacagtcctgcctgtaagagatgtgcaatctagtcattgagagagaccctatgagaaacagtgggtggagctgggggattaccggtgttgtttatgggatcccagagaggaaggaccctgactcagcctgaggttgggactgggggcaactgggggatcatcagacttgtcattattgatctaatgtcccagtaaaattgggcgttttcaggacagggactgtgactgtctttttattgctctatgtcttgtcctagcccagtggttgacatataacagacggtcaataaacatttgatgagtaagggaattaagtgacatctaagctgagaactgaaggatgaggagtctgccaggaggaaagtgtgggaggtaggggaggaagggggtggcgggaggaagtaaaatgatgacgaaggatggtacagggagggaggagcatgtgctccttgagggtgacaaggactgcagttctgggaactgttagcttgtatggtgggtggcatggagccatttcaaggtgggggcctgggcagagctgaatggtgagaataacatagagttcttagtttttacatgatgaggtttgatatgcatgatccaaggtgcaggaaatggattggagaggacagggtggaagaggagaggccattcgatggctattgcagcaatcttgagagatggtggtggcaggacaaattactgacacctgagatggagaggtgactagattcagaagcaactagggatgtagaattgtcagaacctggcaattaggtgtctgtggggaaggaaggagagatgtatgaatgatgctcaggcctccaggggatgtgggcaccacttacttgtgatagatgagaagaggagctgtgagaaggttaaattcacacttgggcatggtgagtttgagatgcctgtgggaagtccagagcgcagttgtatacagcaggcttcacctccagagagtgatcagatttgagatacaggtttgaacactcattggcatagagggtcagggcttcatagcctagaaggacatagataaaattaagaaggcctatgaacttcagaaattatattaaaatcataatgcatgtgcattgttctgaagagctagctttgtatcaacttttcaaaatgtctgtgtcctcaaaaaggttaacccttggtgcatatggttaatgaagccagaaggagagatgagatttttcaggcagcaagaagggaagagagccagggtttgtgctgcagaaaatatcaacatttcgggggtgggaggcactgtgctgagtcagaggcctgggggtcagagttctgggaatgagataaagacttacaggtagcaatagctttactgttcataaagcacttttacatacaatgccattttatctctcaggaactcaactagatctttataatttggctctgtatcagttagagttcagtacaagacatgaaaacttggctataaattttaaagaagggatttcctagagggaataggtgcttactatggacccagaaaatctgagataggtctcagttaatgtagaaagtgtattttgccaaggttgaggatgtgcacccatgacacagcctcaggagggcctgacgacgtgctcaagctggttggaatgcagcttggttttatacagtttagggagacatgagacatcaatcaatgtatgtaagaagtacattggttcggtgtggaaaggtgggacgactggaagcaaaggcaggaagactcaaagcggagagggagcttccaggtcatagataggtgagagacaaacagttgcattattttgagtttctgattagcctttccaaaagaggcaatcagatatgcatctatctgagtgagcagagggatgactttgactagaatgggaggcaggcttgccctaagcagttcccagcttgacttttccctttcacttagtgactttgggggcccaagatattttcctttcacattacaaaatctctggaagggcagccccagggaaagattcccagaacaatatagaactaaggtcagagtacatccctgtagctgccaccctggcatcgaaaagctgggactggaaagccaccatggctgcagctctttctcggccttcatggagctgaaggaaggatgctggacactactgtattaagaaatctgttttcgtgacctgccttgatagcagtgaacagtcaaatagaagccaaagcatggccctcatctcacttccaccttctagaactccttgcttgagtacatttaattagtggaatccacttcagtcctgaatctctagatgcagagaagtctggaagatatctttataccacctctcttcctaaaaggagtgtgaaatggagctagagaaggggtcttattttgtaagggtcaagttaagaactgtttcagtcttagtgagccatgtggtctctctgcagccttgccattgaagtgtggaagcagccagagaccatacagaaatgagtgagcatattgtgttccaataaaactttatttataaaatcaggcctggcacagtgtttcacgtctgtaatcccagcactttgggaggctgaggcaggagtgagcttgattgtgccacagttctccagcctgagcaacagagtgtgagaccctatctctaaaaaataataatgataaagttagttaattaaattaaaatgagtgatggggcctaaaggccacagtttattgacctctgaggtaagcaaatcaattctcaataattatcgtaggttcttttttacagatgagggaattaaaaccggagagcgtcagtcgaagtgaaaataagtcctggttatttagttttcaaagttcatgttctccaggaaatcctgatgctcagcctctcctcttacaaggcttgtgatctaaaagaggagataaaatatgtactttgttggtgcagaccatggtaaatgctcccgggatggtgcggaatgcttttgcatacaaggcatttttgacaggagaaatcagaagtatgatggtgaaagtagttttagctagatgttgaagaaaggtataactctaacaggtggagatggagaagggaggagtcaaaagagctgatagggtttggctctgtgttcctgctcaaatctcgtgtcaaatcataacctcaatgttggaggtggggcctggtgggaggtggttggatggtgggggtggatccttcatgaatggtttagcaccgtccccttggtgctatccccgcaatagagttctcatgagctctggttgtttaaaagtgtgtagcacttcccctctctctttctcgtgctctggacatgtgaattgcctagctcccccttcaccttccgccatgattgtaagcttcctgaggcctccccagcagctgagcagatgctagcatcatgcttcctgtacagcctgcagtgcatgagccaattaaacctctttttttttttttataaattacccagtatgaggtatttctttatagcagtatgagaactaatagagaatttttgatggagtcaaaaactgcaagagaagtttaggaaaacagctagaaatggaaactcatctgaacattgtgaccttctatggtgttagtggagataagactggatcagggagaaccttagatagtaggattaggaatccgaacttggaaaaggggaagcactgatagtcttcgagcagggttgtgatacacacattacctcaggaagaattatctggttttgttctacagaattttgtgtaagtcagaagatacagccagcaagaattcgctcaggcggttgttgtaatatctttacatgaggatgcaaaggaagaagtggacatgagtcttgggccattcatgggacagggcaacttgtaaatgtaggtggaatagaaggatggctttgatgggaagagatgaaatgaataacaatacttgggaaatttgaggaatgggagcttgttttgtgggtaaagtaatgggccccatcttggatatgaggtgctgaggggcagaaacggaaatatggagtaggcgattggaaatgttggcttcatcttcaagatggggttggttgggagtcatcccatacaggtggatagagagccaagtaagagctcagctctctgagggagtgtgtacagtggaggatgccggaaggagaacccaggagacaaaggtattccagaactgggagagggacaagagataggaaaatgtagtaggcagggtagtgagagtggcaggatggatgttgtaccagaggagtcaagttagggagctatttccagaaaaagaaagagccaggaatgttgcatgccacagaaaggtcaagaaatactcgaaaaaccactggatttggtgaccacatctcaaggtcatgggcgaccctgagagagctgtttagtgtgtgttcttctcttgaggagtttcatattgaaagaaaagaggagagaaaatgggagattgaaatttgtggcttgttttaaagtggattaattcttcagtgccagaagaccacaaagaacttggtctgagaatatatcctgatttctccccaagacttttcttaagaaaaagcaagttgaaagaggaacaccctttagtttcgttctctcttgatttcaggattcggtttttggtcagttgtttgtgtctgactccacttttggccctgtcgtggggccgctcctggcaacctgggaggtcacgcacaagtgtgtgcagttgttaagcaactgctcgcagtcgcggtggccctgctaaattgggaacatgtattcgtcccagtctgagtcttcattcagtgggaaacaatgagtccctgactttgaaatctcagaggttacacatttgtggaatatgaaatcagtgtgttgatgatttttcctacctcatagaattctttaaaaataacactggagaattgctatgcaattctgtgaaaatttagttctctctagggccttttctagaaaaaacgttatgcccaaatcccaaaaggaactgagtattttatatcaatgctttctaagataaataaaaacagaacacacacacacacacacacacacacacacacacacacacacacacacacaacgcagcaacaacagcaaaagtcaataaaacaactcaccaaactaactctagagtttcagatggaaatgatgttatcagtccaaattaaagacatattctcttattttcttttacaccttggtttgtggcttccataatacaatcatctgagtcttgtatggtttctgaaatggatgctagaagagataacttgaatgagtacttttcccctggtggaattctcttcctcatctatatttaaacagttgttttgcacctaaagggccctaagttacgtttctctggagatatttagagataagaagtgttgtaagtactctttcacatttgtgcagaactttagtctttgaagtgtttagacatccattaatctttttttttttttttttttttttttgagacagggtttccctctgctgcccagactggaattcagcagtgcaatctcagctcactgcaacctttatctcctgggctcaagtgatcctccctcctcagcctcccaagtagctggcactacaggcctgcaccaccatgcctggctaatttttgtattttttgtagagacagggttttgccatgtcacccaggctggtctcaaacaatctacccacccttgcctccaaaagtgctgggattacagacgtgagccactgtgcccagcatccttaatctcattctacctcactttctgcctattgagagataggcaccccaagtaggaagtccaaatgctgataaagaaattgggattcagagtgacttactaactagccccagatcacacagcttattagaggcagattcagggctaaaggtcagattttccagctgcagatttattctgctttgagtggcattttagacattagtgttttctttaatccttaagcatttcagtgtctaaggtttgtataacatcaggttggtttctggtagtacgttgattgtggagagggcccagaagcagaaaccacagtctttacatgatagttactcttatctgaggtttggcctttattgaatggaagtctcttgttaaagaagggtatgcattgaggcaagagtcttgccaacttttcaaaaaaaaaatgggaacccctgggctccttggggatggctaatgacaatgattatggaggaggctgcaaatgtgaagtactttataaatcctggaggtgtggcagtagactgtgtgtttctggggagacagatttttgcatacattatcctctggacacttctgcctttggtgcatgcttgtttttataaaaaagcttgttttgttcctcctgtagaaatgagcctatcatctagagtcatggtggttttctgtatgtgtgagcttatgcttcagttacactgaacactcgtactactgcaaaatcgaattcagtgacattgccaatatcttcgctctcagtagtctttaaatattcttagccctgggaactggcccaagaaactgcttattcttttccctgtatcacttagcatataaatcctgaattactgctgactgaagatacataaagtacaaatcaataagtattttgtttctatattttggagaatgagacaatgagtgaaagagaacccctcaatgagggctttaaaatattgtcattgttctatggattagtagagctgcggctactattttacttacccactggccaccaggtactcacactgcagtgaaaggattcctaaaaacatctttattaagatattcacatactatacaatccacccatgcaaaatttaccattcgacgttgttggtatattattactttgtaaaaatcatggccctatgcacaacatacaacttgccactttaatcattcttaatgtacggttcggtggcactaattatgctcacagttttgtgcaactgtcactgctacctatttccaaaactttttcatcatcccaaacagaaactgtgtacttattaatcaacacctccccgtgaaagaatttttaaacataccttgattattagctttggatgtatataaaacctttaaggaagattttgtttagtctgttttttttcagggaaagtttattttttaaggggcagttccatacagtaggtgacacaggttaggttcctccagaaagcagcctcttatagtagcatgtgggacattgccagagtctcaggagcaacacttctaggggatgggggaagggatggagggaggactgggtaaaaggagaacgtgtactgtgttgtcattggaaggcctcaccctacccagtggaactctggaactggcatttcccaagttggggcaacagggatggatctttgtaccatatcattcagtcatagggttcagctcccaggacggcgcatgagcttggacaaattctctccagccaagggtcagagaaggttgacagctgagagctaagagccagcagctgaggggtgaaatgctcagtccatactttgccaaactttgctctccactggaatcacctttgcatcctcaaaaatactacgcctgatttaattggtatggggtaagagacaagtggaatgcttccaaagctccccaggaggtttgaatgggcaacacagattgggaatggctgctttcagtcttgaaggggagtcagcatagtatacatcatcatgggaaatgcctggactttggattgaaaaaaagttgaacttggctcaaccatttactgacgttgtagttcttatttatgttctgttaagattttgctactaggctttaaaaaatatgaatggatggtgcacctgggtggctgagagggcacttacaaattaaaacaaaaacagtgaacacctccagaatttgatagaacacaagaatgcataattcataaagaagaaattcaaatgctttttaacatttgaaaatatagtcttaatagcaactgaaagaatgaaagttaaaactatattttgcttattatattagcaaagatgaaaaataattgctattgctcagtaatggtgaaggtagtggcagaagacactctcaagctcagcacagtggttcatgcctgtaatcccaacattttgggaggccaaggtgggtggatttcttgagctcaggagttcaagaccagcctgggcaacatggtaaaaccctgtctctacaaaaattagccaggcatggtggcatacacctgtggtcccagctactcaggtggctgaggtgagagaatcacttgacccccaggaggtggagcttgcagtgagctgagatcatgccactgcactccagcctgggtgacagagcaagaccctgtctcaaagtaaataaataaataaataaaacaaacataaaagaaggcattctgatcctcttggtatgtccattggtgtaacacgaatggtggaccatttggcctccattcatgtgtctaccaatgcaatgtagataaaaattcataaaaagcgaatgccttttgacataacaaatctaattctagaagtttatcctgaggaaataacagaagagtatgtaaaaatgtgtgcataagttgtaattgcctgggtcttgctggcaattaggagaagcacaaatggtcattaataaaatattggttaaataagttctggtacatacctatgtacttctaatgagagaagccattaataaaatagtgtgagcctatttttgcattaaaacatttgcattgaaaaatgactttgagaaaaatatcagatgttaatggtaaacagtgtttttccccctgagtataagaattatgggtgaattttattgtctaactcatatctctttataatatttatacttagaaagtattacatgttatttaattatgtgttaattttatattcataaagagcatagagctatttccaaaaattacatatttccaagattacacacctgcatatctctatctatctatctatctatctatctatatctccctattcattcagcaacctaaaatgaaacagcctataatccaattagtagttatccctagaatttgaggtcacgggtgatttttattttctttcttgtgcttatttatactttacagatttttataatgagatcatatctctcttataatgagaaatgttttaaaaaagcttttaatatctcagtgcacttgcctgacctattttatatccattcttgcatctatttcatttgaagggtcctttggatagcatttctttctccatgtctttcttcctgctgtcctatttaaataatcacaattctgtgttgaaatttttgtatgctttacctaattaggacaaatattctgactcttgcatttgttatcaagatgtacatttttactttattcattattgttttttttttcttaagcaaagtttggcctttagatgatgcatttccaagcctagcatccatcatctaccattatgcttttgactcatctattaaatagtaatgtgtcctccaaaaatattgatgttaaattaaatgactctatatttgtccttggaaaaagctttgaggctataaaatttaccaagcaggtaggacatgcaaaaagagaaatgcatgcaaatgcttcctataggcaggagctcttcaatgtgtctgacaaatctcatctatcctttaggtcctaaattaaacatcacttctctgtgatgcccaccttgactttcccagggtaagctggtgctgacttctccttatgtttattatgcctcttattaaatcttattttaagtagttattgatgtctaccaatgcattagaccaccagataggaaatatggttgccatccaccaacactcttccaacagtccctacctcctcatattcaagcccctgacaaatagatgatgacagacgcgaccatatgtcacttccaagattaggttttgaaagacagaggtttccgtgttgggctgtttctcttggcccactaacctatggaaagctagctgttgtgacgataggcaatgtatgcagagaggctcatgtggcaagagctaataaaaaatggaagctggccacacacatgtgagtgagctttgaagcagatcctcccccttgtcaagccttcaggtattacaggcctggccatcagcttgattgcaaactcataagaaactctgagtcaaaaccgtccgtctaaatggctcccaattcctgaccttcagaaaatacgtgaaacaataaattcttgttgttttcagttttgagttttaggatagtttattatgcatcagtagataactaatccacattggtactagaggtgcagtgcttatgtaacaagaaactaaaatgtgataggactttgaacgaggcagcgggctgtggaaaagctgtaaggattaaggaccatgttagtaaaagtgtaaagtgccttgaacacactgtccatagaagtttggactttgaggaggctgccattgaaggcttcaaggaaaatgggagaaatcctattggaaactggaaaacagagaatctttgttacgtagtggcaaaaaaaagaaagaaaaattaacaacactgtcacctgcagtaatgtagaaagtagaaaatgtgcctgataaactggtgatatagttaaggagatttctaaccagagtgctgaaagtgctttctgattttttttttttcctgttgcttagagtaaaactgcaagaagagaggagaaactgaaggtaaaactattaaataaaaaagagccaggacttgctggttttaaagattcccagcctccccacatggtacgtgatgctaaaattaagaaatggcatctgagcaaagaccaaattcagggcacttttaggaaaacaaggtccaaacattaagccaaggatgcgactataaagtcttttcttaacatctcagtaaacaaagatagtgtctcagaatactgtttagtcagaaaaacctaaagatactaagacaagcttgtccaacccttggcccgccggctgcgtgcaacccaggatggctttgaacgtggcccaacacaaatttgtaaactttctcaaaacattatgcgtggacctttatttttatttttattttttagctcatcagctattgttagtatattttatgtgcggaccaagacagttcttcttcctatgtatctcagggaagccaaaagattagacacccttggacgaagggcttgccttacagatcctctctatcaaccagtagtgctccctggaagctcacagacattgtacctcagtccaagctcaagaaggacctgtttcaaagagatttgtgggtgtggcttttgtgtagtggaattaagcctaaagggattcccagaagacccatggagttgaaagggggttgtgcttgaagaaacaccatcagctggaaagaaaagagacataaagagtacaaaatgcagagaggcctttggaccaccaagtgtcaacaagtaaaaagcagactgagaaaactaactccccaagcacatgttacctttcatgaaaatgaaaggatgcctgagagggcacactcaagatttcaaagggtgagactaaagccatagagaaatattcctaggccttaattagagaccaaatcaaggagcttccatcatttgcttgcctggatttcagaactactatccttgcatacttcccattttcccctttgtgagttggagtgtctatggcagttatcctctccttatcctgcccttgcatgttgggtgcatggggccagataacttgtttctttatttgcacatgcctctatatcaagaagaaccacattcaattgttgtatgtcagagactacacccaagaaggctgatttagatgatgagggtctggacttggaactgatgctctgttgggatgagacttttggggacagtaggaggggtgggagtccttgggagccaaagggtgtcctgtgttaggcagcctccaagatggctccctttgatctctgactcctggactcacagagttgttaatcccctccccatcccacattgtactagggttggcctgtgtgaccaattgcaaatggcataagtgatggtatgtcgctctcaatattagtttattaaagactgaagcttccattttggtcctgctctaatcccgtgctttcctggatccctcacggtggggaaagccagctgccataagttgaggacattcaggcagtctggtggaggcccacatggtgaagcagttccagccaatagccatgtgaccctctagttccaatcaaggcttcagatgatgcagaccagattgacagtttgactgtaacctcatgagatactatgtagaaaaaaactgctgtaggccttagacttctgtacttacaaagacttcttgcaaaattggcttggctggcatccaggaatttggatttaggggaggcctgacaccatttcctaatggataagagtggttcactgtgcctaaactgtaaacaatattatttatgctgagcacttgctttccatatgggagtcttggatttttatatgtgctaggcagagggtgtgtaatgagcaaccctcagtaaaaaccttgggccaggagtgctggcttacgcctataatcccagtgactcaggaggctgaggcaggagggtagcttgaggctgggagttcaagaacaacctgggcaacagagcaagatgccatttctgaaaacagaaaattagccacgcatggtagtgtgcacctgtagtcctagatactcgggaagctgaagtgggaagattgagcccaggaagtcaaggctgcagtgagccattaactgtgccactgaactcccgcctaggtgacagagtgagaccccccaccccaaactctaaaaaaaaacagacaaaaacattgagcactaagtctgtgataagcttccctggtagacagcattttccacttgtcacaatacgatgctggaggaattaagcccatgctgtgtgattccacagcgagagaactcttggaaacttgcatttggttccttgtctggcaaagagaaaaggtgctgattttgctttatattcttttgctataataaatcctagctatgaataatattatatgagtcctgtgaatcctcttagccatcactgaatctgggggtggtcttgaggacctccaacccagagctcctgagctaggagcacctagatcttcctagaccctcagaaaccataggataataaatatttgttatgttgaggcactgagttttggagtagtttgcttcacagcaataggtaactaattctggaagccagtcatttctctcttcccagcatttagtttagtgtcttggaacataggtgttaaagaaatatttgttgagtgacttgacactatttctgcctttgaagaagttcatagtccatttggttcctttgctggaggaatctaaatcctggcttggtattatgaagcaggcttactctcttttttctgtggcctagaagaatcaatcgcagtggcagcagcctgccttaacgttgtcaggttctgccatcttccctgttgaatgagatccatgggtataagaattagtgtatgaccatgcctcttctcttttactcacttcttaggtcctttgatttttattttctctcccttctatgtcatggcagtggtagctattcttactattgaaataaaaacttcttcctgctgaaaaattaattaccaaatgtttcagggccttataagatattaatatttccatatcgagtcttgcctcttactctatcatatgattgccttgaggaaagttcagacaaattaactttccattttacattgcaccccactttcccagcttctgcaaactgtcttgaaatagactttatagaaagataggaaccatttccactaaaatgagtttaatgtagggaaaaaactcaaagtatacactgaaagtagacttctttgagtcatttacagttaaaaattattttaatctaaaggtgtatttgagtgtgtgcacaggtatacacatagaccgccccccaccccatactcattcctgtggcacacttcttgctagttgttggcactgttaaataaaaattacagggggccatcgttttggactaagcttctgcacttggccccaacaaaccagattgaaaatcaaaatggagtcactcatgctaaagttccatgtcaccttccaataaatcaggggaggaagataacaatctaattttccaaacagggcagtttcaatcttcaatcagcctgatgaagttctctctgctttaatccttacaacaaaaagtaacctgaaggaacgtgatgttaactagatatttttttctctattgttctgttttcctgttcctggattacaaagaaagtaactatgcaatgaccaattgcttttgttctgtgtttctgctttctctagcccttttctgcttacaaagccaaccatctctgcccactcattgcagcacttattaatggcaaaaccgcaatacttttgcaccaaaatatttaatggaatgaagtgttgttctattctaaaattgcaaataaagctacttgagctcctgaaagtaaatttgttgtaattttgtcctttgacagatccttttcctcctctttgagtctccttccggttcagcagatgaccttggttatgagtttcatgagaatcccagggtgatctaatagaagctctctcatttatcttctttccatctaattttttacaatttttattgttttttcttgtgtcagagaatcatctacctttgtttcaaagggttctagtcctgctttcaatcccatatacttgggcctgatggatctttcgaaagtgaaattgtggcctcatgatggcatcatttgaaagcctccgatgactgtttcccgaggagggtgaactttctctccttacctgctcttgctttcctgcctccattttgctcatggcattcccttgaattaggttctatgagtggaatacagctttgaaggcaattccagagatccaacaaaaacccaggagattggaaggaattcatatttgtcaaaaaatgtgtagctcaaaaatataaaaaaaaaaaataatgcaaataaaacccaatagagtataacaactatttacatagcatttatattgtattaggtattataactgatctacagatgatttaaagtatagaggagggtggcataggttatatgaaaatactacaccactttatattaatataagagacttgagcatctgcagattttggtatcctctgggggggtactggaggcaatcttcctgggatactgaggggtgactgtaacttattttcagtactttggtaatagtgtatttaacggtctattgtttctcagggtttgtggatgatagtccattaggatctgaaaataagatattagaagttctatttacttttttttgtttttctgaaattttaagtgtatatgaagttaagggaatacatgtaattttgaaataattaaatattcatgtttggaaatctgttcaaatttttgggtggctgggaacacaaccaaaaagatatgaaaaccaataacaattatgtatcagtaggcattttataaatagtctttgatattattttggatataagtgatttgattggcacttctcatttaattgcttattaggtgggtttctgttttgtagagaacatttaaaaaaaatttagacaagcaaaagttaataaaatcacctgtggtatgaccactcagaggtaagtataatgaatgttttattgtatcttctttgcagctagttttctatacacatagacatgattttcttctaaaaaaggaaagatcatgatgtatttataatttgtaaaacttttataccttgctctttgaactttaaagaatgtcatgaacatttccttagatactaaactctttccccatatattttaatggccttattatatgaacatataaaaataatttattttgataccttaattcatgtgctgttggatttttaggctcttgcaccattttccccacttctctgcttgctgttataaacagttctgaaaaccagatgctgttagccacaccatacatatctgtgatgtttcctgacaagattcctaaaagtagcaccttcctttcataggtgaggttttacctctacctttgttgtctgtctctaaggcaaaggcaattttgtgtaatggtgaagaactcaggacagaatttgaattgtgcctcaaccagttactactgtgtgactctgggctagttgtgaacctctctattcctcatttcccctcatctgtaaactgggggaaacactaataccaacattgctgggtggttgtgagcaaacaataaacaaataatagtgtaagcaaacaataaattttagcaattgtttataaggtatttctcttgtcaagtaagccaagttaatcatctaatggctcctataaaataaagcatagggccaggtgcagtggctcatgcttgtaatcccagcactttgggaggctgacgtgggcggatcacctgaggtcaggagtttgagaccagcctgaccaacatggtgaaaccccatctctactaaaaatacaaaaattagctgggtgtggtggtacgtgcctgtaatgccaactactcgggaggttgaggcaggagaatctcttgaacctgggaggtgggggttgcagtgagccaagatcacgccactgcactccagcctaggtgacagaacaagactccgtctccaaaaaaaaaaaaaaaaaaaaaaacaacaacaaccataaaataaagcatagttatagtattcagtaaggtgaatgacacattaatgactccattttccatttgatcagttcttacatccaggaaccatgaacacagctatctcaacatatggtagtttatagggatagtctgtaatcttgcaaatttaaaaggtaaataggagtccttcagtaggcagattcatatattgacaaatgaaggaagaattagtcttgttagaagaaacttgccatttcgtttgtgaacaatgtagttaatttatcacaggctcagtgagggcaaggatggagctatttcactttactatttgtgtacagatccagctcttgggccgtggtaggcactcagtgaatatttgtgaaatacataaatattcatgagcaaatatatctatactttgttgaatgtattgcaatgtatgttgtaaacataatgaaggctttgtgtgatgaaccgacaattgacaatgaaattattgtctgcaaagtgggctggggccttcaggcttttctcctgattatagattcagaaataatgcaagaggctgttgctcaaagtgaatcccttactccgtgctggtcgtgttctttaattcatgtgctgttcccttgtgtgtgctcagtccttattgcagctgctgggtctgagctcactgtgaaaatcgtgtttcctttctgccgacccatagggctcagtgtttgattaataagtttcccattttctgagaaaaatacctaggtaaatcccccttggacagcacaaggatctgcagtaatttacaaccaccgtgtgagccttgtgttgaatgacatgctctttgtaaggatatggcataatttataatgctggccccaacgtccactcctagggcgttctcagtgcagtgccttgactctgatattggataatgttgacagttaagagaggaatgactttagttgctgctgctgaattaaaaaagtcagacacacagtctaaatggattttgctgtcttcaaagtagtgaccttgggatagatagaactctttgatgcttccattgatgttgctattgccccaaacatttccggaatcctttaaaaattacctttaaagcatgtggcacattcttgtgaatatttttgagtctaacaaatactcattctttgtatgaggctttgatttttggaaagagtgaagagtcactggcatcaagtgcaacaactgaggtgggtgatgagggcagagagtgctggttttgtttagggcaacatatggttttagaggccttttaataatgtcatgagacttgagcatttgttctaaacatgatttccttttaaaataatgtttgaaatgatgaaatagtccaagcctacagaacacaacattacatgccagataggcacgttcccagcatggatgttaaacagatgttaacgtgctgtgtttgtttgcgtgtgttctttcatcttgctctccttccctgttttttctttgaaagacagtgttttagatattcctaaacaccccccgcttccctccatacccgtctgccttctcccctttttccatcaatattcatacttctgccaatgttgccatgcttcattcccaggtgtgcttgtaccttttgaggaaatgtttagaaatttaaaggaattatcttgtgtgtgtccttctaacattgtctttgaggtttatccatgttgatttgttttaactgctgttttagtccatttgtgttgctataaaggaatacccgagactgggtaattaataaagaaaagaagttcatttggttcctggttcttcaggctgtacaggaagcatggtgccagcatctgcttctgctgagggctcccagctgcttccactcatggaggaaggtgaggggaaaccagtgtgagcagatcacatttcaggaggggaggagagaaagagagagaaagggaggtgccaggctcctttcaacaaccagctcttgagggaactagtggagtgaattaactcattactgcaagggcagcaccaagccattcatgaggaatccgccattatggcccaaacacctcccatcagttccaacctccaacattggggatcaaatttcaacatgagatttggagaggacaagcaaaccaaactatagcaactgctccataggattccagtatatacgaataaatcaagagtcttcatctgttcacctgagagaaagttcagatgctttcaccttttttgttattacaaatagtgatacagtagtaactgtgtgcatatctatctagaaatatgtactagaggttgtctagagccagtactcagaggaaaaatggctaggttctagaacgtgcacattttaacttagtggacattaccaaattgctctccaaagcagttgtaattatgcttccattggtggtttcccatatcctcttagttatcagatttttaatttttgctaatccgattggcacagaattgtatctcattgttttatattgcatttctctgcgttctagtgtgattgagtgtctcttctgtactcagtggccgtctgagtttcgtcttttgtgaattgcccatttatattccttgctagtccttctattgccattggcctttttattaatgatttataagaatcatttataatctagtattctttgtcagtttaatgggccccaaatatctttactactctgtggcttatgttttgactttttatgatgtctctaattaaacagccgtgctaaattttaatgtaatcatatttatccatttctcctttgtggcttgtacttttttatgtgtttttaaaaagaaatactgctctatcccaatgtcataagaataatttcctatacattcttttaaagttttcaaatgtagtgtttcacagacacttagaattgatttttgtgtatatgtaacattggaatccacttttatctttttccatatggatgtccagttgtctcagttacatgtatcaaatcttttcccactgtcatacaccacattcccaaacacgtgtgactgtgtgtggcttctgttctttattttatttttatgtttatttttattttttgaaacggagtctcgcactgttccccaggctggagtgcagtggcttgatctcagctcactgcaagtgctgcctcgcgggttcacgccattctcctgcctcagcctccagagtagctgggactacaggtgcctgccaccacgcccggctaattttttgtatttttagtagagatggggtttcaccgtgttagccaggattgtctcaatctcctgacctcgtgatccgccctcctcggcctcccaaaatgctggaattacaggcgtgagccaccgcgcccgactgttctttgttaatggtgtgtttgcttactctggctctaccctattttaattaccttggtcttataggtttgggtagtttaagtttcacttcagttttcttttttggaattttttttggctattctaagctcattatactttaaactgtattttaggaatgtggaagccctattgggcttttgttggaattactcagatggtttacagataaatcgtaagaatttgctctcttatcctgggtcttctcatctacaactatggtatagctatgtttatttagttctctttttaggtctttcagtagaattttgtaatttttgccatacttttcttacatatctttgttaaatgtctttgtaagtatctcatttctttctttcatttgttcctttttttgagataagatctcccaggctggagtgcagtggtacaatcatagctaactgcagcctcaaccctcctgggctcaagtgacccttgtgccacagcttctttctaagtagctgtgactacaggtgctcaccaccacatccagctgatttaaatttttttatcccacattttttgttgctgtcaatgatatctttttattgtatcttttcctattattgctggtgtataggaatgttatttttgtatatcttgctgaactcattaattttcatggtttagatactcatacattatgcagacagataaaatcttttaataataatgacaggtcttttccttttcatgttatgtggcattcacttctttttcttgtcttgatgtactgacttggactttcatgatatcacctgtttttgttaataaagttttattgaaacacagccacatccatgttgtctgtggtaccattgtattataacatcagagttgaatagttgcaacagagactacctagtttgcaaagcctaaatacctgccttcaggctctttacagaaagtttgcctatcttcacaaaacagggttgaacagaggcagtgatagtaacctttcttgtctcatccctggctttaaaaggagagcttgtgccaccaagaataagtgctgcttctgggttggttgatgtgtgccttttattgggttaagaaaatgtcttttttttttcttcaacttttattttaagttccagggtacatgtgcaggatgtgcaggtttgttatataggtaaatgtgtgccatggtggtttgctgcacacatcatcctatcgcctaggtattatgcccagcatccattagctattcttcctgatgctaccccacacctcacaggccccagtatgtgttgcttcctcccatgtgtccatgtattctcattgttcagctcccacttataagtgagaaaatacagtgtttggttttcttttcttgtgttagtctgctgaggatgacggcttccagctccatccatgtccctgcaaaggacatgatctcattcctttttatggctgcatagtattccatggtgtatatgtaccacacaagaaaatgtctttcttagatttgtaggaagtcttttcttgtttgttttgttattaaaaaaaatcatgattgaatgttgaattttatcaaatgtagttttggcatctgattattttttctctcattttaaacatacgcaattatattcttttgaatttttctattatttctagtccttggggctagaatccgcccctttgatgtgcttttataacttgtgatctcagtgggtctcattttttctgtaggaattgtctgcagcatggattgtgggaattttgctctggcattttccctgcccattcattagtccaggaccaatttttatgtgaatttctcagattgggcatttccggaccatataggaagcctaaatttgtaccgccaaaatgttccagaggcggtggtctggagtttaaactttgcaagggaaggcttttattctcctcccttggagacagacagaaacatacgagtctctttgtggttgcagctctttgaggagcctcactcagggcagcagccttctacctcgggcagagcccacagactttgcctgtttctcctctgtgctagttgaaatctaaatgcctactccccctggaccaatacttgtttctctccttctccctcaccatgatcctgtcactctctaaggggagtgaatttatgcttgcttctggttttagttgttgctttgtttctggcacctggtaatttcttctttcttattgcaggttcagctatgaatttaaaaatatatataatatttccaggtgcttgtaggaggtgagtgtgaatgtgtgtcttctcaccctcttgctgaaatgagaggctgccctctaaatgaaatttcaatattgaaaagataaaacccaaataaaacaaaaagcaaccccccaaatcagctccctaaccatgagccaggcagcacgtgaagtcctttgatattagctcatgccattcttatagaaactctgtaactctttttaagtggagaagttaagaaactggcccaatcccatgtcagggcagagccaggccaaaaacccctctgttttattggctgttacctcattttacatgtctgaacagtaataacagtgggtgtcaagtgtacctttcctaaaggtaactactacaaaggtcaacactattttccatctaacactcctaatatatttttacacattagtctcacctggtaattctaagatagaataatgatcatgcttgtctgtgagaattagcaatttttttcatggatttaagttcaagaaaaatcagaaattagcagttcaggagttttcaacatttgtaaaaaggcagatgggtgcaccattagcacttccttctgagtgaggtagatctccagggaattaataggaacccgttgttttccatgttggcaagatattagagaaatatgtcttactctcaggtttactaagacatgttttaaagataatactgtcatgcatgtggcttatggaaggctatagggatgtggatttttatattctctctagatttatttgcccatactctgaaatcaaggcagacggtaaaggtggagtcagtggtcattctgtttttttgattaggggtttatagatggctgacattttaatctcagttaatgactggggatggactccagggtccttcaccacagctcacccttgtttgtgatctaatttagcagcatcttgatttgaattgaaagacagccttgggaatattagctcggcccttgtgagagcattctggaatgctgcatattacctgatgctacctgagatgtaggtggttgggcagtgacagcctctctgagccctgacctgtcggggagaggttgagaagtggcaaaactttgattctaccagctgcaaagaccgatgtcaccatgaagttatattaatgactttgacaagaattttctcagtgtacagtaggcatatttgctgaatgagctgatcttgtaatcccagtatatctggagtagtcaattatgaattttctaattagcttgatgtttggtctcccagctaagtgagctcttgtgaactctgccagaatctggatttccaaattatctgacaggaggaaaggaaaggattgggccaaagtggccattgcaagtcagtttcttataagtcaaaaatttaatcagaccaagtgcctttcttttctgtgttcagaaaatacccattctttgtttctcacaactgttaacctgtcctaggatgaactggttctgcctccctttgctgtttcctgcattagtacttggaaaagcctgtggctgcatggtctgaggtgtgaccttcatggtgggcacaccttgtctctcttctctgcccgaaaggaggccactgttttcttgtctctgtaactgctctgtgaattcttcttcttcctgatgactaagtgtgactattctccaaggtctttatctttttgcaagttttctgagatcttcaccaataagcacgaatacttactgaatatgttttgtgtgccaggcactttttaaagcactttaataacaataactaatgtttattaagcatctactgtgtgccaggcactgcttttggtacaaaagatgtgaaataaaccacacaaagaccatccctcttggaacctatgttttattgagatccagccaggtggtagaacacatcagtaaacaaacatagacttcagcaggtggtgacatgtgctctgaaggagaaatggagtccgagtagagagtgactatgcatgatgaactggtcaaggaaagtctgtctgataagggggtatttgagaagagcacttctccaaggaagtggaggagcaagcccagtttgcttccaatttcttcctccttgtgtcttgccaactgggaccaagcatgcctggcgtggaacaaactctttctgttctctgctgatggagccattttctcccagagcccaggctctaggtctgaaccctgatccttctcttcacttttcttttctaatggccagacgtctttgtccttcctttgaaatagaagtgacagcaaaatcttctttcccacagccgttgtggataggaagcctctgcctggctgagcactttgctactttatttctgaattcctgtgccagcctcctcaatgatcttagctgctagtcttgctcttctcacccatctgtggccaccaaagcactggaacacgtaagccatcatttgagtgcttactccataccacacactggatcctcacaacttgctgatgctattacaatatgttttttttcttttttcctttttctaactttttttttttttttttttttgagatggcgtttcgctcttgtcacctgggctggagtgcaatggcacgatctcagctcactgcaagctctgcctcctaggttcaagcaattctcctgcctcagcctcccgagtagctggaattacaggcgcctgccaccacacctggcttatttttttttgtatttttatagagacggggtttcaccatgttggccaggctggtctcgaactcctgacctcaggtgagccaccctcctcggcctcccatagtgctgggattacaggtgtgggccactgcgcctggccttttttttttaaagttttatttaggttcaggggtacatgtgaaggtttgctatgtaggtaagctcatgtcatggggagttgttgtacagattatttcatcagccaggtgtattaagcctagtacccaataattattttttctgctcctctccttctgccacccccaccctcaagtagaccccagtgtctgctgtttctttttgttcataagttcttatcatttagctcccacttataagagagaacatgcggtatttggttttctgttcctgtgttagtttgctaaggaaaatagcctccagctccatccatgttcccacaagagacatgatcttgttattttttatggctgcatagtatttcatgatatatacgtaccacattttctttacccggtctgtcattaatgggcatttagattgactccaccatgtctttgctattgtgaagagtgctgcagtgaacattcatgtgcatgtgtgtttgtggtagaatgatttctattcctctggctgtatacccagcagtgggattgctgggtcgaatgatagttctgcttttagctctctgaggaattgccatactgctttccacaatggttgaactaatttgtttttcttttacaaagttttttttcaagactagtcaagtacactagtgagaagggagaaaaaagtagagcaaggagtttgatctgtaactgactgaacaatcaatggagatacctcttacctttggaccagttgctattacaattatgattcccattttgcagagaaggaaacagactttcctatggtcacttgctaatacaggaggtggctaagccaggatttgaactcaggtccaatggaatccacaggctccttccagccaccagaccaagcttcacataccctgctgtggagcaccatggagaccctggttcgctctttcactctttggctggctcaggattctttcatgcttcctattatcagtgggataaaagtccaaatgttctggaataatatttgagatctttcatgcctggaccgtacttcacctgtcttctggttttgtatctgagctccctcctgtaacaacctttgctgaacatactcaaatgtatcatggaggtaaacacagcgatgcctacgtttatacagtgagtgctttttctttccctttacctgaactcactctttcttcatgccccagctcagactccacctcctctcttaccttcgtctgtgttcatctatacttccaaactctcctgtcagttagaaggcgtgtcctgcctgtttcatgtcattcctaacatcagaggacatagctcttaaagatcttattaccaacttgccatttccatgaatttccttagcccttgatcctaaactattgagaaagcttacatatccaaaatgagtctaacttttctaagcaatggtcttgggagatgtacatatttcactagggcttcctggagctggaaatatatttggtggagctcctttttctaaattgccttccggctacccaagaaagtcaatttccttctttaatagctgtgactcatttttggactgatgatggcactattccagttcagtcacctatctgagtcatcagtagggactccatttaaaatttgactctttccctaaattgaatcaattctcaagggattaaaactagatattcactagaacattccccaggaaaatttagaaatcagagttctgaaaatgtttgctcaaaatgtcaaggggtgaaactgagagaaggcaactggaacgtttctcttaatccactgtccctcacttacctgcttggcagaaagaaggcgggggaaggaaagcattagaataaaaagagaaatgttcagaggcagtttgagtcatgaggaaacagctaaaacttccaaaacagaaactgaatgacatcctcttcctaattcaagccttcctcaggggaaaattgaacagaacatttcacttgataaatggaatgagacctggtcctggagtatttggaaagatgaatgacaggcaggaggaatacagtggaagggaatgccatttatttacaaatgcatctcctcaggtaagggaggggatttcacagagagagggaggtggaaccgcagagggcttggtccaagttagaacatgaacttactccttgctctcgtttctgggggagaaagccatgtatacctccagcactcagaagtgctcgcgacaatgagctcattgggatttgctactcaattagattctgctttgtacatgtagcacttagcactgtgtctagcacataacgaggactcggtaaatatttgttgaatgaatgaaaaataattgctgcctgggagaagttgagaggctttgtaattctgccctgtcatttctggtagtgaccaccaggtggtgccttcttaagaacaggaggaaataaaatcactccagtgaacacagaaggcttggggttgactcagaaccttgcccctgtgcacaccgtctaacagtacatcacaatttcttgttcctaacgttgaatgtgcacacaggattcagatacgtggctggcactgactttctttacttgagtcaaggtcaagtaaggttttcatcgttggctgagctctgggatttaaaaccagttctatcccaggccaagtgggtttctgttgttcctgcttatcccctgtcctccaggagaacacatgctgcccttgcttccatattttctcagaaattcgtccccagcatcactaatggattcatatccagctcttgcactcacgggttgaaaaacttggtacccctgtgtattttaagcagctacctgatgagtacctatgttgaaataggtttctgtggtcgaaattctcagaaaagtcccacaagatgggcataaatgaacaaactagctcagcaggcttaggtggctctcccaaagtaacacagataagtgagttggcagagaggattccagcccaggacagtctgcccttaggttgtgctgtgatctctattctgttttatgtggagtgagtttaatgtatctgcattaacgagatccagggacaaaaatataacaaaattcaaggaatgtgaagcaatgtcctatagaaggaggacagttcactatcagtgtgagccaacacactcagctcttggcagttttcagacagttgcaaagaaatacttagcctgaggcttcttcgtgcccataaacctaattaagggtactagagattctgattggcaagagctagggacagagaggctgagtgagactatacgtgtccctatgtttctgtatataaagacagaaagagggagtttgagagagcgaatgagttaaatcctaagtagacctggaaaactatcattttgctaggactggacttaagcaaaacagcagagcaaagttcagagttaagccagaactttgccttgaacctcaggcccattgagccctctgctccaacagggccaaatcagcatccaatagtccccttcaagttgtatctgtcccgtgtctcggtgtttctggtttctgttatttggtaggtcacaattaattatacagggttaacaaaaatagattaacataatgtacttgccgaatagtgtttctttgggagaaaatgacttaactcacctaaaatatctccaggcataaaagatattaatgttgggaatatcaggagtgattaacctctgagagaggttgaagggaagcaaaattggacaggaaggataggaggaatggagataggggatttcgggtggggagagcctcttagagtcttttatttcagaccttactctgtgcctttccatagggccaagtctgatcatcctctttttatggtctgaatatctttgagcccttcagaaactttcaaattagtaatatacatgattaatatttttgacacttacatgttaggaactagacattatttcagtaatcctcagaggagccttgagtggtagatgctatcattcttccccctttcttttaaataatgaaatagaggtttaggaagacccaaagctagttgatgtcagagccaagatccaaagcccatgtgtggttataaagccgtgttcttaccactatattatgctgtaagaataaagggacaaacctcaaaataaaagctttcactatcagtaacacagcaaaaaacaattattcattcaataatgagcaggatgaataaaaacagacaaacctcatcacatgaagttgaacttcagagaatagtcgaataaaaagttccctcaaacttaggagaaacctaaggctatgaaactgattgtttcatagccttggtaataagtagccatcaggggccgggcatggtggctcacacctgtaatcccagcactttgggaggccaaggcaggtgaatcacctgaggtcaggagttcgagactagcctggctaacatggtgaaaccctgtctctgttaaaaatatgaaaattagccgggcatggtggcacatgtctgtaatcccagctactgaggaggctgaggcagaagaatcgcttgaacccaggaggcagaggttgcagtgagctgagattgtgccactgcactctagcctgggtgacagacagagactccatctcaaaaagaaaaaaaaaagtagccatcagaacccatttaaaatctgttcatttggtcaacaacaacttgtcttagtgaaagttggttttaaaactggcagaactgaccagtgtcaaatccttacttcagcccatcagggatgcagtttccagtaaacatctctctgagtgccagccaatcaaagaatcaattacagcctcagctgagcacccacgtgctgtcaacccacgtgtgcctctgaacatctcacaaccacagagctccatgctttcaaagccctctaagccatcagccatctgtcctgctcacagacactgtttggccagcatagctctcttctgtgatgagcaatgtattcagccttggagttctgtgtcagatactaagtggtgatctcattgttatttgaaaaaacaagcacacatcagtatgtatgtagtgtatggctacagagacaatagcacaggtaagaggttgggtagggcaggtgctagggggggctactttggatgggaagctcaggagagcctctttgtgggtgcaaggtttatgaagagacctatatgatttgagaagagtccagacattcacagatctaggcctggggcttccaaaaagaaggaaaggtcttaaggtaggagaggatgcctgcgtgtctggggaaggagtagaagaggaggctggagaggaaatgggtggaggctgatccttcagggccttgtgggtcatggcatggtcaggatttgggattttgcttcaagtccaacggggaggcaggaaaccacccagggaaggactatgtcctctgctttaagagagagagagagagagtgtgtgtgtgtgcatgtgtgtataatatacacttgcacatatgtgcatattgaaagaaaggggatggaggcttagggtcaggagtgcctcttagagtctcttactttataccttactgtatatctataaatgcacatacatgcatatatacacacaagttttgcagttaggttcaaagatcctgtagatctagaagaatgtctatgacattgacaatgtgagtcagtacaccctccactgtgtgctaccaaatctgcccaccctcttccactgggagtcccataaatgaagtggttttactaccctgttgtagcccagtgacagatgatcagtgatgtcaaaagcgtgattctggagaggttggtcactttgttgcaaagctgctgtatcatttcaggtacatagtctgggaggtacagagtctagggtcagagtagagtctcaagccattgtgcatgcctgcccaagacagagtggagttggtctactcctgaatatattaaccattttttcccttagtcattacatgtaaagcttcatgtctgcatttgtcagttatgatttatccggatcacctttcttacagaaagcggtagatgccaaccagaagactggaataggcttccttttatctcttttgcacagttgtgtcttcggtgagatgacttgactctctgatgttgagagtgtttttgttaatttttgaagcatgatctcagttggtttaggatatgaatgccatacacactcattgttttcgtttggggactgccgctgtgctgggtgactgcgtgtttgtgctgctggcccttgctgacactgatattggatttacaaagccaaccttgcagttttgtgtgggcaggtaggctgcctttaatttgtggttgctttgcccttctgaaaacacgaacttctatctggttggaagtcattttctttttcatcaatctcaactactgaacctatttcttcaggcacatctccagactgccttggatatttcgaggatatgttctgcgtgttcacatttgaactgcagcttggtttgcagacaccctctccttagattggcagctgtttgtggaattcctgagtaccaattacatccagtagcaggaaataaaagacaaacaaggaactagtagagctcaaggtattctttcatccttcctccttcttagctaatacatcttacagttagctctgaaaggagaatttatttaaacatactaaacactgtgcatagtgactcttacatcttttctggtaatagcatgctaatgctatacttcaaagtgcagtgaataagccctgtagagaaatatcctcatggtatggtttcaaaggacaggcatccttctggaacatattgttatcttaggtttttgttttaaatgtcagcacatggagaccttattctaaggctgcgtctgtgctccgctagtgagtatggaaggcttaggtgattcatggtgggaagttgaagtaactagagaagacttggtgctgtttggctttagtgaaatttttagaagctgtagttgaaaaaccaacacagattggccctctgtttgttgcttttggctgtctagggactgcaaagtaaaaaatgacattttcttgatgtctttctgacagtttctcacctgtaggtcaagtcctaattgaaatatgacataaatatttggcgtcataaaagcagaatctccataacacattaggtgatttctagagtaatgctcacttttattgtttgggttccattgatgagttaggcagggttatattttaagaattttcttacatcaggaagagtcaacagaggatggataacatattttgaacgtggacattgcttgtaagttgcaggacacttgtaaacactattgagtgtcacctatagcaggaaccagtttttctttatccctcgttctgtgacagctacctgggttctatgttggagccccgtagtatagtttcaaatgcaatagccactgcataatccttgtcacccaaagactgcagatcttgacagaacttgtacaacagtggccttgctgaggagtgatgtacatttcttttgtcatttggccacataagaaaactgcagccatcactgtattttgatgcatcagactctgtgtcctctgagtgtgattcagctgttggatttcttgattatgaaagtatctagagtacctcatgttcagtgatgtgaactgctatgaaagttccctccgtgtattctgctggatttcttaagttatatcttcacagagagggcttgcctcttatacagtctgcatccagcacccataagtactttcctttgctgcaggagcaggaactgaacccaactgtggatggagtgggaatgtgtgttctgattcctgcttattagcggtaggatgtgataaatatgttccaaagcaatgcctggtagaagtgttcccctacctgcatgtgacaagaagcattttcctcccttcatttggatagaggaagggctttggataaggaaaaaaaataaagaagatcttggaccttaagctggagacaggaaggtcaagtgctttattttttctgtgatgagaaccagctcatttgagaactgaaggtgaatactgactgtcatatttaataagtagtgatggaatttgcatttcttccttgaggtcagtagtctgctttcatagatagaacaggagtttaaattctgagcaaaatatgcaatcttttctctttctttgattcttatcctgtcaattatctcgtcattctacagaggactaaaaggtaaagagttctaagatcttcgcattgtctgggaagaagtggaaatgttaatattagtctttaataagttattaatgacacatattataattgttaggataactcctaaaaggatagtgaagagcatataacttccatattaatggttaaagatgtgccaaacaatagcaacaaaggaggaggaaaatttgaacattgggataaaagcactgcacacagtggtagatgtaaacacaaatatttcagcaattacattacatataaatggactaaatgatgcaattaaaagataaagacatggatgaaaaaacttttcaggaggcatatttaaaagataaggaaataaaagtttgaaaaaataaaaggatagaaaaatattatgcaaatactaaaggaaagcagctgtaggttggctggtatcagtgttgatcatatcatggacatggttgattatggtatgagtttgtgccttatgttgtaagtattcacaatcagagtttcttatagttagaaaaaattagatgatcaaattataaattactagaaagatttcataattgttaaggtgtaggctttttactgcacctggagaggcctttcagccatgatgtgaattatgtaccattatgtaagataagtggagcgtaaatgctttgttcaaacaattataatgtaattggaaacttcttgtgttaacaatatcattatcttaaaggtgaaaggggtgggaagaatgtggtagaaatcaagttccctggggaataggctttacagccaaaagtaaagtcattttttcctgaccagtgacttagcttaaaacaggtcaatgatattctttaaataaagcaatatttaattggattcatttgcagctgatatggattctggggcttgatagcacttacatattaagctggaaatctagaaataagaactttagcaacaatttttttttttttttttaggatttgagattagttattaataacacaggatgcaagactcttaggttgtagttgtgggtaagcataaatatatactgaatagattcagacattggccaagtagactcagtttttttcaggagatcatgttcattcaaagggataatttcttctttctgaaaaacttctattttgaaaatattaaatgatagaattccccctgaaattttttattgtgctgtttaaggaatggtattttacccattagtgataatccatgaatgcatgctatgaatggatacttaggaaacatttcctgcatgtccatggaaagataattatttttaatatttgtatggactgttaggcttttttctgtgagtaagatgtttttaatgtagaggtgtacttatagagtatacgatttttattgtattcttttaaatggactatttaatataattgacatatttcccatggagtaaaaacactatttagatgcttgtggtaacataactcctcaaatcttagtgacttaagacaacaaaggtttattacatggataatgtagatcaacaggaaactgctcattggaattgaagactccatgctgacactgatgggaggctccatccatgcacaggcactcacagtcaccaaagcagcataggaaaatatggtaatccttgcactggctgttaaagcctttctagaagagaaataacacttgcttatatttcattgaccaaagcaagtcatgtggccatgctaacttcaaagaaggtgggcaagcgcaatcctgtatgtccaggactggactattagggaacagcctaattgactactccagattgctactgacaacacttttttaaatgattgggataatactccaataaatgcctatgccatagtttacagagttagcccattttaatgtttgcagtgccaatagtttattaataatgctgaaatggacattttggtatagtcaccattcctccacactgctccttttctggggtacttaaactaatcctagattaagtctcctgttgtatagtttaatggactgctgtatgtctactttgtagcacttattttctaccaacacgctataaatttcatatagagaccacacctttttttcagtgctgtgtctgctaaccgttacataatagatattaaataaacattaatgaaggaatgaattaattggggaagtgggaagggtaaattggtaaaactactattaaggctttttctatatgtttccaaattgctttccaaaagaattatagcaaattcacatgtgagtcagcagtggtttatcagtttaccacccattgccaccactggttattttcctttgctaaatggaaagtcaaaataaataatatctcaatatttttagcactgtaattggcatatctttgattatcaataagactgggtatttttcatacatttggtttttgttattgtgataaaaacataacaaaagttaccatagtaaccattttttaagtgtacagtaaaatataactatgtgtacattgttgtgccacagatctctggaaacctcattttgcaaacctgaaactctttaaccattgaacagtaacttgtcttcaccctcctccaacacttggcacccaccattctactttttatttctaaaatttcgactacttaagtatacctcatataactagacttatgcagtatttgtttttttgtgactggttaatgttacttagcataatgttctcaaggttcatctatattgtagcttattgccagatttccttctttttaaggctgaataatattttattgcatatatatatgtatatcaaattttaaaatctgttaatccgttgacatttaggttacttctacgaacttggctattgtgaataatgctgtaatatacatggtgtgcacttatctcttcatgattctatttttgattcttttgaatatacagatgcttgacttacagttacgtcctgataaaacccatcatcagttgaaactatcataaggtgaaaatgcgttcaatacaactaaccaattaagcacaatagcttagcctagcctaccttaaacatgctaagaacacttacattagtctatggttgggcaaaatcttccaatacaaagtcaattttatagcaaagtgttaaaattgtcatataatttattaaatactgtaccaatagtaaaaaacaaaatggttgcattggtgggtttttgatgttggttatcatgacaaggtctctcactctgccacccaggctggaatgcagtggtgtgatcacagcttgctgcagcctcaatcccctgggctcaggtaatcctcctacctcaacctcccgagtagctgggactacaggcatgagccaccatgtctggctatttttttttattatttgtagagatggggtctcactatgttgccccagctggtctggaactcctgggctcaagtggtcctcttgccttagcctctcaaagtgctgggattacaggcatgagtcagtgtgctcggctgatgctttggttatttaccctcatgatcatgtggctgactggaaatggtggctctttgccactgccccgaatcataagcgagtatgttactgtatattgctagcctgggaaaagatcaaaatttaaagcatggtttctgctgaatacatatcacattcacaccatcgtaaagttgaaaatagtaagtcaaactgttgtatgttgaggactgtctgtatatctaagggcaggattgctggataatatggcaattctacttttactttttttcagaactgctgtcctgttttccacagcagctgcatggttttatattctccccagcagtgtacaagggttccagtttcttcacctcttcaccaacacttggtattttctgttttgttttttgtttttgtttggttttgatagtggccatcctaacaggcatgaagtgattatggtttttgattagcgttttcttgatgtttagtcatgttgaatatattttcatgatgctcgttagccatttatagtatatcttctttacatagatgtctctattcttcaagtcctttgcccaattttaagattggtttatttgttttgctgtgtgaagagagataattttactccaatttggatgccatttatttattgcctaattgcttgggttaggacttctagtactatgttgacgagaagtggcaggagtgggcctctgtcttgtttctgaacttaaaggaaaagctttcagtttttcaccattaagtttgatgttagctgtgggattttcatatatggtctctgttatcttgaggtaatttctttctattaatgaaattttttgtgtgtttttgtcatgaaagggtattgaattcttttcagtgcttttttttttttggcaccaattcagtcatgtggtttttagccccttattaatgtggtatatcacattgattgatttttgtatgttaagccatcctatcattccaggaatatatcccacttggtcatgatgtataattactttaatgtgctattgaatttggtttgctagtattttgttacgaatgtttgcatcagtatttatcagggatccttgtggttttcttgtagtatctttgtctgctttaggtatcagagtaatgctggcctcaaaaaaatgagtttgaaaattttccatctttttcaatttttttgtaagagtttgagaagaagtggtgccaattcttctttaaatgtttgatataattctccagtgaaaccatctggtccggggcttttctatattgggaggtttttgattacttacttagtttcctttccagttaccatattcccctattatctgagagttcactttctgcagtttcaggtactggcagtcaactgcaatctgaaaatattaaatggaaaattgcggaaataaacaataagctttaaattgcatgtcattctgagtagcatgataaaatctcccactgtcccatttcatcccacccagaacttaaatcatccctttgtccagcatttctacgtatacactactcccccattactgtataggaaaatacatggcatatagagggctcagtactattcagggtttcaggcattcactggcggccttggaatgtattccccatgtataagggggaactgctatattgctatgttcagattgtttattactttatgattcagtcttggtagatggtatgtttgtaggaatttattccttttagattatccaatttactggcatatgcttattcatagcaatatattataatcctttttatttggacatcaggtataatatctcctctttcattttgatttttgttatttgaatcctctatatttagtctgaggatttatcaattctattggtctttaaaaaaactcaatttttgttgtttttttctattatttttctattctctaatttgtttatttttactctagtctttattatttccctctttctcgcaactttgggtttagtttgtttttctagttccttgaggtgtaaagttaggttgttaatttctttcttccttgttaacgtaggtatttactgctataaaattccttcctagtattgcttttgctgcatcctatatgttttgcaatgtgaatctcaattgatagaggtttatttagccaaagtttgaggacatgcccaagaaaaacatgggtcacagtagcatttgtgccctgtgcttttccaaagagcattttgggaacttcagtatttaaaggggaaatagcaaaaatgaggctctgattagtgctcagcacatctacattttatttatttgttttaacttcttaaaattttactttttaaataaacatatggtaaaattgacgttgtatgtgagtacagttctatgaattttgacacatgtatacatttatgtaaccactgccataatgagaatacaaaacagttccgtcaccccagagaactccctcatgtcatccttttgtagtcaatatccctagtcccacccgtaacactaacctttagcaagcactaccctgttacccatcaccaaagttttgtcttttccacaaggtcacataaatgaaatcctaccgtatataatcttttgagactggcgtctttcactctgcataatgcctcgaagactcatccaagttgttgcatgtaaacatattattattattattattattattattatggctgagcagaattccactgtgtgaacataacccgttttgttttgttttgttttgttttgtttttcacccattgtagagcatttggctgtttccagtttttgataattaagaattaagcttctataatcattcttatacaggttttggggtacagatatgttttcatattgtaatgcttaggtaattcctagaagtaaggttgctgagtcaaccggtagatgtgcctgtaactttatgagaaactgccacactgtttgccagagtattttcaaatttcagccattctaatatgtgtatagggtattttatcatgattttaatctacatttttcaaatggccaatgatgctgaacatcttttcatgtgcttatttgccgaccctacgtcccctttggtgaagtgtctgttcaggtcttttgctcattttaaaaattggactgcttgttctctcaatattgagttttgagagtccttaatatattctgagtgcaagtattttgctggatatgtgatctgtaaatattttctcccagtctgtagtttgcctttttattcttttaacagtgtctttctaaaaacaaggttttaattatgatggtgtgatttattttttctgttatagatcatgatttacccctttagttataaaaattttataattttatattttacatttaaatgtgtaacttagtttgagttaattttggtataaggtattgagaggtgtagccagctgggcttctgggtcaggtggggacttggagaactttcctgtgtctagctgaaggattgtaaatacaccaatcagcactctgtaaaaacacaccaatcagcgctttgtgtctagctaaaagattgtaaatgcactaatcagcactctgtaaaaacgtaccaatcagtgctttatgtctagctaaaggattgtaaatgcaccaatcagcactctgtaaaatggaccaatcagcaggacatagatggggccaaataagggaataaaagctggccacccaagccagcagcagcaacctgctcgggtcccttccatccacactgtggaagctttgttctttcactcttcacaataaatcttgctgctgctcactctttgggtccgcaccacctttaagagctgtaacactcactgcgaaggtctgcggcttcattcttgaaatcagcgaggccgtgaactcaccagaaggaagaaactctggatacatctgaaggaacaaactccagacacaccatctttaagagctgtaacactcaccacgaaggtcccaattcttgaagtcagtgagaccaagaacctaccagaaggaaccaactccagacacagtatgagatttaggtcaaggttcattttcttgcatttagatgtttgaatgcttcaaacaccgtttattcagaagactgtcctttctctgatgaattgcctctgcaaatttatcaaaaactcagttggtaaaactgtagttgcccatgggtatatgcagcagagcagaactttctgaagtaatggaaatgggaatacacgttacagggtgtgttatgtgggcatatgcatttgtcaaaacatcaatttacacactttaagtcagtgaattttactgtatgtgagttatacttcaattaaaatatcagttggccatatttctgtaggtttatttctggaagtctattctatgctgttgatctacatgtttatctttttgccaataccatgctgtctttattttttattattttattttatttttgagattgaggctcgctctgttgcccaggctggagtgcaatggtgcaatctcagtcactgcaacctctgcctcccaggttcaagctattctcctgcttcagcctcccaagtagctgggactccaggcacatgccaccatgcctggctaatttttgtatttttaatagagacgaggtttcaccatgttggccagtcttgtcttgaactcctggcctcaatcaatccgcctgcctcagcctcccaaagtgctgggattacaggtctgagccactcccggccaaccatgctatcttgatctcaattactttagctttatagaaaccttgatgaagtggaaaagtgtgattcctccaactctgttctttttcaaaattgttttggctattcttgtttctttgcctttccatatacctttagaatcaccttagttctacctacaaaaatcttgttgggattttgattaggtttgtgctaaatttatagattaattaggggaagattcacatcttcacaatactatcttccaattttgaacatagtatgtttttttcatttatttaggtcctctttatttcattagcattttatagttttcagcataccctctaattgtttacataaatatttattagatttatatgtaagtatttcaattttttggaattgttttaaatatcatttttggagttattttaaacagcatttaaaaaatatttggtttccagctccttattgctaacacataaaaatatgatccatttttttacatgtactctacaactttgctaaatacattcattagttgtaggaggtttgtatgtatgctatttcttgggatttttcatgtaaacaataatttcatttgtgaacagggacagttttatttcttcttttccagtcaggatatctttatttcttttccttgcctgattgctctggcttggaattccagtatggtgtgaaataggaatggagatagaagtttgccttgttttcattcacaggaggaaagcattcagtcttcatcattagatgtgatccttgttggttttccaatgatatgtcctttattaggttgacaaaagtctctttttgtagcaaatctacattttacatgtcaaaagagggagtagatgaaaaaagtaaattacatattcatctcatactcagtgaatctacattttactaaataagttgaagtaaacataaaaagaggaagcagaggaaaagtcaattatgcattaatctcagggtaggtgaagagataatttctggtcttgtccttgtcctgtacccgcaaagataagctggtagttgacattgtgagggtgagagtcaacagagctcagttttagggctagtttataggagggatatagatcctgaacgatttagggcctcacgtttatacttattgtatcttccctatgaattggcccttttattgttgtataatgtccttttttgtttcttctgacagttttgacttaaaatctatttgtctaatattggtatagctacctctgttctcttttggttactatgtgcatggaatatctttttccattctttcatttcagcttatgtgtgccattatatctaaagggaatctcttgtatacatcagatagtgaggtcttgttttttaattccttcagccattctgtcttttgattgaggcatttaatccatttacattgaagcaattactgattgggagagactttctgttgtcattttgttaactgtattctgtatatgttgtatctatctattcctcttttcctttttcctttttatttgctgccttcttttgtgtttcattgatttttttttttttttttttggtgacatgctttaattcctttctcattttcttttgtatgtcttctataggtattttctttgcggttgctatggagattacaaaaaacatcttatagttgtaacaatctattttaaactgttaactacctaactttgatcacataaaattcctttacatcccccgtcctactttgttaccaatctttcaaattatacctttttatattgcatatccaatcaagctttcaaactatatccttttatattgcatatccatttatagagttttataattgtagttattttttaagcttttatcttttaaattctataccagaatttaaaatgacatacaacctaccagtacagtattacagaattctgtatttgtctatatattgacctttaccagggagcttacattttcatatgctttcatattgatatctaggatcctttcatttgaaggacttccattagcatttcctgtaaggcaggtctagtggggatgaactctcccagcctttgtttatttctccttcatttttgagtgacagcttttttggccatggtattttgtgttggcttttttttttcttttagcatgttgagtatattatctcacttccttctggcgtataaactttctgctgagaaatctgctgataatcctatggaagatttcatgtacatgatgacttacttttctcttgctgtttttcaagattctctctttgtttttgattttgacagtttgattataatgtgcctcagtttaggctcttcaggttcatcctagttggagtttattgactttcttgaatttagatgttctttttccccctagatttgggaagttttcagtcattattttctcctttctctcactgttctttctcagggactctcataatgtgtatattgatctgctcaatggtgtttctttctttgtttcttttttggctttgactagaaaatttcaaatgacctatcttcaaattcattgattctgttttgctcttgatcaagtgtgctgttaaactcctctggtaaatcttccaattcagttgttgtattcttcagctcaagaatttgttaggttcttttttaaaatagtttctatttatattctcattttattcattcttcattttttggatggtttattttttattgctggttgtctgtacacccagttaactctttaaacttctttaagatggttattttgaatcctttgtcaggtaatttatagatatctgtttttctgatctgcttttggagatttattttattcctttgattgggccatgttcccctgattcttcatatgcattgatttttgctgggatttgggcatttgaaaaacaactacaacaaccagctcttccagtcttaatggactggctttgtgtaggggaagacctttaccagtcagcctggctagagattctgagggtctctgcgaccttctctggagatgtgtcttgtctgggcttgcatgtaatttcccaattagagaagtttgctaatttctttttcaacagtttgtgttctcttgctttctctgtgacactccacagtactgtaggttctccggtacagcaagaaaacatcaagttcttttgttctctgcagccctagatgtccaaagtataccagtttcccgttagagtctgtgttaagcaaaacagaaactagtctcttaggcagccccctgaaaaactggaacactggatgtgcattcactcctcttttcctcccaaaggagaagctctgagtaggttgttttctcccaattcattgagctgtgccagcctggggaaaggctaagaatagcaaaataaaatgacttttcctacctgttttaattctgctgttcttcactttgtatttgcctaggggcactgtggtttcataactggtttctggaggtcttataaaggcattttgtacaatatattgttggtaagtctgtggggggtgggcagggaatgagatctggggcatcctattttgtaatcttacttatatcacctcccaggaagatcaaattttatacttatcagtgtatgagagtagaaatgtcattgtattggggggtcagtagataagattccatatctgtttctatcactaatgatagaactactgctaaattataaaaatgtaaaatggtgctagaatagagattagagtaacatatttttgaaactttaaaatctgaaggaatttactgcttaacttctgcctactttcagggtattaatactagagaaatttcctctaatactttcctttttctttttctttttcttttttttttttttttgagatagagtcttattctgttgcccaggatagagggcagtggtgcagtctcagtttaccgcaacctctgcctcccaggttcaagcaattctcctgcctcagcctcccgagtagttgggattagaggtgcatgccaccatgcctggctaattttttgtatttttagtagagatggggtttcaccatgttggccaggctggtctcaaactcctgatctcagatgatcctcctgcttcggcctcacaaagtgctgggattatgggcatgagccaccgcacccagcctctaatacttttctaattatgaacctgatgaatgcttagtaggatatatatgtaaatcatctgcaattcattcaacatgagtaattactgttaacattttatagtattttctttacattttgtatgtatctgtataatgtattcaaaattatgtatatttaaatgttctctatacacagatctgtttgctctctgatcaccaggctttatataataaactttttttttcatgttaaacattcactggtttttcaatatctgcatattttcctaataatatattgctgtaatatacctcatttgaccatgtaaccatatctcatatttctattttgggaggttattataaatatggggccatgaaaatgtttgtagaaatattctatatgcttttaaaatatcctgttttcttcaagtagattgctggagatggaatttctaggtcaaagaataatgtggacataaatgattttagaactttttctacctttgccagttacctttgaaaaagtgtgagagtgttacattgcttttgtttctcatgaatactatcttttaaaaattttagctaacttgataggtaattttatttgtatttctttgaacattaattctgcttctgtggcttgtttattcttatcccctttgcccttttctttattgtgatattggaaatgtccctttcaattagtttttactctttatttattaagggtgttaatactttttttagatttgtggtaaatattttcccctgattcgtagtctgcatagcttttaattgtcttatgttattgtgggttgaaacttttatttagtcaaatttgtacaactttctttagtaacttttttcctttgctgttgtgcctgcagtcacacaccatccagatattaatcacctagattttaaattttctatatatatacaaatttctgactatactatattccttctctatgaataacctcttttaacatttttttgatgggcaaatttgctggcaatgaattccctcagtttttgtttgtatgaaaaagtctttattttttcttcacttttgaaggataactttgctgaatatagaaatctatgttggtggactccccccatttaacacattaaatatttttctccattctcttcttgcatggtttctaacaaaatgtctgctgcaactttcatcctctatagatgtttccctccttttggcttctttcaaaatttcttatttgactttggctttcagcagtataaatatgatagcccaggtgtaggtatttttgacatttattgtgcttagtggtggtctctaagcttcctagattggtattttggtgtctgtcatttattttggaaagttcttggtcattattccttcaacatttcttttgcttcattctttcttccccttctgttcagttacacacatgtcgcacctttgcaattattccacagttcttggaaggtcgctgctgctgtcactgctgctgctccttcctactcctcctcttccttgttccgcttctcctcctcctcctctctttttcttctctgcccacctcccactctgttttcttctctctttgcatttttatctgggaggtgtctattgagctatcttcaagttctctgattctttcttcagccatgactagtctcctcatgagcccatcaaaaacattcttcacttctgtttgtctgatttctagcaattcctttagattctctcttacagtttccatttccctgttgacattacctgtctgttcttgcatattgtctgcttttcccatcagtgttcttaacatactgtgatagttaattttaggtgtcaacttgactttagaagggatacccagatagctagaaaagcattatttttgggtatgtctatgagggtgtttctggaagaaattggcatttgaatcagcgtactgaataagaaagatctgccctgccccaatattgacaggcaccattcagtcagctgaggtcccagatacaacaaaaagggagaggagaaatgaattcatattctctttctctccccttctctctcttccttcctccctctccctctccttttccctctctccctcccttctagagctgagacattcatctgcttctgatcttgaacatcagaactccaggttcttggctgggtgcggtggctcatgcctgtaatcccagcactttgggaggccgaggcaggcggatcacttgaggtcaggagtttgaaaccagcctggccaacatggtgagactctgtctctactaaaaatacaaaaaaataagctgagtgtggtggtgggtgcctgtaatcccagctacttgggaggctgaggcaggagaatcacttgaacttgggaggtggaggttgcagtgagccgagatgatgccactgcactccagcctgggcaacatagtaagactccgtctcaaaaaacaaaaaaaaccaaactaacaaaaaaacccaaaaaactccaggttctccaccctagggattctgggtcttgtatctgcagtcccgcagtttcttaggccttcagccttggactgagagttacattgttggctcttctgattctcaggcttttgagcttggactgagccatgctaccagcttccctggttctccagcttgcagatggcgtactatgggacttcccagcctccataatcagatttaattcccctgatgaatcccctcttgtctatctatttatcctattggttctgtttctcaggagaaccctaatacacatattaatcatagttattttaaatttcctatccgataagtccagtatttatctggtttgattattactttgcctcttcaaattgttttttcttgccttttagcatgccttgtaattttcattgaaagctgaaaataatggattgggtaatagacctttagtataaggttttatgttaatctagactagattaatcacagactacagttggcctgtgtttagtatttgctgtagctgtaggtgccagaggcttcaaattcctctggcgtcattgtttcagtctcccctgttgtctttgggattccctaagaactcctcagatagagtttgcatcttgcagctcttttagacgtaatctaatgtaatctgttattttactggtgaggtatggtgctaaggtgtagggaaggggaaacattctgtaatcttaggactacataccagtttcttagtgggcttgcattcatggcctatgaccttcacaagtgtttcttagcttttattttcttaaagaaaaaaaaaaaagctcccataatgagataggaaggctagagggggccagagtaggaggaatgtccttccctcaggtggataaggctctggtaaagtctttttggattccactctggagagtaggcctttatttttgaaactcctctgggcatatttcacaatagttaccattagggatggaatatttgtgtccccccacgcccccgcaccccgccaagtttatatgtggaagtcctgacacccaatatgagtgtgtgtggtaggctgcgtgtggaggtattgggaaattcaggttcccaaaagtttggtcgtagtgaagtcctcagaggtcttcttgagtctttccttttcttcaccaaaggctcactgacgtcatccatcctcctgatggaggtcaaagcattaaagtcatttttctccctaggagcgtctcccccattgccaaattgccaggctagtattagggagaaatgtcctccctgaatttcattgttgggtttttttttttttttttttaaaccttattatggctttaatgttgaaatttctgttttggactttttagcatgacacatacacacacctctcattttattttcattgctttttaaactcccatgtccaatgtctattttaatcttatgtttggcagcctgaaacattttatttctaaaattaattctctaattatacaacatctacatggcttgtaatgacatcagtagagcagaatctagaatccaactcaaggttttcgttttgttttttaagagtaagtaacttattttgatcaatgtagtaagaggagattgaaaggtaccagtgtgtgtgaaagtgaatagttgcttcctctccccatctcctcttcttcctcccctgctcctctcctcttcttcctccccctcctttcctcttcctcctcccccaacccttcttccttctactcttcctcctcctctgcttattccttcatcttaactcatccttcactaaaaagagttatattagcattagaagtattccttaatggctatacttttcagatattataacttcagaattttctagccaataacaggattctagggcaaatgtcatgtaggatatggctcttcgagtaccaacatggcaagaaattgatttcctctattgaagacacattgattttcagctgtactgaaaaactcacagccttccagtatcgacaaatagtaaaaattgacttcacataataacacctttatttacctagccttgtgaccctctgattttgttagatgatcctatggtgaaagaatgcaccaggaccaatgcttggacaaatagtaagtctccattttctttatagtagatgcttctacataaaattccgctttgggcagtaacttgcgtagacagctgttcttgtgacacgacataatgcacactgagcacggtgacagctccagacgatggtctactctggagtttccaactggactggtaatctactggatactctcatctggaattgtctcctagctgagtggttaagctatagaagcccatgattaaacaatgttgtttctggaaagaataatagaaatggttattattagtgagtacttactgtctgccaggccctgcactaagggctttttatgtgttagttttgtttaatccccacaatatatctaagaggtattatcccccttttcccgtgaggacactgaaggtccaacagctaataagtgaagctggcgatatgtcctgttttagctactaacatttatcagcttcatcatacagacatactttgtcagattggttagccaggcaagtgaccgctgagagaatggggcacaggagaagtaagtgatgactgcgaacacaggctggacaaagatcactttcttatacgagtctgcagttcttgaaataatacctatcagatatggcattaacagtgattggtagccttatccaaatgcgatatttgacttttgccttcatatcatggtttgaatttacaaacttcatttctttttctttttttttgagatggaatctcgctcttgtcacccaggctggactgcaatggcgcgctcagttcactgcaacctctgcctcccgagttcaagtgattctcatgcctcagcctccagagtagctgggattacaggcatgtgccactatgcccagctaatttttgtttttttttttttttttttttttagtagagacagagtttcaccatgttggccaggctggtcttgaactcctgacaaacttcagatgggggcattgccttaagtgtatgatgcccaccattgaggtagactaccacatggtacctggatgagcatcttatgtttcaccaaaccagaaatttcccaggcaaagtgaacggaacaagagagactgcggattcagacgtttcctatgcagttatacttctgaatgggtagtcacagtgtgttcaagggtaaatgatagctaaattatcacccatctttaaatgttttcactttaacggggttaccaaatcgctctttaaacttgaatttctatcaagcttcagaaccataaatgttttcttagaatttttccaagattatctgaatcagtgagtcctttaactcacttctccaggtatcaaaagtcttttaagtcttttttctgccaaaggtgaatctatgctaacgccttctagtactgattctcctttccattttcccatgcaccctactgctttctgtctccctttgcaattcaacagaaagagaaatcatgaggcagtatgaaatgaaggacttttctgggctgattttccttttgaatcagaatggaaatttatggtcatagtgctttccatgaggtatttagaagtttccagtcaatcattgctcttatcaggggttcttaaaggctttgggagatactaggttagctttcttacaatataggctgccctttgttacagcgacactttctttttgcagattttttttttcttaacagagaaaattgagatatgaaattatttccttaatctctacaataatcaaatcataattatttctattctattttttaaacttttaaatttcactaacagtacatagccattgcagtaatttttttaaaaaatagagaggagcttaaaaataacaaaaacctctataatcccatcacccagagatgagttttggccccattcatctcacaagttctgtgcaactattgcatttcatgttgcctattcatattaagagaatagcattacttttattatgatgatgatttgtaaacaatttcccagagttaattcccagacatttaaaaattttggccataattgaaagtcaggattttatcttctcagttggaaagtagaagagaaaagtataacagtgaaaaaaatttttcttaggtgtgtatttgtgttggattgttctaatttcaaaacagagaaagttttgaactcctgctttcatggttcattcttagaaataaatagaattgttttcccaagaaaaccttggaaaactttctagtaatagcaggaggaatatgggagtaggaaatggcaagttgaaggattttaatttggaaactgccaccttttggaatacagaagagctggttatgggattggcccctggctttacttgtccttaacatgggctttgataaggggaaaacaaagtgagggcttcgagccacaagtcaaggtcttgggaaagcttagcaaaatggtgcaagtctctcgtgatatctacctttatgcttactgctttctattggcaaaaatctctcatcttttgcagatgcactgagatcccatcagtagacagagaaagaacgtgggtgagtcagaagcaatcagccagaagcacacaaatgggtgtggacatgtcactgccaacaacccacacagagtggctggctactgcattcacccttaggatctcctaatgagcacagttaacagtagttggagctttgtctctgacatcctcttgcagtcatctgccttatttgctgattgatttctgttcttgaaactctgaacaggaagccttctgttgactcatccctgcttttcagactggaaagcacttgtaattttatctgccatgtatagtctctaaaaatttattttgaagatatgctgtatcaaaagcaatttaagaaagtaggaaggtaggaaatataacaaccaaaaccaaacagtgacactaaatatatacatatatatagctgtacactagacttaacctaaactgaccagctagatgattttgatgcagtaaagacaagttaagaaaatttgtctttactgtcaacaagacagtaaacttgtctctatgtcaacaagaaaaaaggcaattagaaattcttggaaaaacagaaatttgcaaatgaagtcccaatttaatatgaggtaaactgaaatgtgacagaattctgcataattgatggtatataagaaaaaagaaaaaagaatacattggaacttgacgcttacagctagtatggtgacaacggactatatctcctttaactgatttagtttcaccatctggaactgcactgaataaaaatatttacctaattgtaatactgaatatattttattagttttcatttttcataattaacctgtatgcaaagcatggaagataaattatatttgctgaacaaaatggaaatattctaaaacttgatgttgtaaattaatgcttattataggtgataaaatgtaagggggggattgaggtggaatggagtacaagagcatatgttttcttctgtttcatagtggatggttgaaatggtactctttagtcttgatacatagagaagtagagatttaggaatatgattacatgattaaggtaacaaatgaaagattatatatctgaagaggacagaggggaaaggagatgctgtgtctcaaaattgtgttctcctctagcagggaatcaatataccgttgacccttgaacaacacgggtttgaattcaggagtcctcttatatcccagtcttttttaaaccaaacatgaattgaaaatacagtattcccaggatgcaaagcctgtgtatagggagggctgactttgcgcatatgcagattctgcaggtggactgcaggacttgagtatgcctggattttggtatatgcaacaggtcctggaaccaatcccccaagtgagtatactgaggggcgactggattgtttcacttttgtagaggcatatgggagttaggcagccttgtgcttttcatactatgttcttgtttaatttctggggttttttgtttgtatttttgttatccatgtacatcttttgaaactgaaaaaatggtgatcagatgatttacaagaaactttgattaacaattatactagcacaactttgttaaatttccctaggagaagacaacagcctcaaatgcagtgggaaaaaaaagcaaaatctgcctgcttccacattgttttcaaggagagcacttgaacaaaatggtactatttggacaataaatagatgggtaccaattctagacaagcacaagcaaaaagaaaacagggctggcagtattcgcatgggggcaatttcaagacagaaagcattaagtggacaaaaggtgatattttgtaatggtaggggttagaatccaccaagaatttatacagccatggttctttacgtatggaaaattagcgccgaaattggtaaaggaaaaactgttaggagataaaagaattaaagaataaggcaaaaaatattagtacttagaaaattataatagccaatggtataatttaaggtatgaaaataaaacaaacaaaagtctgcacctgcaaaggaaacttgaaaggcagggctgttggggatggggtgtgtgtggcggtgaaaggggtacagatagtttatcctaatcataggttttaatcactttcttgtagaaggaaggaaaagttttatttctgtgacaccatctcattgtaaaatccagtaaaattgaaaactttgagataaatgtattatcaggagttacagccataacttttagtatgtgagctataaattctgttcttatcactaagtcactgagaactaaggctgctgattttcccaacatagtaaaacagagcgacctgaccaaaaaatgaaaaacatttttatggacttttattctccttcctgcaaccctaatctccttccttcctctatagattctagtctatctaagaaattctaggtggatggtttgctttctctgagggaagctaagattgaggccaaaaggagatctgctaggtacctgtgcaaacgtcaggtgggacagtgaatagaaagtaggcatgcaggggaccgagaaagataggctctgggcatcacaaacagcttttccaactctagagacttgaaaaatgtatttggagttacatctaagtcagaagagtacatcttgtttatccccccaaaaagcctcctggtatataccttttagtcaaatagcattgtgatcttgtcacaatatatggacaacagatattttcagttcatttgatacttaacatagaacatattaatgtgccattttatcagaaacctgtaaaggagtttaataatggataactagaatgaacataagtggtagcaggtccttactctcatcccccctcccacttttcataatgtactgatttgaaatgttcgtgaaatcaatacagacaaattaactcagtgagcagcttctccccagtctcttgctgcagtgatgagaagcctctttctggatctacttgtttccagatggtagacaaggcttattctgacacatggactgaaaacagggcagaccagcagtcggaatcttccctgcttagtgtcttaatctatagtaagacctcaaagaattagattccctagcatgaggaatttttcttactgaattttttaatgccactatatggcagtgattaaatagcaagttcaagtgattaaatctggtccatctctatacttttcctttacaattgctatcaggttttgtaagtaaggaagtggaggcatttttgtaagtgtgttaactctcaaagcccacaaaagtatgtttttaaacttagggatcaagttgtgtggatccgatttcagacccccagaggttcttccaatgtgtctaatgtccaggacagtgcacatgttcagagtttcattgtatttttctttctttctttctttctttctttctttctttctttctttctttctttctttctttctctctctctctctctctctctttctttccttctttctttctttccccctccctccctccctccctccctccctccctccctccctccctccctcccttccttccttccttccttccttccttccttccttccttccttccttcctttctttttttgatggagtctcgctctgtcaccaggctggagtgcagtggcatgatcttggctcactgcaacctccacctcccaggttcgagcgattctcctgcctcaacctcccgagtagctggggctacagctgcccaccaccacgcctggctaattttcgtatttttagtagagacggagtttcaccatattggccaggctggtctcgatctcttgaccttgtgatctgcccgcctctgcctcccgaagtgctgggattacaggcatgagccaccgcacccagccagcagcatgttttctttgaagtgttgttcaggggtctcttgcatcagaatgtcctgaactgcttgttgggaatgcagtatcctgatcctaccctccagattctgattcagtaagcctggactgagccttggaaatctgcattttatttagcataatgtcctgggggcttgggggctccccaaagtttgaaaaccaccgctaagggctattatgtttctgtaggcaaacctatttttctgttttcattttatgtcatacaaagtaggagtttaagaatttatttttggtgaaactagaacactgtcttcaaattaataagagccttgttgtgtaggagaaatattctcttcaaaatctctccacgaaattgatctcaaaaagactggctgagtcaaatgctaaacagatctgtcctgtatctggctgccacctgtcaaaattgctgaccttacacttatgtattcaaatgcttcctggaagtcaaaacatattttcaaaagtttctagtggaaaagaactaagcctgtcgcttggttttaaaaggtggaaattgagataagaccgaatggttgagattaatttcacatcacaagaataggggtgagaagagaatagcaatttccataacttctatcatttatcttttaggttgaggatactgtgaaataatccttccctttccaaccaacatgaagatgactgatacacccatcatactgaaggattcctactgtgtcagagattacattatattaagtccttacagaaatataaagagtataaccttcaaaaaactgggaattgttaaattatacattggattttgggggctattgtttgggaggttttgttttgttttgttttgtttttccttctttcataacagttcgctcaattaactataccagaggcatctttggctgcaaaggtggaggaatcactgtgctcgaagatgacagttctacaccttggcctgacagttttgagattcttgcttctaaaataagatggaacctgaaagatgggatgattctagcatactaagtatttgactttaattggaatcattgaacgtcccttgaattttttttctcattggtattggattctgttgtctttactgatggaaatttcttttccttccattcttggttcatgacaaaccaccaactgtccacgcatgatctcctttcattttacttgtatttgaaatgaaaacctgtgagtgcaatgcctaatctaagaatcagaacattattcttttatacccctatctctgtaattctcctttatcttactccttcacctccccatccctctgccaccagaggtaaccaccattctgaacattgtttatcattctcttgcttcacccctacatatctacatgtagccttaagcaatacattgtttcattttgcctggctttgaactttatgaagaggtatcatccctggcttatatgatctcttgagacttgctgtttcactcagccttatattcctaagattcatccatgctgtcattgctgtgtagtatttttatttgtgcttatactgcagtttttctataaatgttagtataggttatactatgatttatcaatactcatgtcattgggcattcagggtgtttcctgtttttgtatctatgagcagagctgttagtaagcatttgcgtctcctggcatgcatgtgccgaggtttcccttgtgtctatgcttagaggaagtacagcaaccactgctgtgttgtggtgtatgaaatcattcaactttacaaaagaatgggaaagcgctttcagggtcgctatatccatttacacttccaccagaggtgcagaaaagatcctatcagttcacctcttcaccaactctttgtattttcagacatcaattttttttttgccaattttgtgtttataaatctactgatatacttcttaagtattttatctatcccttaggaaaaaaggtaggaaatagaatgtggttgccttcacatagagaggctagaaaacaaagtatcatgcctgcttagtttgatggcacccaaatttttctcccagttatctcactactagtagttgacattcttttctcaccctcgctagaaatatgaaaaccttgcctctgcacagtggaatcccttggaacatttaaaaaatgctaatgtctggaccccacctccagagactctgatttctttggagcccagcattgaacatagggatttttttttttaaataaaagcttcccaggtgattctaacgtgcagtcaaggttgagaatcactgctttaaaatacagaaatcttgacaagcaagcataagctcagggtagcctgatattgttaattgttctttttctcatttctaaagtacaaagtttgcataattttggagaatcctcttgcctctaatttctagctcagcagcctttgagagttttttggtttttgttttggtgtttgttgttggtagaagtaaatagtagaaattcaataaaagttagtatgggctagaaattgtgcttgacatttatttttttcttataactgtggatctcaaagtttagtgtgcataagaaacacctgggaagcattttgttttgttttacaatgcggattttgattcagtaagtcttggcgtgagcccccgggaatctgtgttctaacaaagtgattatgatgtaggtggttctagaatcacctttggataaaaactgcctcataataatcctacagtataagcagtattctcatttacagatggggggatgtgaagcccagagaagttaagaagcctgcgccgtgtcacagagctccctaggggactagcctttgctctgtaagctctcagccctgctcatagtatgcctccaacaaggctctcagaatttaggaaagtctgctttggaacatgtgttatcttctctatacttacattctttcttaatctgccatgactttctctcctcatcaaaaaacagcctttaatctcctacccaaatccacctcgtacctgtgagtcttcaggtgtgttacactctgaacatggtcccgtgagagaatttcttattaaaaattgagcttgcaaaaaatcaaatgtgttatatttttgttcttatttcaccctaaaacaatgactttagttgacaatcacttttatgcaaccttagtaattatttctaaactcatgtacaagtggatggaagtatttctgtgcacatttagaaaatttatattcattgcttgtttccctcccctgccaccccacagagtgaggactttaccatgaaatctgggcctttggcctatgtatttttaatcatgttcatattgtactgtatctgcaaccatctgtaatacagctgtatatgtttacatgaaacacaataaacttttaagtttaattccatttgtgagcagatggtagcttgtcaaggaaacatttgatcatgtttatgtctgtatttggccacaaaaacctcataattactctcattaattacatatccttttcatgttacctgtaataaatgctaaggtatcatatgtgttggccttgtgggatatatttttgtatgtagagacagtcctcttaagaatgtttgcggcctggagcagtggctccgacttgtaatccaagcactttggaaggccgaggcaggcggatcacttgaggtcaggagttcgagaccagcctaggcaacatggtgaaaccccatctctactaaaaatacaaaaattagctgggtgtggtggcaggtgcctgtaatcccagcttcttgggaggctgagggaggtgaattgcttgaacctgggaggcagaggtttcagtgagctaagatcgtgccattgcactctagcctgagtgacagagtgagactctatctgaaaaaaaaaaaaaaaaaaaaaaaaaaagaatgtttgcttctgtaggcacatttatgtctacctattatgatgtcaagggtgtattccagtttgtatctgtagctgctacaagaagggtgtcatgggatctgtggttacactcttactcttcccatctgggtatttctgagtgtatttgctccaggagagccactggttctgctggcctacatgcaaagtgtatctatctctctgttaatgcgtttcccatgatgatactcgctgctgagatacttcctaggaagttttgctttcctatcacctcctttaagtgctttcctttaagtgttctcattttaactcattattaaactagcagacttgattgcagtgaatttttcttaaataacttaattgtagggccttttgcgcgtcattttgtgctcctacttactgctcagaggtggtacaaagtcagcagctcaagagacagacctgccacccatgatctctcctccaagttctcaggatgttcagaaagttaaaatttcactctgtcgagtttccatctggcttggcaatcaatgccggattagctccaaatactctttccaagtctcttgaaggatgtgctagcctctgttttgaattctacttcaggatcacaccatctctgcatgcaagaatgacatatctgagtgactgccactaaacccacatggtggaagtgtttgcttatcctgctatgtgatgctggctatcatattgtcagtttatgaggtgtttttttttttttttgcttgtcttcttccatgtaagtatttccagagcagaggcattggcttgcagaaggtgtgcctgcaatcagtccagcttccccagatgtgctgaggcttcaacaggggtttttaaaacttgtgctagaatactcatcttccaaaaaatctttaagttgatgcaatataatagctgccaattgagcatacattttgaggtagttttctttaatgggagtatatgctcatccacactctctttccagtgttaaatattttaagacagctggttagagttgagggtgccttttttttggtcataaaacgatgacagaactctaaaatcacatggttatttatcaacattaaaaacattcttttatatccattaattaatttattctttataacagcttctgtggaataggtatataaagggtttttttttttgtctactgttatttaagagtatcataaaacctgagaaagaaaaacataattagttgtcatctagtctaatgctctcattttgcagataaataaattgaagttcagagagatgaagtcactcacttatggacctatagctagtgaatggccctgaaattgtttcccagtcatggctggaggcacaactttgtctgagacctgactgatacttttgactatgtgatgttgtgtcaattatctaacacttctggacctcagtttctttacccatattatggattattgtgaatattatattagactacatccaagaatgctattaacccagggcctaccatcaaataagtagttaatttatatcagccacttcacagctgcacttatttttatttttattttttctgagacagagtctcgctctgttgcccatgatggagtacagtggtgtgatcttggctcactgcaacctctacctcctgggctcaactgattcttgtgcctcagcctcccaagtagccgggactacaggtgccaccatgcctggctaatttttgtatttttagtagagacggggttttgccatgttagctaggctggtcttgaactcctgatctcaagtgatccgcctgcctcagcctcccacagtgctgggattacaggcgtgagccaccgcgccttcctgctgtgcttattttcaatactcttttctcagggatcttggtaaccagagcagaatggcagtttttcagctcttacaatgcctttgtttagaagtcttgtatgtgtatatctgctccatcacttaaaagttctcctaatgcaatttggaagggtttaatatggaacaagagcagggactttgggatggagtctaatgataacttgtcacatgttcttttagaagctgaattaggtagtttttgccttactggtgcgctctcatttaactgtgaggtatcctggcacttcaaacaggtaccatatggtaactgttttgtgttttaagcctggtactgtttagaacacatgcttcagagagtggtcattgtttcgctgccacccagttaaggcatgtgttacctcttgttatggatggaatgcctgtgagccctaggttcctatgttgaagccctaacccccagtgtgatggtatttggagatgaggcatttgggaggtgggtaaggttagattagctcatgatggtgggaccctcttgatgggattcatggccttataataagaggccatgtgaacacagagaaaaggtcatgtaaggactcggcagaaaggtggccatctgcaagccaggaagggaggcctccctagaagccagacactgcctgatcttgatcttggactttccaggcttgagaactgtgttgtttaagcccctcagtctgtgatattttgttatggtagctgggcttgaacagactgagagacctctgctggagtgtgcgttgttcaatgatttacttccttgtttgcctacattatacactttcactatgtctccacgatggaagaggcatgactgttcagatgcatcggggttcgtctctacctaccaaggtcctgtgccatgaggagatgtcgggccagggactcaaacaggagcagtcatccaactcctttctattaggtctttggtgatttaaaatctcatatgaatcaagagctggtagagtgctaatgttcacaggtttttatagaacattaaagctctgtaatagttattttgtatgttatataaataatttccctgcaagtatttattcatttactcttcatttacataattgcttataatcttttttaatatattcttgtcccctgcgccacccctcccaccttttttttttttttgctgtggttcatatgcttttatgtaacctgagctataaaagactagaatactgcagatattctatctgccatgtctgtcattttcttatgatgggtacttagtctaccgtatacaaatttctgtatagttaccaatgtctttttagctatttattaatcttatcttgtttctttggcttctgaatcactttgctgaagttgaaatcatctgaggtcagagccagtttttatttaaatagactgaatgcagctaaacctggattatagccaagaaagatcttacaccaagtgcctacaaaattagaagcattgccaaggacgcatcagcagagtgttttgcttactgaagtcttattctgaaataaatttgaggccctggcgatgggagcttttggttgttattggtagacctcctaaaaaatgtaatgtagtttaattttacttttaatttttttagcatgaactttctccttcatttcttctttccagagatttttgggtctatccattggttgccatctatgtgttcaaacatgtgactaggtagaagagaggtaaacaggagtgtattcacctgttatcatggagaagttattattcaagacctgtaaggggaatgtggcagtcctaaaggctgcaaatattctggcagcattgtaggattgcactttccctcctcctctgaaggtagatgggagccatgtgtcttgctgtggctaatgaaatgtgagcaaagtgttgcaagctttaagagccagtgcatgattcatcatgttcccatcccattgccacagtgtttgtgaaagcgagtgttgagatggaccctttgttttctgggtccttaattgactgtggtaagataaattattgacaacctgtactagacatatatcttcagcagtatcctttggttgggattttgttgagataagggtccgtgatttggcatactcagtgtaacctaacctattctgattcttatagggaatcagagaagtgtccttacactcagggagcttgtgatttaatatagttgagaagatgtgtttgcataatgaagaaggaaccagctgcttaactgtactctttatttagccacattactgaacaagagacaagctgattatagcataatattgagattttgagtatattcctgagaccctggtttcaactggaaaagtaactttttttttttccttgacactttcagatcacaattgatcaaaacacctatgcaaggaattaaacttgctacaaataagccactagatgcatgatacctttaaaaaagaccaattatgagttatcttttattgttctttttatattaaaaatctgcatgggaaatggaatgagaatatttataacagtacagatttgctatgatggtgtctattaatcaaagttctttattttttagtatgtggggacgacacatactcatggctaatattggtgaaattgctaattcattcattctttatttggtgattcactccacaaacatttattgggcatttggtataaaccaggcatagctctcaatgctgctggtacagcaagaaacaagacagagcctctgactttgtgtcttacattttagtgagagaattgggtaataagcaaacaaagaaaggtacagtgtggtatcaatgatgagagttataaagacaaagcagagaaatgagacagacagtgcaaggtgtgtgatctcacatagagtggtcaggaaaggctgctttcagaaggtgacatttgaacaagaaattgaagaaagcagggagaaaagccatgtgactgccctgaggaagaatccttcaagtggcataaatagccatttcaaagaccctgaggcagggatgtagtaggatgtttgaagaacagcaaagagaccagtgtggctggaagaagggtgagcaagtgaggagaggtgggtaggagatgaagccagagacgtggtcaagagccacagaaccagggcctgccctgcctctgatgaaaaggcactgggattttgaatgtgagagaaccatgacctgctttatgttggaaactgatgtagtctgtggagggcaagaaaacaaacagaccagcaaggagacttttgcatgagtccaaattggagatgatggagtttggacacagttggcaagtgtggtggttgtgagatgtgttgggttcaagatatcttttgaaaatattgctattaggactttgtgatttgttgtggactttggcctgagcatctgattgactgatgatgctattttctcagatgaggagaatgttcaagatgttgttacctatttaagagaaggtggccattgcatattgcatatgtgagcctggacttcaggggaaagtttaggactggagataggcggttggtcattcaatggataggtggatttgaatccatgagattggatgagattcttttttgtttgtttgtttctgagacatagtcttgctctgtcatccgggctagagtacagtagcacgatctcaactcactgcaccctctgccacccaggttcaagcattcgtgcctcagcctctgagtagctgagatttacagatgtgcaccaccacgcccaggtaatttctgtatttttagcagagacagggttttggcatgttggccaggctgatcccgaacttctggcctcaagtgatctgcccgcctcggcctccaaagtgctgagattacaatcatgcgccaccacgcctggcctggatgaaattcttgaggaaaggagggtaccgagaggagaaaagatgttgaagaactgaatctggggtgctcccaacagttagaggttgaagagctgaagaggaaccagtaaaggggaccgaaaaggagcagccattgaggagagaggacagccagacaagtgaagtgatccacagctacatgaagacagtgccaaggaggaaggagaaatgagaaatgaaaatactactgagaggttgagggcctgggctgagactggaacacaggatatagcagcatggagatcatggtgacattgacaatatcatgtcattgattgggtgggggcacaagcttgattgaagctggttcaagtgagaataagagatgaggaaataaagataggatatacgtttcttgagagatttttgctgtggggtgagaggtaagggaggatagctatttaggatgtgaagtcagaaaaatttaattttttaaagatgggggttatattacacttgaaagctgatcattatttagtagagataaagaaattgacagaagcatctccttaagtaggcaagaggggatgggacctagtgtaagtggtgggttggctgctgcattagctggagttaaggcattgcatgttctagatttgtacggagacatataggtgaatgcacacacttatgggaagatactgttattatcttctgcttgcctttgttttctaagaaatagaatcaagatcatcagatgggtgtgagtaaggggtcatttctaggagtaggagtgtaagttggccaagaaagtgtaataagattgctgagcagaactgaaagcacattgagattactatcatatctttaaagcaaaatcagccagtgtagttctttgtttttctctagattgtgtcatttgctgtggtgtagggagagagtctaaggattctctcgtaggtaatcatggtcatagttttgcaatctgaataatgtggaagtggagatgggcagccgtgcagtagggcacttgcaagggagcaatttttgggagtgccaaaggccaggctggaagaggtgaaggaggagggagtgatttttgggtggtgccctagaccaggctgaaggaggtgaaggaggagggtgaagacataaagtggggaacggaccatggagaggaggtcaagtcaatggatccagagggcactgatgccaaattgttgacaggcatgagagggaatgagctggaaattcctttgaaataaaaagttggcagctttcctcaagcttaatctcaaaagagacatttaaaaattacttacttttgctgcatggttggggaaaaatgtatttttcaagcatgagttcaactcattttgtaccagggtattcacactgatattcttgggtaagtcattaaaattagtcaactatttctgtgtcttcacccacaaaaggagacgtgtgagaagtgaatacttagtgattgttagattccactgaatctcactgctttgttgcagtttaacgagcaggctaggattgcagcgctgtcatttcagttgggccaccaagccttgaatgaggagataaaactggaagataaagtcttagtaggtacaacaaaagaagcttttgagagatcgttggatagatgtcatctatttggttgctaaataataacacacaaagaaatctctctactgtttatcatgtgtacttatcttgagaagcatcagtgattaaaaaaacaactttgaaaacataaaaatggtgaagtgtggcaatggtatcatgtggcaacggtaaaatgtgtttacccatgtaaatataatgtcacaaatgaatcttgtcattatattttgtagtatcttggaggttactggccagaactattataatagtcagattcatttcatatttatttaaaatccgcggtgttttcacatacattgtgtttttaggggaaattttaccaatgattaacatatattgtctagaagcagagccatctgaattgaaactcaaatataattgccacttttattaaatatacaactggcagactttgaaaatgttatctcagcatctagcattggcttcattttggtttctcattttcctattttattttgttcagtttagcaggggacagtggggaacagggttacaaattgcattttttcctgcattattggtttttgtcaagtggtttacaggccaaagtttgtggatctgccagaggctttatcccaaaactataggcaacagctatttcttgaaataattttagatagatttctacattgatttatgttttggggtatatgatgcacaatcccttaagtcttaatatgactattggtttaatatggcagaattaggatcaggttcactcattgtttattataatttacccatgcttgactacccaataaaatgtcttccctttacaatgatctttttctattgccatattcttcttgtccttaaaacaacaataacagatcctcaaacgtcattggggttaataaaagatgtttctttattttcagatctttaacaaagcttctccttaacccagagggttttcagaggagtaaagagtggaagtcatttgtacatgaattggcttttgaaagtggccctcattattttattttattttattttatttttttattatactttaagttttagggtacatgtgcacaatgtgcaggttagttacatatgtatacatgtgccatgctggtgtgctgcacccactaactcatcatctagcattaggtatatctcccgatgctatccctccccccctccccccagcccacaacagtccccagagtgtgatgttccccttcatgtgcatcattttttatgaagtggccctcattattaagccatgtctctgcctgttgattgatgttaactatctgcttatggtctgagatcagtgtgtactgcaaatgtttgggaagatatcttctttctgtggaggtgaaacttaaatatcttctataaaatatgcctcgatttcagaagtagcaattgtagcaatgcctgatgtgaccactttattactgccttagaagtacttttgtggtttgactgtggggagggaacgggtcactggagattttgctatctctccaggtttcatgctttgggaatcaaaggtaggtaacagtttggaaaaactctgtaggggctaaagctttttctaaaggtttttacgtctatatatacctctgtatgttactgcttcaagcccagcaactagcaattttagtttcactgaaattgtgttttctttaaatacacaagataatagaattgtaactggaatttacatgttatatataaagatatattttatttaatcttgtcagaagggttttttttttttttttttggtgcttttaagctaatgtggcatctttctcttttcaaagagtggcatctccaaggaatagctctgcctggaaggtgtttgtggctgtccacttaaaagctgaaattaggtcagtgttattttgtcttgagataacaaaaataagaccccaagggagtagtgacttgggatttcatttaagtacttaatttacaggaaaaaaaatacagtttccgatactgaataattattacactactgaataattatatattttttcttctcccggtgttcttatactttagaggcaattttttttttttttttgtaaagatcacaaaaggtctgattagtcaaagaatgaaagaaatgcactgtggctccaaagtcccttatccaaaacctctgggacagatgtattttggaatttaagatttttgtgctgagaatgatggtttccagcttcatccatgtccctgcaaaggacatgaactcattcttttttatggctgcatagttttccatggtgtatatgtgccacattttctttatccagtctatcattcatgggcatttgggttggttccaagtctttgctattgtaaatagtgctgcaataaacatacgtgtgcatgtgtctttatagcagcatgatttataatccttggggtacatagccagtaatgcgtcattcccagcaaactaacacaggaacagaaaaccaaacactgcatgttctcattcataagtgggagtcgaacaatgagaacacgtggatgcagggaggggaacatcacacaccaaggcctgtcggggaggtggaggacaaggggagagagagcattaggaaatatacctaatgcatgcggggcttaaaacctagataataggttgatgggtgcagcaaaacgccctggcacatgtatacctatgtaacaaacctgcacgttctgcacatgtatcccagaacttaaagtaaaatttaaaaaaagattttttggagtttagaaaaataatacatttggatttagcagggtttagtgcggcactttttaatcacacacactaatatttctgtagtgaaactgaatattcacactgagataaagactatgaataacttcacatcagttcaggtaaggttttgcctcctattaagtcttgataacaaactttaaaaacttaaaaaaataaaataaaataaagtttattttcaaaacttttgaagtttgcgcgtacagctagcttgtaggtctggccttgcttttctttagattatatttcccttattagtcttctaaacacattaaatctgtgtttaccaacgctgtaatattttgccaccgtgaggatggtctagaggccagcaccatccacatcccttgggagctggctagacatgcagaatcacaggtgctaccacgaagctgctgaatcacaatctgcattttaatagaatccccaggtgattcatgtgtgcgttaaagatcaagaagcattgctgtagtattatattggctttaatttagattccaagtcttaaagggaaatgctgatggggggatactttagttgtttaaatcctgggaaagtgagcccagattacactaatatcatttatttaattatgtatgtatgtattttttttttttttgagacaagatctgacggtatcacccaggctggagtgcagtggtacaatcttgactcactgcaacctctgccttgtggggttcaagccatcctcccacctcagcctccagagtagctgggactacaggcatgcaccaccacacctagctaatttttgtattttttgcagagagggggttttgccatgttggccaggctggtcttgaacttgtgagctcaggccatctgtccacctcagccccccaaagtgctgagattacaggcgtgagccactgcatctggccgaatatcagttctttttaattttttattcaatatttcctccgtctctccctcccactcttcctatttttttttttttttttgagacagagtctcgctttgtcgcccaggctggagtgcagtggcgcaatcttggctagctgtaacctctgcgtcccaggttcaagcaattctctgcctcagcctcctgagtagctgggattacaggcgcctgccaccacacccggctaatttttgcatttttaccagagatgggatttcaccatcttggctaggctggtcttgaactccccacctgttgatatatgtgccttggcctcccaaagtgctgggattacaggtgtgagccactgcgcccggcccactcttcctttctctcctccttccttttctttttctttctttttaaaaataagtctcataatacttgactttaaatggatcatttagtctatttatttacatttattatattcttgatatatttggatttcttctcttttatactttctgtttattctacttttgtttctttctcttgttttatttatttttttgagatggagtcttggtctgtcactcaggctggagtgcagtggcgcaatcttggctcactgcaacctctggcctcctggcttcaagtgattctcccacctaagcctccgagtagctgggattacaggtgcatgccaccacgcctggctaatattttgtatttttagtagagatggggtttcaccacgttggccaggctggtcttgaactcctaatatcaaatgatccacctgcctcagcctcccaaagtgctaggattacaggcgtgagccactgcacctggctctttttcttttaggttgatattttttttctcatcctattccttcctctgctagtttgttatataccctatttctctcttttagcagtaatcctagaaattgtagcatgcatactttatttataaaagtctaaattcagtcagtatcttttcttcctcctaaacaatagctcagaatgttttaactcccgttttcctctcttgtgctgtatactattcttgttgtgtgtttattctatttttaaaaattattaatcatagatgattttttaaaacttatttttttcaagacagggtcacattccataagccaggctggagtgcagtggtgcagtcacaatgattgcagcctcgacctccctgggctcagatgatcctcctacctcagcctccagagtaactgggactacaggcacacaccaccatgcccagctaatttttgtatttttagtagagacggggtttcaccatgttggccaggctggtcttgaactcctgggctccagcaatctgcccgccttggcctcccaaagtgctgggattacaggtgtgggccactgcgcccagccaatcacatatgatttggttgtttaatagtggtgtttatctacatttattcacatatttgccacattagttgcttactacgtatttttgcattttagaccttctacttggaatcaccttcttcaacttggattctttagaccttccttaactgagagtctcttcatggcaaactgtcttggattttgtctaaaaatgtctttattttgcccttattctaaactgttactaaactatacattttgttttttgttagtgtatctgatttgctggctgtcattcattgtgctttatttctctctctctctctctgtctctctctgtgtgtgtgtgtaagggagagaatttgctaattagttgattaattttccactgtgagctgttcatttttcttacagctttgttatgaggattcttccaggtctgagttacagaaggattctcctagaaagtatttaaggttgcttctgctatgtgcctgggttattaccaactgtgactcttcacattaaatttttggcttcagggttttgggactctaagagctgtatgaactcgcactgcaaactcatatgagttttcacttattatagtaaattctcaggtttgatttttttcttcttccatccatggccaagatttgagacaggcaagtttccttgcactccaggaatgtagcttgacttactgttcctggtgttggtggtggtgctgctggagatgagatccttttagccatcctatctttggcaggccctgggctttgtttcaccctgaactctgaaccctgaatcctgtgggcagggcttctgctagcccatgtggctccactctaaattgatgcaggcactcagcttgttaaagggagcactggatggatttcagcaagcttcctgttccttatggttctgtctggtaggccttaaacctaggctcaagtactctggagttaaacaagtggcccaaggcaaaagccagcttcagtgcttaacttacttcgcagggattgtatgtatgtatgcatgtgtatgaatatatgttatgtatacatatgtatgttttgtgcgtgtgtatttcaccgttgagtgttaattactcccttgttacaactcattgatgcatttaaataaaacatttaaaatattttattcatctcctctcatggttttcagcaaaaatgtaggtcagggtaaattaccagatatattggaccagctggatgtagtcgcctttgatttttttttagttctaccacctatgtatgtatcaataaacaatgtattctttagtgcttccttatttttaaacattatgtgaattgaataacttatgtaatcttttgcaatttggtttcccgcaacatttctatatggagtatggttcgttcatatttactttataccaatatatgaatttctttagctattcaacacaatttaactattcagattccactgttgatggacttttggattctttccaatttttgctattggagttttccagttttgctgctaagaacactctcgtacatgtcttctggtgcattgtccaggattttctctagaatatattcctgggggtagaattgatgattcattgagtaagcatgtgttgtaccttactaggtaattacaaatggctttccaaagtagttgtaacaaattatgcttccattagcggtacacaagagtttctgtggctccatgtccttaccaattcttagtattgtcaggtttcttaattcttgcctattaggtgggtggacttaatacttcttagtttagttgttataacttgttttttaaaattaacatatctatgtgcatattcgtagtcatacatgtttgtctggtcatttaggtacttatgcaatactctagtagactcagaatagaaattagccatggcaacatatatattacattcttcatattgctacatttgaaaataatcataattatttgcagaaatatgaacagaacatatagaattaaatgttttcacgatgtcttgtattatctttcatgtttcatagcaatctctgtgttataggccacatcaactgcttttgcattgttctgacttacaggaattgcagatttattgttctcagtgccatatttaagttccttctctgtaacaatcaggtgtaatacttgtaaatttttttaaccttagtacaaatttaaaaagcagaaatttctcttgcagcttcctgtgtttcaggcccagtgctaagcacatggcaagcattgtcccatttagttctctccaccatgcttcgggcaggtgctgttgttaagcccctttcatggaggagtgaactaaagcatggagaggttaagggtcttgatcaaggtcccacaatcttattctcaatggaccttctccttctctaatctaaaaccctcattttattttgggaagtggatgtaggtctaggaagcttgtttgtgtgtgtgtagtttgtttgttttttttttttttgagatggagtctcgctctgtcgccaggctggagtgcggtggcgcaatctcggctcactgcaacctctgcctcttgggttcaagcaattctcctgcctcagccttctgagtgctgggactacaggtgtgtgccaccatgcccggctaattttttgtatttttagtacagacggggtatcaccgtgttagccaggatggtgtcgatctcctgacctcaggtgatccacctgccccggcctcccaaagtgctgggattacaggtgtgagccactgttcttggctgtttgtgttttatattaggaggcagagagcacttaggggaagcagaagctctggtctgaggaggcagtggtttacttattagttcacaggccttttaggtaatcactggtccttcacttaattaagcaacttaatatatgtcttacggattaagttaattttaaatcaatgctaatttttatgtcaaaatatattaagcagcatcacattaaagtcaaaggtagtcttgtaattattagagcaataggtatcgtgctgtcgttctccaatgtggctgcacattggacaacctgaggagctttaaaaaatactgctgcctggggatcactcccataagctctgatttatctcgtctggggcaccaggagttttaaaatttctccaggtgatctaatgtgtagccaagcttgaagattactcgatagtcattgattatgtgcgtgccacattcagattggtggggttcaaatcctccttctgccactcactagatgtgtggccttagttaagttttgttaacgtttctttatgtcttcatctgtaaaatggggatgaatgataaaaatactgtctgcatctcagagcattgttatgaggattaaaggggtacagtaagtccttatttaacgttgtctataggttattggaaactgcaacttttaagtgaaacgatgtataacaaaaccggtattaccatagattaattgacataaatgagagttaagttcctgcagcatatttttggtcctaaaagtattatcagacttctacataaagaccaaaacatttctaatattaaacactgagagaaatctaggttatacatacatttaagaaagattaattcaatcatttactcaattattcgactccagaatagtgggtggtccgagcctgtcctggcagctcagggtgcaaggtgggaccagccaaggacaggacaccatcccatcacagggcacactcacgctcatccacactcacactgggaccacttagacatgccagttcacctaatgggcacagctttgggaagtggagaatgtgaagaaaatccatgcagatgtggtgagaacatgcaacctccacacagacaatggccttggctggaataaatttttttttctcacaaattttataatgaaacaatgttactgtaggacctgctgtataatatatacatattaataaaatgcttggaatagtgactggcacaaaatagtcctttactgtgagctattttaagtagactaagaaaaaattattactattattggatattctctcaaaagtatcttgggggctaagattttaaattaaatcaaattttgcctagtactaagcccactttggtgttttcttggctttgtttaatttttttctccatggttttatttaaaagttatttctaatcaccctgtcaacttagcagatatctgttggaatcatttaaggtgtttgtttccaaaagactgcagaaattaaatcaagatatttgcagaggaatgactgacagcttgcaggtagactggagaaagtgcttcctaccataacagacagaaaaaatggtagtacaagagtcagcatttcttatttatttttctatgaggcagggtctcgctctgccgctcagactggaatgcagtggtgtgatcatagcgcactgcagcctcaaacttctagactcaagggatctcctgcctcagcttcctgagtagctgggactataggtgcttgccaccatacctagctgattttttgtaggggtgggtagagacagggtctagctctgttgctcaggctggtcttgaactcctggcctcaagcaattctcttgccttgacctcccaaaatgttgggattacagacatgagccaccatgcctggccaattgagcatttctttaaactggaaactagcacctttataataatttcacacataccattattgttgaaaatagtcagattttcagaggaaatctctattaacctaagttgtataaccttttgaggttgtaccagtgtagagcctgtttttccgagcatctacatgctcaatgctattttttcagttatccagcatccccccacttgtttctatcctatctcatatgcaagagggtgtaaatgtttttgtgcattgcttttacatttttatttatctctcaagtgggcaagtaagacagtcatcaacagaggttgcatttggagatcatattctgttttttctttaaactatttgatcatttcagagaaactttattctcagttctgttttgtcttcagctgtcaatatccctgactccaggccctttatttagcttccattcttactgatgtggaaacatacttttaaatgaactgcctttaaaaagaaatattttagtaaagtgaaggatctttttgtaatgcaaataatgttttgttcaggattttcttgagaaatctgccatgttctctaagcctttgcctccatactggatgtggctttgccttttttgttgtgttgaagggcatgcacagatatagtttctgattatttttctcagtctgatttctccaattaggcatattatcattagaaaactcgcccattttcccatggtgtttaaaagtaaaccaggacttgtgacactatgctactcggcatttatgaaatgtaatttaattactttgtttccattgtgaagactcggtttccttatttcctatattcatttatttattcattattggtatacccaacaagataagtaaatacgatacagccttgcatttgacaattttatggtgtgtatgtatttatcatgcctgaactgtgactagacttaagatgaagatggtacctaaatcaagctcttttatattttgtctttcccataatctagtctgtcttttctttcccacaaaatagaatgggatactttttattataaatatatgacatgttcactataaaagagaggcagtaaaggaccagagaaaatgacctgtgatgccaccacctagaagtaatcactcttgttaacatcttgttatttacttgtacagtttttttctgtgttcataggctgacatttttccttgcagatgttctctctctatattcatacaaagctgcagttgttcaagtcccaccccagcctctggaggtccaggatgaatgcctccctctttctgtcctggtaccttacgtgacctccggacggcagtgtcagtgttggaaatggcaggctgctgcaaatatgctaaaacctcatcagttgtctctattcgtctgaccaaagtccgtgggaagagcaagatgctggtgatatcctggagctcttctgacacaaggctctggctagccttgatacattcctcaaattcttccttccaattctgaaaccttttgttttccagacaataaaaccctcccaaactcctacctagacattctctctaagcagtcctgggagaccacatgtgacttgacttttaactatctttacagcgtttacattttgctccttctttttgtcatgccattactagagggaggatgggccatccagagcagcgtgcgccctccacaggcaccttagcctgttcttcactccgccatgattgaaagaggagaaaatattctatagctgttccttttctgttcttggctttttcactcttactgaccttacaagttttatttttccatttctgaatctcaattattttcatttctcctattcagtatagtttttaatagatagcattgcattacatggatgtcccttatttaatcaactgtttggtatttcttttctgtttttcaaaatctaatgaacactccagtgaatatccttttgttcgggatttatctctagaaggaagattactggctaaaaatatatgtacatttaacattcatatacatatctatacacacttttttttgagacagcgtttcactctgtcacccagactgaaatgcagtggcatgatcattgttcactgcagcctctacctcctgggctcaagcaatcctcccacctaaacctcctgagtagctgggactatagacacgtgccatcatgccagctgagtttaaaatctcgttttgtagagacatggtcttactatgttgcccaggctggtttcagactccttgggctcaagtaatcctcccacctcagcctcccaaagtattgggattataggtgtgaaccactgggcctggcctatgtatacataattaggctatactgtctataaaatttggctatctatagtcaaattattttatatgcatatatccaaatatacctataaatagccaaattatacatatacagccaaattttatatatatatatatataaatgttatatatatatagccaaattatataaagctgtatatatagtcacattatcctacaggaaatgatgtaaatgtaccaatttacattcctgtaacagggcattagaattccctttttccagagccttgccaacactggttatttataaccctttcaaactttgtatgaaagttgtatgtattttaagataaatgaaaacttatattgatttgtaattatttattggtataattgaacacctttccatatctttattgtactaatgtgtatgaattccatcttaatagttttgctaacttgtccattgaggggtttcctactgatttgtaatggctctctatataaaaaggatgttaatttttgcctattttacagtaatagtacaaatattctctcatgttttctattagtcttttaacctttgtttagttttttttcgttccttcataaatgctaaattttatgtcatcatatctttcagtccttttctatattatttctggctttgatggcatgcattgaaagcccttttccaccccagagttatcaactcgttggaaaatgatgttgaaatgtcacttttaatatttactaaacactcttgcctaatttgttctattttgaagccctttaattctgtttctttaatctgcctgtcttttttttgtgcctgttccttactgtcttgactactgcaggcaacatacttacatctaaagaacaagcacacctattctgcccttttgctaaacaaattttcagcctctttttcaatgattattttttcaaatcaatgttaaacatcacgtaaagtttcaagaaaacccctaggggtattagtatttagagtgcattaaatttttagctaattcatgggagaatttgaagtattatatcttctaatttaagttagagtacaggaattgtctgtctttatccctctaagtacattcagattctcaagaatagtaccaaaattctcagatccccctctaccagtatttttctcccactgatggctcttcaaccctaaaatgtcttagtggtatggtttggatctctgtccccaccaaatctcatgtccgatcgtggtccccactgctggcagtagggcctggtgggaggtgattagatcatggggaggcttcttatgaatggcttagcaccctccactttgtgctgttcttatgatagtgagttctcatgggatctggttgttaaaaagtgtgtggcacctccccaaaccccttgctcttgcaccggccatgtaaggtgaggatgcttcccctttgtcttttgccataattctaagtttcctgaggcctctccagaagcagaagccaccatacttcctgtacagcctgcagaaccatgagtcaattaaatcttcctttataaattacccagtctcaggtatttcttttcttttattcttttctttctttcttttttttttaagagatggagtcttgctctgtcgtccaggctagagtgcagtggcgccatctcagctcactgcaacctccgcctcccaggttcaagtgattctcccgcctcagcttcccaagtagctgggattacaggcgcccgtcaccacgcctagctaatttttgtatttttttagtagagacggggtttcactatacgttagccaggctggtctcgaattcctgacctcaggtgatccacctgccttggcctcccaaagtgctgggattacaggcgtgagccactgcgcccggccaggtatttctttatagcagtgtgagaatagcctaatacacctagcctgatgttacacttaggatcctcttcattattcttctgaatccaagcctccaactttatctacccatcacggttttagcttatattttgattttatttcttacatcttcccttatatttattattttaatattttgtttctcttttctccttctatacttgtactagatttatcagaatctgtaaatctcttttaaccctattaatttgttaactcagttaaatatatctattttgccaatgctcatcttcctatttttaacagtcatatatcaaactgtatttctcaactgatgtaccaaaattaaaggacacctagatgccctccctcagctaaagtgtttactactgcatccaaacccatgaattctccctaactgagagaggatatttagagggcctttgtgccttttttttttccccctatttcttccttgaaaattctggagctttttgaaataatttagaattttacttttaagatattattaaatttttttctacagcatgcctctgtttaaagaatcaaagctttttaaacatatcactagtcacatatattatctgtgtagacttagctatattatcatatatttatttttataaagatattgctcagcactattcttttacagttttatttatcttaactgacaaatgaaaattgtatatatttatgtatacaacatgatgctttgatatatgtaggcattgtgcactggctaaggtaagctaattaacacatgcctcacctcacagacttatcatttttttgtgagaacacctagtgagaacacctagaagtcacccacccagcaactttcaaatacattgttattaactgtagtcaccatggtgtataacggatcttttaactcattcttcatacctcactgaaattttttgtcctttacccaacatctcctcagtccccttacctcctctagactctggtaaccactgtttgaactctgttcctatgagttcaactttttttattctacatgagtgagatcatgtgatatttatctttctatgcctggttcctttttcacttaacattaatgtcctccaggttgaccatgttgtcataaatgacagatatccttcttttttaaggctgagtagtattctgttgtatacacataccacatttcctttacccatttgtttgtttttgaacacttaggtggatcccatactttgattattgtgactaatgctacaatgaacacgggagtgcaggcaactcttcagcacactgatttcaattcctttgggtatatactcagggattggattgctgtatcatatggtggttctgtttctcattttttgaaggaccttcagaccatttccataatagctgtactaatgtgcatttacatgagcagtgtacaaagattcccttttctctatatcctagccacacattatctttcgtctttttgataacagccattcgaacaggtgtgaagtgatatctcattgtggtcttaatttgcattttcctgattagtgttgttatttttttttcatatacctgttggccattcatatgtcttcttttgagaaatgtctattgaggtcctttgcccattttaaaaattgttatttactttcttgctattaagttgttcgcattccttatacattttgggtattaatccctatcagattatgatttgcaaatatattctcccattctatagattgtctactttgttgtttcctttgctgtgcagaagctttttagtttgatgtaatcccacttatctattttttgcttttgttgcctgtgcttttagaacctgatcaaaaaattattgcccagactagtgtcttggagcttttcccctgtgttttcttctagtaattttacagtttcgaatcttaggtttaagtctttaatccactttgagttagttcttgtatatggtatgagatgagggtccaattcatttttctgtatgtggatatccagttttcccaacaccatttatttaagagacagtcttttccccatgtgtgttcttggtacctttgtaaaaaaatctattgaccattgactatgtggatttatttctgggctttctaccttgttccattggcctaagtgtctgtttttatggcagtaccatgcattttgattactgtagctttgtagtagtttttgaaatcaggtagtgtgatgtctccacctttgttctttttgctcaagattgcttggctctttggggtcttttgtggttccatatgaattttaggattgctttttctatttctgtgaaaatatcattggaattttgataaagactttgaatctgtagattgctttaggtagtatggacattttaccaatgttaattattccagtccatgagtacaggatatctttccatacatgtgtgtcttcaagttcattcatcactgtcatatagttttcagtgtacagatttttcaattcctggttaaatttacccctaagtactttatttatttatttttttgctattgcgaatgggattgttttattaatttctttttcagatagtttgttgtatgtggaaatgctgcatcagcactaattcttacatattttatcttcttgagatcttttctgtttactttttatttgattgagatgctttcttagataccagtattggtatactttcttgagtttgtttctaaattatcttttcctcctcaaatatgtatttctgctgttctggtcttggattgcagttctctttattcagatgtgtgtgaacactgttctattgttatctgtggtcaagcattgcagacgagaagtctgatggtagactaattattttccctttttaacttacttctcttgtctgaatggaaggctgtagaatttttctctttgtctttgaagaaatttctctagaatatgtccagatgtcttttttatttagcctgactagaatgtctgagcctttttatgctaaaaatgcaagtctatcttcaactcagcaaaaacttcaaactgaaaaccgaagttttaaaaccagtgaagctttcttccacttttaaatattattaccacacctacttcttctcgtaattttttactttttttttcctaaaaaatgtagaaagtacagaaaataatgcggaaagttctcatttagcccaagcagagagttaaaaagataatcttttgtcatatttgttttagatctttttttaacagtatggttatattttaaaatgcctagaagactggagttaaagtcattcagttatttcttaatagtacttagagagttgctcatgaattggaggataatgaaatatgagacatgccagagcaggagaaggaaattctaggggctatttggggtcttttgtggttccatatgaattttaggatttaaaaaaaaatttctgtgaagcatgtcattggtattgtgataaagattaattgcatctttagatccctttgggtagtatggacattttgacaatattcttctaatttgtgaatatgggatatcttttcatttcttgtatcttcaattaatttcatccatgttttatagttttcattgtagagttcttttacctctttggttatattcattcttaggtattttttatttgtagctattgaaaaaagattgctttcttgatttctttttcaggtaattcattactggtgtatagaaacacctctgagttttgtatgttgattttgtatcctgcaactttactgaatttgtttattaaactattagatgatagtttaatgataaatgtttaaggtggcagatatactaattaccctaatttgataattacacaatttataaaagtattgaatcatcatgttgtaccccatacatatatatagttagttattatatgtcaattataaataaaaaattatatactacgttggttttcaaaattaaagtaataattaaaattcgcaaatgatgggaaaaaaaccggaagttcttgggggaaataagcatatttcacagtgtcatggaaattgagtcctgaatgtcaatattgtttcataaatacttgtaacatacaatgcaatagggatactacatcaggatgcttttggctccaagttacaaaaaaccccaactcaaattggcttaaagagggaagacatttgctcatctcacacaaaaggctactcagctttgcctcaatccaagccatcatgtaatcacatggtgggtatagaaatttgaggtgtacttacacctgtgtacatacctctagatgtaccagtgtcctcaagaataagaaatgccatttgccttttgtgtttcttatttagaagtgagaaagtcttttccagaatctccctagaaaacttgcctataaggtctcagccacaattcactcatacgctcattcttgtaccaactggtggaaagaaagaatagaattcacgggaattctattgaatctgacacagattgatctgacatagatcaacggttcccaaccaggtggagttttacctccagaagacatttagccaagtctggaaacatctttgtgctcgctggggtcccctactactggtatctagtgggtagaggccacagacactgctaagccttctacagtgcatgggatgcttcccacaatacagaatgatctgattcaaatgttaatagtgtcaaggttgagaagccttaacatagaccagttaggatctcacccttcagggccaaggaaagggctgtttttcactgaagcacagggctaaggaggggctatgtggatgttgtgtagcccactgggaatgcccactgccatgacgtccctcggatggagctggtcttctgagctgctcagaaagggaagctcggatttgtgggttttaggctactaaaaattaaccaaccacattgaatttcatgtttttctaattcattcctagtcttcttgcctgttaaactttctgctaaagataattctaatgaatttgagaaggtatttataaaagaatatctgtgaggctgtgtgttgcttgactggcagccaaaagaaatgttgcttggggaaaatggcacgaattaaacattgattgcccatcagtcttgtacttggggtctggggtagtctggaatacaggtagggagatcattcaagcttcacagagaggttcactagtacttataaatccaagcattgggagttgagaattgccagaaatagtcatgtaatgatattccatgttgtataggtgtttgcatttcttcctttctaaaaacacagtggttttggaaataataatatcctagaacagtggtcctcagctttttttggcactaaggacaagttttgtggaagacaatttttccctggatcttgaggggaggggaggatggtttcaggatgaaactgttcccctcggatcatcaggcattagattctcataaggagtgggcaacctagatcccttgcatgtgcagttcacaatatggtttgcgtttctatgagaatccaatgcccccactgatctgacaggaggtgaggctcaggtggtaatgctcactcacccaccgcccacctcctgctatgcagcccagttcctaacaggccacagactggtagcagtacatgacctggaggtttgggacacctgtcctagaacatcctggattaagcaattaaggatctctgcaaatcctagctccattgctcaactttgaaaagttgttggactgttttcagctttgggtacctcatttgtaaaataaagaaattgaattacaggcacttacaggtcctgcaattccccgtaactcagataaaaaatagatccctttctcccttcaggagaactcatgactttggtagcagctagagttagcatttgctcatgcttttattgtgtttagcaatcaatgggaagtgcatcaggtgaaatctctcaggcctgcatatgtctggtcaaagctcattcattgattttttttttttcctgctgaaacttgcacatatataaaaaacgaagacactaaatttaattttcaccagctcagtgtatagtattgtggctgctcatgttcctgaagagcgagttgttctcaaataataaactaagctgtataatctttaaaatatttgaccaggtgggaagcctttctgtgaggacaatgtgtttgtgcgtttggtgcttaagcttcaatcccctggccacagcttggatttatttgcaggggaaatctgctacgtaagaagacaaccactttgggcaacattatcttcatcatcagcatgcacgtgtggtaatgacctgttatgagcctgacttggaataactttcttcctcacagaatggtggatactccatatgtgtagaattactgagagtaattatctttgcaacagtaaggcgtgagggtaagaaatcaataaagcagaagggaaagatattaacatttatcgaccactttctgcatgacagcagaaggcggtcaataaatggcatactttattttaatcgtattaggtgattattgcagtattatcttaatttatgtgtgaagaaattgtggtccagcgaggttaagtcacttgctcagtgtccctcagtattaagtgataaagcagaggtatcaacctaggataccctacaaggtttggcttccatctggaagcactgagtacctgggcccagatatgagacagggtcccagcccagagatttgttggtttatcattccttcagcaaacacagcttacttccaagagtgtagaaattggggctgtgcttcatagcaagataataagcatcagaagggctgggtgtggtggcttatgcctgtaatcccagcactttgggaggccaaggcggttggatcatttgaggtcaggagttcaagaccagcctggccaacatggcgaaacctcatctctactaaaaatacaaaaattagctgggtgtggtggtgcacacttgtaatcccagctacttaggaggctgaggcaggagaatcgcttgaacccaggaggcggaggctgcagtgagcccagattgccccactgtactccagccagggagacagagtgagacaccatctcaaaaaaaaaaaaaaaaaaaaaaagccatcagaggagctacagtgatgctggtgaggcagacatttcctgactcatagcaggttacctttgtttcctcgttataatgagaaaaagttgccttccctggacttcctcctattcatcttttttttcctgtcctcttcttgcttaggatgccaaggctgtgacatttatttctgctctcttccctttgagatatgctgaagtcatttaaaaaaatgtcaggaataaaatgcactaaatgatgactgtcttagaaaagactccagttaagctgtgtgcatccagaaatgcaactgtgctgaccagtttctgcctcccttgccctactgataacatgatgggagatgaagtcgtttttcaaaagtgttctgggtccagagacgtttgctcgacacctgtgccctccattggtctaaaggcattagagtttttctcccacaatatttgtctttgttattttgaatttatgacaccctggttgttggtgtttttctttgcattcatacctgactcttgacctccaaaagaaccagtacatacattttactttaagctgggcatttttgtaatactatgcaaccttgaaaataatcgcagtgatattttgcttttttataaggccttctatccttctttgctcttgcatctctctttcccctttatgacagtatagcagaacatatttcattcttccctgagccctctgcagagcaattttgtaactgatttgagccatgtttttgatggagtatctgctctctggacctttccatctcctggttgcaactgtgaaccaccctgcctccaataatctacatccaaaatgctgagcaggagatttatggaatttgtttgaagatattccctgaactctctgaagctaactagttcctttgcaagtaagtggctggaaacctaaagatcttgtgaactgggttctagaagcatgggataacaaatgtaagatttcagactggaagttaaaagcgagttttcctcttgattcagtttctaaccagtcagctaaatggtctctgaatagttgtagctaatgagcaccatcccccaaacagtcaattgtcttgactattaaatacttaaatccatgtattttcgctggagtgtttattactatgtgttcttaggaccataattataaaatgttaagttaggacgacacagaatatttttctctgagtatttttgcctctttcatcagataagatgaaattcatttttattttattttacattattatgattattattttgagatggagtctcactctgttgctcaagctggagtgcagtgccacgatcttagctcactgcaacttctgcctcctgggttcaagtgattctcttgcctcagcctcccaagtagctaggattacaggtgcatgctaccatgcccggctaatttttgtatttttagtagagacagggttttgccatattggccaggctggttttgaactccttacctcaagtgatctgcccgccttggcctcccaaagtgctggaattacaggtatgagccaccgcacctggccgaaatgcatatatatatatacttttttaatggaatgcaatggaatattgtgaagtagtaaaacatgaataaactatagatacatacaacatgggtcagtcttactaatgactgtgagtgaaaaaggaagctccagagaaatacgcgtattatagcttggttataaaatttggaaacttgcaaacttcaacaatatactttttttttttttaaggaagaaaacagacaaaattcagaatagtggttatagttggggtgaggtgagcccatgagtaaatactggtaatgttgtaatttttggactaaatcatggattcgcaattcttcattatattattaaaactaagttttaaaagacccacaaatgggccagtgatgatagtttttccagaattgatagccatcaattctgatcatccaggatccttggaaataaattgcatggatgagctcattcatcacaaatctggggtctttaaagtttctgctgttcccagttctttggattcatagctatgatccttagagggcaacagatctctcccttctcatggcagaaataaaggtcagatgagaatgggagagccatcagatagagaccactgtggaggagtttgcgctttgggctgagcaaagagaagaccagaatcttttggtaccatctccttctgcatttgagatgaaacttagtcttttaaaatacatgcagccccagtcctctgtgttgccagtcacctgagctacctttgggggtagggttttgattaaatggcacgctttgctcatgagtaaccttcggggcacattttgttggtaagaaataaatgcatcactcatttgaatcagagctgcaagtgccatctgtgatgcactcctccttcccattatcacacaaatgtgtttctgtgtgactggttcctggattttgcaggctctcttgccttgcgccgattgctggctgagaggtctcagctcagcgttcaccacgtatcactatatttctattaatacttctgctcttcttggcaaaacagaagtggggcttcatttgaaatgatgggctggggagaggggaagggaaccatctcactcatagttattgacatcaagctaccatcatctcttgttcggataactatgagatttttctgctccctttatgcccccgccccaccccttcccagccactttctgtcctctgccagagtgatcttgtgaaggcttcaatcagaccagatcattctcctgcttaaaaatccccccgtcgtttcccgttgctcttagaacaacatccacactttttatcctgcagtagggggctctccatgctctagcccctgcctatgttcccctcctcatcatgcctttctgccctttgttcactatattctagtcaccctggccttctttctgctcctcagtcactccaagctcattccctctgcaagaccttggcatatgccatttcccctgtcaagaacgttcctgctctaggtcttcgcaaagcttacatgttctcattgttcaccgaacagtcttccctggccacccaatctaaagtagtccagccccacctcgaaggacactgtctcattgcaccttttattatcatcactgcatttaccattctctgaaattattctattcacttgtgtgtttatggctgtcctgattagaattaattttcataaagagaacaagaatcttgactggttcacccttcaattccttgtgcccacaacagtgactggcacatggaaagcattcagggaataaaagcacaatggaaaattaaaacatactcactgcatgcctgccacctatagaaccaaattaaatcactgccaatatgcatggggaaaaccttcccatttttctggaataatgttacaaaggatggaaaataagtgcacatcacctggatggcatttaataaacgctgtgacccagtagtgtacatttcagtgaatattgccaaaggaagtaggccaacatcaggtaatctgagttaactttcctgtacattgtgtattcgtttcctgatgatcaaaactggattaattagtctacaatgtatctttcctgttagatacgaagattatctgctctatccaatttgtgttttcttagctgagaaatcactgttgaattttaaaagcagcttgcctggtcctcatttcctggtcttctgatggaaatggtttatggaaaaaaaaatatttactagagtcagataattagaacattttatgtattttgcatatgctaatgcgtttgagttcctttgagggagagccgcatggcataaagcagaatgaaaaggatgattcaaatttcttcacccagcctcctcccctggccagatttagcacttcctatataccaccacctcacagcttagcttggctgggagctcctcaggtttccaaaggacggtccttccttctccctcccccaattgccatccctacaccagggtgccaactcccaagtgggctgacaggaagggagattggaaacagctttatagtagatttgatgctgttataagacacgttgtaagacatcaggtaaatatagcacatcagattttattaatcataagaattctttaaaagccttcagcagagccgagatcatgccactgcactccagcccgggtgacagagcaagactccatctcaaaaaaaaaaaaaaaaataaagccttcaacagtggctaaacacaaaaccagaatccctttagatttcttaaaatgcctttgtagttcttttgtaatatgggtccttgttggacaaagttagtaatttgttttttatatcctttacattaggggtttctaacccccaggccatggaccagtaccggtccctggcctgttagaagccgagtggcacagccggaggtgagcagcagttgagcgagcgttactgcctgagctccgtccacctcctgtcagatcagcagcagcattggagtctcacaggagcgtgaaccctattgtgaactgcacatgcgagggatctaggttacctgctccttatgagaatctaatgcctggtggtctgtccctgtctcccatcacccccagaaataaagtttctatgattacaataaatgtaacacacttgaattattcatcccaaaatggtctctcccgactccccactatccatggacaaatcgtattccataaaaccagtccctggtgccaaaaaggttggagactgcttcttttaatgatcatgttcacatacggacagtgaaaaggtgggtcttcttagaggttaaagggaaagtaggacagttgccacaaagctccctttttggagagtgcccagccagggagtgttactagggcccaccttggccttgctgatgtcttcagtggtgtccttgaagtcagcatgggattggcgcaggctcctgttggggcactcggtgaaggtcctccctcctccccagtagctctcatttccagggcccttattttcttttggccatctgggactgaagtcttgctcctggtgggctatctctgttgccctatcacctttagtgatttccactaaataaccctcttttaagcatttaggggaagagggagtagcatgaacgtttattgtgcagtggggtgagaaagtcagtaccagtttcaacacgccctccagctgccttcctccagggaggggacttcacactggctgtctccacagatctgcagtgcccttgccatagctccaactcctggccttctcccactccccgctgcctgctggcacatagagcccttgggccattctctgtgtggtattggcccctgcctttgcttatgctctctgctgtaagcagctaggcttagacttccctaagaggagtcccggacaccactgaggatgcattttcccttcctcacgtgaagagagcattaggtgcccttagctttggagggagtggagctttggagcctggagacaggggaccaggaccagattacccagcctccctagattctgctgaactcatctttcagtaaagaggccagatgagctgagctccacttctctctggctccatgttcctgtgacttttgactcatctgaggttgactttgagaaggcaatcccttttaaatatattggaatccatgtagtatgaccctatccactgtggaatcttactccattttactttaaagagaatgtaaatggtttggctgcacatcactatgaaaatggcctaagtaagcagaacggagaagctgccaggagagcagaggtggagagtggaaggggccaagccggttctaaatcgttttctgcaggctcctgtcctcagatgtactcacttcatgggaaccaaatcacatttaactgctctccagctcttaaaacaggataacttgagccatctgatatttgagaagaatacagcaacccagaagatgtattaatactctattctctaattttccagaataagtcagatcattgacaaatgacatacttgggctgtattaccttcctacagaaagactttcactaggtttagtaattagctatagcttcagccttttgttttgttttgttttgttttgttttgttttgtttttgagacagtctctctctctctgctgcccaggctggagtgtgaaggtgccatctcggctcactgtaacctccgcctcctgaattcaatcaattctcctgcctcagcctcccaggtagctgggattacaggtgcacgccaccacacccagctaagttttgtatttttagtaggtatggggtttcaccatgttggccagtctggtctcaactcctgacctcaagtgatccacccacttcggcctcccaaagtgagcttatgtctttttgaaggatggctatgggaaaagtccacttgaaggatgttttgtcatttatttacttactgattaattaagatgggaaagtcttgctatgttgcccaggctggtctctcgctctgtcatccaggctggagtgcaatggcacaatctcagctcactgcaacctccgcctcccgggttcaagtgatgctcatgcctcagcctcccaagtagctggaattacaggcacctgccaccacgcccagctaatttttgtatttttagtagaaatggggtttcaccaggttggccaggctggtctcgaactcctgacctcaggtgatccacctgcctcagccccccaaattgctgggattacaggcgtgaaccattgcgcctggcctcagctccctttagtttttaaagatagacttcctatcttataacagttttagatttacagagcagttgcaaagatagttcaaggagttcctgtattctctgcatccagtttcccctattattagcaccttaaaatagaatagtacattggttacaatgaacaaaccaatgttgataaagtatgtcaactgaagtccatacgtttttcatttttcctagtttttacctagtttcctttttctattccaagatcccataccatattacttatagttgttgggtctctggatcctccacagcaatttcttagacttgccttgtttccattatgaaacacttcagacataccaaaagtgtgtgtgtgtgtgtgtgtgtgtgtgtataaagaataccaatataaccagcattcagccctggaagcagaacatgaccaacatgattgaagcctcatgtatatccctcttgatctctttctccttccctcttcaaggacgaccaatatcttaaatttggtgcttttgtcccaggcatgttttgaaacgactatatgtagtgttgctttgcatattttattttatcgagacaggatctcactctgtcacccaggctggaatgcagtggtgtgatcatggctcactgcagcctctacctccccgggctcaagtgatcctcctacctcagcctcttgagtagctgggactaaaggtgcatgccaccacgcccacctaattttgaaaaaaattttctacatatgaggtttcacatgtcgaccagggtggtcttgaactcctgggttcaagtggtcctccctccttggcctcctaaagtgctggcactacagcagtgagccactgcccccagcctgctttgcacattttaaaacaatataagtattataagcattgctctacagtttgcttttttccccccacataacatgttttaatctgcattgctctaatgtatctagtttctaagtcagactctgttgtatgaatcccctctcttgttgatggatatctaggtgttttcctttctgttgctgtcatggtcattgcaaacagtgctgaacagacacctttacaagtcaccttatgcacgtgagcaagcattctacttggggagaggaattttggggtttcaaattttatccttaacaaagcagtttattcattcattcagtaaatattgattgactatgtaaaaactgagccaggttctagaggtaaacagaacagaaataatccttcatttatcatgagtttacaatctaattgggaaaatgaacattaaagaagtaattaaagatatgtatgtactatacagctgtatcataaaaataaagaacaatgtattgtgtgccatgaaaaaaatataaggcttattaagggatgtttcttaatgtttcttgtatcataaattacctaaagaatttctggacaggaaaatgctactctcctactgaatttatgtgctttctttatcgaacaatggaagcaatgtaaagcaaagtgtttcttttttgccttagctactaggagtagctctcatgtagatgctgtgcccagctgcagtgcctggaacagcccagctacatttagtatgtttatattttggctttttaaataaatggttttcatattgttctatgtcttgttttgcatgctgaatcattttgaatgtaaatgaggtatagctcttggagagaggacaagatatcattgataagtggttggtgacccccacttttcttttcagagacaaatgaccttgcttttacttggtcttgctgtatttatatagggatcttactgtatttgcatgcttgcttaatttcaatataaatttatgaaatttattatccatcaagagtcaatttgtcctctaaatatttcacttagatgatgattttttttaatcaccaccaacacatacacaaacagaactccttagcaattccatttggctgtactgctatctttaggaacatttatcttgctttaactcctctcttttttacagacatttagttttctgtgacattgtttactttcgttataccttaattatgggattctgataaccatggaggagtaggagagacaataaatggggttttgtgggtgattaaatgctaaagcaaagctgagatctttgataagcacaacagttgtttctgccagtatattccaaaggcaagactattcttgcaattacacaacaagcaaggggggagaaacacctcccacaaatcactctgatatgtttcttaaccactgtgcttttgaaagcctaatgctctttcttctgatgtttttttgactgtcagcctgagtagttggctcttccttggtacgaggctatttaaatgacaggtcctttctcagtgtgaatgtgtcagctatctaaatgagtggttgaaaatgtacctccgcatcagccatgtggaccacggcatggtctgaagaaaattatgtttgagcagctatgattgagctcaattttgcaaaagcttactgagttttaacaaataatttagccctatcaagcagaagtgcatttggctgcaggtaatagaaaactgaatcattggtggttttagcaagtaggttttctttttctcacatgacacagattggcaatactgtcagagacccagtttcttttgtgctttctgctctattttttgtagtctttcagcctttatcgttgggcttattgtctcagggttgcaaaatgactggtctgactgcagattttctaggagggaagtgcaaagtggtggtgctggccacagctttccttctttgtcaggacagcaaaagtttcatcggaactccccagtggacttgctctcttaattcaaaatggctgtaacagtgtcacgttggctgcacctgtttcaaagaaagttcagaaaattgggtatttcacagacacattaagatttcaaacaaagacgagagcattcacaaggaacagagagggaacgtatgtggatggggcaagtaactgccagtcatcagcctgttatgtactgtacacatagagttttgctgtgcagcagcaaatataaaaatgaatgtcatcaccatgaaagtggaaaaccgtatttcaatgtcatgcaaatgccataattgaaatgaaaagataggaaatgctggtgcattgtctacattaatgtatttggttgttgactttattgcataaaaagtatcagtggggacgagatagttttgctttgtttcagaagattttgcttttgtttttcccagctaagaagggaaccttaaaaataatgaggagggccgggtgcagtggctcacgcctgtaatcccagcacttttggaggccgaggcaggtggatcacttgagattaggagttcaagaccagcctggccaacatggtgaaaccccatctctactaaaaaatacaaaaaaaattagctgagtgcggtggcacgcacctgtaatcctagctacttgggaggctgagggagggagaattgcttgaacctgggaggtggaggttgcagtgagctgagattgcaccactgcactctgcactccagcctgggttacagagtgagactctgtcttaaaaaaaaaaaaagaaaagaaaaacacacagatgtatgaaatagagcttattaattctgtatatattcacagaaaacgcatacttttatgccttgattatctttaggtgatcatggggaacaggagcccaaagataattaacaactgtgctaaaacaacaaaacctcaattgggctacaaatgtcaatatcatgtacacaggtggaaaagactcttctttgatttcatatttttcttttatttccttggcatccctgttctggttatgtcttgctgtgtactctagacataggttttgtgggttgactgagctcagccgggtggttctcactggggtctcttatgccctggctcttaaatggcagctggggctcctacacatggcatctccatatggcttaggcttgtcacagtctggtggctgggttctgaggctgaagtttccaagagaccaggggggctgctgcaaagcttttaacctgagcttgcaagtcatgaagcatccactttccgttggttgtgctggacagcccagatgaaggggcaagttcccaaggacgtggatacctagaggcatggttcattagggaccaactttggagacaaacaaccacagtctccttccttctcttcccttggggattgaaagggttatcaaaagctggccagaaagagaagcaaagggtgaggataccgctgctgcagcacgtctgtagtagggaatgaacccagaatgtgaagagttgccattctagtaccctcgagtgtccttttcatgccattggaaacttgacaatagtaattgggagtgagttgaaatcttcagctttctacctttgtattgtcctttcagagcaaaaagaagtaaacattaacttaaaaaatgcttttgatattaatagttacaaacaaaaaacaaaacatgcaacaattccaagctcaaatcaaaaccaacactgagctttgaggtgcaatttctattctatgtgtgtggccatctcctcttgtgttagtggctgagcagagaatgctccattccaaaataaatagaattaattttcttaacagcatctttctttgtgccaagaacacagggttacaggaagcacatctgaatgtaccattggcaggttaaatcattctctttactttggtctttggtgggtttttatgtttgttgcttttcatctgaatgaatggcaatagagcaagttttaaaaatccttagggatctccagagattcctgtcttgctaagaaacaggaaggccgcaattagcagagaccaagaatgaagaggaggagaagggggcgggtgtctttgttgctgtaaactactagttttcaccattctgcaccttgggctgtgttgctgctgctacctggaacacccttcctccccctcctctgccgggaagactcccacttagcccagatgcagcccagctgctggcttctgcatgcagcccacctcttcttgctggacagggtggcgtcttgtcccccacacccacaattcctgtgcctatcactttgtctctgtattccttcctcagattgtagctccttagtggcagggaccagctcttagcctgatatcatcagccaagcaacgtgtaggatgcagaggtttggcaaaactttgaaagcgggaatgtatagtcaactatgtcgatgtctgggtcatttttccaatgtctggtagcaattgtgttaggtggcttatacctctcctggacccacacatagcaaattctaaaaataacaaactggaccatataagcttttccaaaagcctggggtgggggagatgttataatatcctgacatagctgtgctgttgttcatttcacctctgtcacctagagcaaccccctccatgttttccaaaaccgcccccatcctcggggtctggtttgggacccctgtcctcctggaggtcctctttgaaccctctggacccttctctcagagccctctggtaccttgatgtcacagcatttcctgtaatttcatttccctggcctcttggctaagataataggctcctgtccttgctttttctctgtcccctgaaaggggtgaagtcgtgtggacatgtggcaggtgccactattgtttatctgctgaacactagcactccccgtgccttcatgccatcaggcagggggcatttgttcttttgacggtgtggacaggggcagagtttagtggcattgttcttttttagcttaatgagcacgaactgtcagagcttggaccaaatttttcttgcagatatattttgattgacaggcacaggatttttggagataattgaaagagttgccaacatttatcaggagactgtacataaaaatacagagttccagtttccctcaaaaatttggaagttttggcaaaattgagtcccaattaccaaaaattgcttctaaccaagcagtaactattcccttcacacagaatgagcctcccttccctcatttcctgtaaaatggtactgcatgttctcctctttcatttgtgtcacctgcctcattggtgggtaagttgttctagaaaatgtctatcatatgtgctgctgtactgctaagtgcgtagagccctagtacccacagggcacacacaaacaaacctggtatacaaagaacttctgtgcggatttctttcttattgtgcacattttaaggggcatcagtctctgtccatgcatccttagaattgtatggctttttcatgatttgatttattcaacaaggatcgaacagtctgtttgtattgagtatttactatatattagttactgttctaagtataaactcattgatctcacaactctgagatgggtgcttttactatctccatcttacagatgagcagcagtttttttgttgttttttgaaatggagtctctctgtcacccaggctggagtgcagtggtgcgatctcggctccctgcaagctctgcctcctgggttcatgccattctcctgcctcagcctcccgagtagctgggactacaggtaccagcctccatgcccggctaattttttatatttttagtagagacggggtttcaccgtgttagccaggatggtctcgacctcctgacctggtgatctgcctgcctcggcctcccaaagtactgagatgacaggcatgagccaccgcaccctgcctagaagcagctttaataccaggtcacacagccaggaagtagactagctaatgtttcaccttaggcacaggtggagggagtcacacatctgtaagatttgttcccaggacaatatcattttctttaaatgtctgttttgggaggacttcaatgagctctcagatagaaacacccatttccagggagcattcttaccctagaaaaagcttgggacagttgtattcagacagctctgctgttgaccatgtaaggaactctctgccactcttcctcatagctttggcggggattatttgtctttagacttgttcctttttgtgaaagtgacagtagtgatagtcattagtagttagtagtcatggttacttttgttgagcacttacagtgccaaatgtagtaagcactttcaaactgtattactctccccgtttctacttgggaaactgagtattactgtgtgagtgatggggacttcttgaaagatcctaaacatgggaatgtcgtaatcaggttgctgtttcatggatttggttccgaaagccaagcagagagcgggtcaccagcacagtagtaagagtcaggaaaattggttgagactgttgtgtacaggggagagttgcttggggcttgaactaaagggacggtgaagagaggggtaggtttgagagagacttagaagatagtaatggcaaggcctggtaaaagacgggagtgatttccagttttacagtttggacggcagcatggataagaaagaatataaggggctgggtgtggtggctcaggcctgtaatcccagcacattgggaggcttaggtggccagatcacttgaggttaggagttcaagaccagcctggccaacatggtgaaacctcctctctcctaaattagctaggcgtggtggtgcacacctgtaatcccagctactcgggaggctgaggcaggagaatcgcttgaacctgggaggcagaggttacagtgagccaagattgcacgactgcactccagcctgggcaatagagcaagactctcaaaaacaaaaccaaaaaaaggtagaaagaaagactgtaagaaggctaagaaggcatcgtgcggacaggggagtgaagtgtcacaaactgtcagtttgatgtactctgtgactttcagttgaagatgtcacaagattacgacaaggagctcccagtgtcttcacgtagttttcccagcttactcagtaaatatttgttccctaaatgaattcatgatttccatagttactcagtaaatatttgttttctaaatgaatctatctgtaagcaactcaagtaatatcccctcctaccatttatcttaatgtttgaatttcatctccaaccacttaaatcatagtctctgggagatgggagctaggcattgacatttaaaaatgtatgttcggccaggcacagtgactcatgcctgtaatcccaatactttgggatgccaaggcaggtggattgtttgagttcaggagttcaagaccagcctgggcaacatgacaaaaccctgtctctaccaaaaatacaaacattagctgggcttagtggcatgcatctgtaatcccagctacttgggaggctgaggtgggaggatcacctgagcctgggaggatcatctgagcccaggaggttgaggctgcagtgagccgtgattatgctactgcactctaacttgggcagcagagtgagaccctgtctcaaaaacaaacaaacaaaaacctttgtgtccacagatattctaatttgtggccaggtctgacagccactgcttcagttttaatgaaacaacagatgaaacaggtctactgagatgttcttttactcatccatcaatttcatttttgagtgtctaccactgttttgagctccatgaaactcaaaagtaagcattgatgtgttcacctctgtgttcctagtaccagaactgtgcctggcacagaataggtgctcaatagatagttgtagaataaatgaatgttttatgattctgagcacttagagaatactgcgctctagtaacatacaaccatcagtgtctgtagctgtggcaggaggctttctgcttctgaggtctctctgtctggactgttgtgctattatcctctcatgtttcttcaaggcagaggggttgctgcctgggaaaggtgtacactttggagagtgaagtcagactttgctaagtgaacgcttggatacgtgttgtgcatctctgttcccaagtaccttctctgctatggactgaattgtgtatctccaaaacttgcatgttgaatctctacccccagtgtgatgttatttggaaatggggcctttggaagataatcaggcttagatgggtccacaaggctaaggccctcataggggaattactgcttttaaaagactaggacattctctgatcctttggaagtatatttcctttccatcctcttctctattacctgccttccacctgcatcattggagttggcttcttggtgttgacaaaccttacaatactcaggttgaagacaagagcagccgagaaggagcttttgtagggagtggttgtcagtgtctggtgctttaatatttccttccgttgggatttggaaaaggcagtcccacatagaaaattgttccagccgaggaacagcaagtctgtctgtcaatctctgggtatattgaagacatctctctgagtatattccaaatgtactcatcagtgacgtactgcttctccagaaggtccccttaggaagttgaaaaagattctaattcctaacacagtagctcctgctattttcctatgtatgtttttttctcgcttttatcttctgctttaccaaaatacatttacataaacaatattagtatgtgtacagaaaatatgaataaagaaataaagattaaaaaccttagaagaaatgaaaataaaaacttaagaattggaaaagaattctaaaatctcaaggttgaccaagctggagggtttttttgtgcatatttattgcagttctaccttgtgccaggttttagatactttcttttaatcacagaactttacaagatacgtattatctctattttatggattagaacatttaggctctgaaactcaagggcatgtagctgctacatggtagagtcaagattttaatttagcatgcctaactgtaaagcacctttccttggtctaaaggccagtgacagttcctaatgaaagttttcacacgtacacaatgaaacaagaaaatgaagacagtgtagaagatttttgataaagcaaaatacaattaactttaagaaacctgttcattattttaaaatacctatattggctaaagtttggcaatctaacgtcagacccctaatcattatatatatatttttttcttaaaagtctactcgttcgtgaaatcacaagttcacactcagggttcgtgatttaatggtggaacaaaacagaatatttaaagttgggaatgttccagaaaagctagatttacaagattgtcttaaggccccaaagaggaaacaaagatttggcttgctgatcagagttaaacattgtgtacaaaataccttaggaggaatttgagacctccgttatttcagacttaggaaatagccctttcttatctctcatataatggtacctgtctctcaggaagctaggcctcccttgcagtggtaatagctggcctgtggagccccttcacattgcattacggcaattccagtgcctccctttcccgttaggaatctaagcttgtactaccttttaaaatatcttcaagagtcaatatgtggatatctgagtgtcaaatctggcatgcactgtatttaagtatcacttaggaagaaaagcaaaaccctcagccccttgaaatgatttttaaattaactttttggtggaaaagtcccattttatctgtgcaacttaataccctttgtgcaattttagccaacttcttgaaaacacaggaggaaaacaacaactttcattatctcttttgctctgaatagcagcaatcatcaaaccaacatccaccaccttcttgttctcctgaacttacgtatttttgtatatgcaacaacttagggaaaaacataatggcaggaaagaaaaccttttcccctaagtaagaaaaatcacagaaaatcattagtgtgctaattaaggaacaaaaatcaaattgtgaaaggtttcttacccagattgaaatgaataggcctgggcttgttcccacagtggagacagggctcccggaagtatgctggaagcatgcaaggccacttgccgcctagactcagaaatgacacatcgtcacttccaccatgttccattgattaaagaaagccattcaggccagcccagattcaaagggtggaggaaacagaggttgcctataaaagaaggattttgaccatttttacaatttaccaaaggagtgacttggtcgaggatattaactaatttaaaggagttaatgtaggtgaagctcttagaatgcctagtgcatgacaattgttgttttgctattttttattattattactgtattctctctaggcgtttcccccaggagcttattgaacgtcctttaatcttttgttttgtttttaaaaatgatgttggaggaacaacggtgacttttcaggccctggaaatgctacatatgggatggtatcgtagaggtgtttctttgcctcccatgggcgcccccggttttgctctctccccctctaggtggcgctgtcggggatccccagctgtcccacgttgtcttgcttttcctttcctctctgtcaaaacgaattctcattcttgattcttaccactgcagtgtttaccaactttgagtgatatatttcccttttaaagaaaagcagtcttgtgaatttagttgttgttttatatttttattatgttacttaaatatgtacaaacataaagctatgtataaactaattatgcttgctcataacttttatgcatttataaaataaaggaaatgaaacttgaacagaacagatttaaaaattaaaacttcagaatttcaaaatagcagcattaacctaacatgacagatgatattatttttactaaaactacatccagacgcaaagccaccgtggcctttgatgcctcagttaccccacaccttctctgtttggactcctgcaagctcttcgaatacagtgtgctgtgaaattattatcaagttgattataaacacaaatatgagaactgaagttacctgacagtgcttggttataagatggctgtttaacttagtgctctcaaattttactgtgcaggtaactcaccagggatcttgttaaattgctcactttggtacagaggggcaggggtagggtacagaattctgtgttttaaataagctctcaggttatgcctgttggctgatctgggaatgacactttgagtacaaggatctgactatggttccatcatttgtttagattattaaacacacaaatatttaagaatcagtcgaaaacatgtttctggataggtccttggtctctagtctagtcactgcactaaaacatacaagcagttaggttgttagagcattatactagccctatgggaatcagatccagacaccaagcatgaagttgcatgtattgagtatcaggcatcagccagtaatatagggagggaatgatgattgtacaaagacctccctggacattccagatgcaactcacagatgatgactccttgaccagtgggacaggcctgatgtggttttgcctctaataaatcaaatctttccatttttacccaagtaaaattttatttgtactttccttatgatcaccactcacattttgcctggtcttacagtttaaaatgtggtacagctttctttttctatgttaatattctgagggcaaggatcatgttctattcctttttgtacttttcatacagcaggcatacagacatttgtggaattgaatgtattagctagataaatcttgagggtgccctctgctatttgcataaccaagtttttttctgaaaattccaggaattttgctctttctgttatatttcagactcgttattttatttactactgctgcttttttttcttcctaggaaagattcctaagatttaaatgactaaagcttagtctctgatatttgaacataaaccacatttttattgctcttggctctcaggtgcgctttgcttttaatttttatctgagaataaatgttgagaagattagaaacgcttatttagttgataatctgtgtgaccagaatttatcctttctaaatagttccatagcagtcttcgagagagaagttctggtagaagaggaggtagagtgagttgttctttaaaaaggaaatgcaagtttgtagagagatacccaggtgtgggctttatgcatgaaatatttttcctatgagaaaaaggaaaacagtgcctgaccttatcaataaaccattgtaagacgtcttcagcgtaggtcccaaggacattccaactgttcttttggactgagaaactctcaggtagtggttgggagaaaaagatccagaggtcgcagtgggatatttaacaaacatatgaatcagctgtatagcacatcagagaacagagagaccagacataaatgcataataaggcaatattctcatgatattgataagaactttttttctaagttctgttgatctgtctttctacccattcaatcattaatttaacattgtattgagaaattaaacacagactcaaactacacaaaataagcatagtttaatgcaaagattcccaaaatatggtctccagatcagcattgccttggaagttgtgaaaaaagcaaatgtttgcactccagtggagatttactaaatcagaaactatggaggtggggtgtttattttaacaggctcttccgaagcttcccatgcatgcttgagtttgagaaccagtggcttagcatgaactagtatgaggtggacactttgaaaccagcacctagctaaagaaatagacctgccagtcacttcagaagcccctccatgtgtcccttcccagccataattcctttctccttccaaattacccactctcttgagttttccagtaattactcccttgcctttttatagttgtgtcactgaattgcatatccctagccgcaatcatttagtcttttccatggatattaacttatctttcagtctatgcattcccccattgtcccctccttttccatacagtgtatctgatgaagaacttggactgttagacctgttggaggttctcagagtggattttgctggttgtgtactcatggtgcagtgtaacatgttcctctgaacttcctgagtatcagcagctggatataggggtttcatcaaatcttagtcctgtccttttgctaagactataggtgggactgcgttttttgtttttttcttttctttttttcatcaggaggcgcaggaagtctagttctcactgtattttgatgttaacagccatagatactcaatacttagatcgattgagagaagcataatggtgacagtctgtcatttcattttcatttattagctggaaagtcttagatggaataaatttagatcactatatggctaccttgtggtagatttcacacttgaaaagccggttgaatgctcagttttccttttatttacctaattttcaagatactgaattgcttccctgtcatgttcagaaggggaccaattaaagaaaaaaacaaaaaaaaaacatgaactactaggtttaaacgtagtggaagagtaatcaaaccgtagcaaatcatccctattgaagctcaaattgtcccatttttggccagtgggagcctcttcaacttggctcttgattccttttggtataactctagcactatttgattccttccttttttattacaggctcatcttgtgtatttcctgccccagaccaagagtcagccatttctctgagaatgcaccctgctcccccagttctttttgataggaaaaaaatgtcaaaaccacaaaccagattctcataactactgacttgattcttttttactgagtcttttcaatgggcaaaactgggaaatatccacttctatatctatatagctttttctatacctatacatagatgttatatgtatttaaatatatttaaagttaaaatacctcatgagtttatactgatatttccaattcaggactacagggttttaacgtcttctgtatggcatctatatcttctttttcctgcccaaacaatcttgattctcaaggacatagagtatgctagattagaatatgtcataattactcatttgcatgcttccacattacacacacaatattaatactaccaccaccaattatgattactaaaaagaattaaaacatttttgtgcatatgctattctcattttcctctattattttatagttatacctaatctgtttttatcaggtaatagttattaatgctatactctcttccatttaacccccatttaatgttcttagtttcatatatttgatggtcatcaccattttcacgtcaatgacatgacacttggttgtccaaagctcattctgtagtagtcgccttaggaagaagttatgggaacagaataccttgtgttcttacatgttgaaagaatgttttctctacttaatgttcatttttgcttggatataaaatccttggcttatattttctttcattgagtaccctagatacattagatcatatccttctggcataaaaccctgtcaaattctagtgataatccagtttttattttttcttacaagtcacattctctttttgcaagaagcccatagagattttttttctttaaagtcttgtcattttactagcatatgtcttgatgctgatagttatgggttgttattctcacataagtagtttctttttttgtatcttaggacagtttttcttgatttatagtttttaaaatttgttatgttttcttgttttactgtttctgccttctttagagactcctgttgtccttatgttgcatcttacttgtctgtcttcaaaatttatcaattcttgaaggcttcttatctttcttaagttcttttgatttttttaaaaaaatttaatttcccccttctacttttgaagttatttggttttattattcactcttaagtttcttctagttaagcctttttaagaacatttctaattcttttctaagctctgtcaccttatttctgaactttttctagttccaatttatattgttccttcatgtctagcgtgttttcttagtgtcttttggcaaatctggaaattgtatgttagaattgtgatctgattttggagccagttttcttggtgtgctttcattatctgtggaaatgttgttttattcgttttcctcttttatccttaagcaataatgtgtggaattttctctccatgcttttctgttgctcattttcctcacgttttagaaagagactttgttcagatggatttttctaacttcatagagctctgtcttctattgtttttatgtaattttttttaaaaaacttgctttgtaaatttttatgttgttttttccttttccactgttacctgaatcttctctttttttttctttctgttttgctcaattttatttttttcccagcagcttctctccagtgtggtaccttgttttgagagcaggtgctggctaattgtgtaacaatttgtgatttatccttacctatttgtatcttgatgtttgtgaggataccttgtctcccagttttgttgtaaatgtccattaatttttgaacattctgtttgatttcattgctctgtctttcgacatgtagggattctaggagttccaaaaactgtgtcactgctaccactgccatctcctcaggaattcctcagtttttcaaatgatgatttttgaaattttagagtctataacttgagagatatagcatttttggagctgggacaaaaaagtttttaacttaattatgggaagtaatgaaaagaattggcttctaaaatgcaatgcagagatgcataaatgtattctctttatcttgcccaattacagagcaaaatagatgacaatacagaaataaacatggtctggagtagaagtaggttaatccgcatgctttagattgacttacagtatatacactttatttcttcattcagtgaataaatttatatagtgccttacaatggacagatactgtacaacataaaaaatatgttgacccttgcctgtctggcctaccttgaaatgctgtgtataacaaaattacacacagaagacctcagatgtggcaaagtgaagtgagagggaagtgactttcccaataccacacagtactttgagaattagaccacaagcctggatatctgtaactcccaatccaagacttcttccaccccaatattcaatctcattactaagtgtcaagaaagtggatttgttaccaccaaaaaaagaaaactttctgacattgagtgtgtgctgttttttgaagaatgttgtgaattctctgttcttaaaaagtcagtagtgcagctttcaatgtagagttcttttgttcaggcttacacaactatcaccattcaccagataacttgctgtattccagacatcattggctgctttgtatacatattcttatttaaccctcaccacctggcaaagcattgtcctcatctctagtttacagaggaagagacttattttaactcagagtatgttgtccaaaattaccctgctaatagactggtgattctgtggaaacagacactttcttcttttatatgtaaagtgttctgggtaacaaataatacactctcttctcatcactgtgggcaccatggtctgggtgcctcattggcctctctatcccctcccaacacatacacagaagagaggagaggagagaagcatcctaaatgcttgactctctcggcagaaagtctactgtgtctaatggtcttgtaggagggaggcagcgacatctctctccctgccttcttcctttccattcccctctctactaaattagctccctgagcatcagagtgtaaatccagtttctcttacttgtgcaaacatggacattcttatgccactttgtgtgtaaaatttttacatgaagtctataacctgttgctttggtatgtaaggctgtagaatgagcaataacgaaaaccagaaatgtttgggggaaagaagtttttgtctgatcttctatattcattgacccagacaagtgtcacaaggaccatgagagtctggggagcctgggacattgcccacactctgctaatgaagaaactgaaccacacctacatctttgtctagtcacacctagcagcctctgaccttgctctccttgcctcactctgatccctctagaatccattgcacataccaaccaactcaggccctaaaactcttcttttgtgaggttactttccagtctttaacctattggctttttctcattgttcctcaaatcaaatctgaactccactgtctgcaagactctcccgttcttttcctgaccaccttggctgacagctcttggagaagagggcttagattgataataatctgtgatcctttccttccaccttgcctagctctgccagttcatggagtaacattttcttttccacagttactgtaaaaagaaatcgattctttttagctaaagtaaatgacatccaactctccttacatggaaaaaaggcactaaagtgctgacagataccatctcaggaatggatggatattcttgctgtttctcttccaggacaatcagaaacaaatttaactggtgaatggccattccatgtggaagggaagtggtaacatagggcactagattaacctagtgcacttctcagtaggattcatggtatttctatgtaatttccacttacaaattacacatctaatagaatcttaaatgggaagacaaggatgagtcatatgcccaatccacatttatgtcttcaaaatacgctttgaacaacaaagccacatatacatgttaaaaggcctagtaaacttctagaacactagaaaatcctgattgccaggatctgttagtcactccactccagacagggttttgacaaaatgccttttcccaacagaggttaccatcttcacaagaagaccacatttgtatatatgtggccagcagcattcgccagggtacgtacctcaaggaagcttcaaatggccattcagtgcgcactcaaaagggatcctcagaggagcattcagaccatttgcttaaatgattgtgtgctcattaaggtgggcagatctgcagtctcaactagagatctggtagttaatctgggtccaggatgtttcttaactaaacatgttaaaggagccggataggttgctctctactgccaatttatcggttttacttttctccttggctacagtgcaatttggctctttggtttaatccccttgagaagccagaatccattggcatgcggagctctgggtcttagagcaatatggctctaaaatgtacgaggtttattctgatggtccctgtcacattagcagatggtggcatttaccatgttgatgggagaggagtccttgtgctctcagccacagatggcccgggaggctgtcccagcagcagcacctcaccctctccaacacatgccatgtagttagttgttccctctctttgttcctataccacttacgtttgcatttctttcatgcagttcgttggtggtggttatagtcatctgttttgatgcgtgctccccatattaggctgctaaggttttaggggcaggtacctggcttctcctccagggattaagagatgcaacgctatgctcaaggtcacaaaggtgctgagtggcagcagggtaggattctaagcctcattcatcagtctccaaagttcaggcttttaattagaaggcctgtcatatcatagaaatcacaatggtcctcttagggcaaaataatgggtgtgaaatcgtggatggtccaacgataattacaataagaatcgtttatttgtttcttagaaactgaactaatcattttacaggcatcatttcagttagtcctcctaatagtcctatgcatgaggaatgtcatcaccattttcagatgagaaaattgagtgtcatagaggctaaatgacttgccaaccaggtcacacagctagtaagtagctccaagtctaacccagattgatgtgattccaaaaccctggtcttgggcatctgactgagaccccccaatgtatgggtgccttgctttatctaggctcagatcctggaggtcatttgttgttaccttgaatataagaaacacacagggggacaggcagactctgaaaatataaagttcattcccctgaatcaaatgcagaaaacagttctcttatgggttgtcccacttttcatttgaacttagtggggaccacgggaggggctgttgaaaatgaccagctctttcctctgccaggcttcctacacttacacacacacacacgcatgcacgcatgcatgcacacacatgcacacacacaccccacttcatgcttagacagtgataaagtgagtagctggggcaagccccccgacatgtggatgactatggtggtggtgatggtaggaatggtgccttatattagtgtaccttgtacgtttacacatatttatttgatctacctcaaggtaggtgaccaagtattatcagtccctttttcctcatgtaggaagaaactgagtgtcagagtaattgagatggagcagattcagactcaggactcctgtttcctgatggagtgcactttctgctaaagtaatagctttcaaactgtggtgggttgaggagccccagaagccatcataataagtgagggccaggggactcaaagacctacatcctgcttcaactggagcatctctgcttttatttgacgggtatagagggttctgcatgtggttttattttatagaagggtctgatgttctaacagtttgctactgctatgtaacaaaccactaccaaaagttagttaattattattgcccatgcctgtgtggcttggcagggctctgccagactgctctgctgcaggtggtggctgtggggcagctgggatggctctgttcctcaggcctgtcactctccttggacgggggatagatggtgcatgtcctgcacatctttcaggcttagacttggaactggtatactgtcacttccaaagcaagtcgcatggctgtgcccaaagtcaaggggtagggaagaacattgctcataatgaggctatggcaagggaatggacgcagagaggggtgaagaactggggacaataatgcaatctgcaagtccatgaaaaaattgtattatcactgctctgtttaaattaggctattaaagtccttcaagacttatttatccataaaatcaagaggaaatggctgttgtattgtaaaagacaaaggacttctacccagagataatcaggtctgaggactgttgcttctgaatggctgccagtttggattgtggtcagtgttctcatcttttcacagctttactcaggtagggtggatgtataagtgtgtgtgtcagacagagagagaggtgcaaaatagaagcacgcctctgtctatcagccttgtcagcttcgatccttgtttagtctgtgctttatcttctcccgtctgtcaatgatgtcccccaccatttactgcaggcgggtctatagatccagtctctcccctgccagtctctctttgtttgttgccctggtgtcactgcacctctgagctctaagtctttaccttctgaaagccattcctaggacaatcattaaaacctatggtagttgataatttctgaccctaggctggctaatttgccttcataaactgtcagattctgctaaggtcattgaatgctgtcatcttcataatgtggttcaagcaaaatggataagagaccaaacaaggagaaatctccctagaacacagtatgccagcattgctgtatctcaacaattaaaaaatggtgcgggagttacccagtagaatatttagtgaggtgtactctatgtggagttcataaatacaaatgcaaaatatttaatgcacagaatcagagttgcaaaataagatttaattctagaggattagggagacagaactgacttaaggctgtttttcccagtaagcttaattacttggatgacaatcattaaacattgcaagtcacctatcccaagtgatcgaagggcttttcaccaaatgtctgagtgagaaagtgattatcttatagaacaaacaagtatgataaagggaaacaatcagacaagtaattatgataaagaaaaacaagaaaaacggcacatccagcctgttttgtgggaagaatcacagaggcactatgtaagtacggctcctttatctaacagatcatttactaactatctggagtcaaagtcaagtttatctacatgctgaaatctatttccttctaataagattccatccacttggatctcagttatgtggcaatcttgacatggaacgtgtctcggaatatggaagggcatgagaaggcaccaaatcttcaaccctagcgctcgctcagggtttgattagagaagcagaatcacaggattattttacaggatttcttctctggatttgacttacgcagctgtgggctctaattaagcagacaatggaaagttgctgtgtctctctctgatgctgggacctgaggccagcagggtaggcagttgggaagggaaaatggacacgaagctggggaagcaaagacaaattagaacccatggggataagctggaatccatcaagatggactgaaacccacattggtctcttgctgcctttcaaggaacttccatgatggaggcgacttccaggagaagccgactgcccttctccatggaactcagcctgcatctgcccaggagtcagaggaggtgagggaggagatctgggaagggctggacaggcccatctgcttcctgccccctcagcctgctggtgagccagcagataacccacaaaagcctcaacagcccctggccccccatcaactttcaaaggcaccaatgcaaaagactatagctactgcttcagttccttcttccaaatgtcatatgaaatgcctcttaggggtctatactaacccagaactgtgcaggagagagaaatctgggaaacacagttccagcttagctaggttgacttgctataagtcaaccacacctagtctcactaagcccatttgtcatgtgtggcccactcagactgaaagaatctttgttggttcactgttttataagggccagcctttaccagtttgtccagctagggcactaagttcttagatgcagacatcagttctgtattccctgttaaggatctgcttccttaataggaatctttaaactcctgaatttgtaatgacacattcaaaagcattatttgagactaagcagtaatagtgtatggcaagctggacttacagtcctgtgtgatgtagagatacctaaacataaatgggcatggatattgtacacacatatgtgatgcaaataatatacaaatattgacataggatgatctagagttgataccagacagtcctcatcagtgcactgatgaaaccccagaagaaaagaggtttagccagcaagttaacccatgctgatgagcatctaccatgtggcaggtagcttctagaggtgcaggggatacaacagttaatggtacagtgtcagccgtgaggctcttacattgttttccaggttttctcaaccatgacatcattggcattttctgttgggtaattctctgttgtatgcatctgtcctgggcattttaggatgtttaacagtgttcctggcctttgcctactagatgctggtattcctccctctcttcatccccatccccgctgcagttgagatcataaaaaatgtcattaatcattgccaagtgtcacatggggcaaaatcatcctcagttgagaacctgtgtttcagaagagacagaaaaataccactgagatactttcagatgctaataggtgctcttaagaatataaagtaggctgggtgcagtggctcatgcctgtaaccctagcactttgggaggccgaggcaggcagatcacttgaggttaggagttcgaaaccagcctggccatcatggtgaaaccctgtctctactaaaaatacaaaaattaaccaggcttcatggtgggcacctgtcatcccagctacttgggaggctgaggcaggagaatcacttgaacctgggaggcggaggttgcagtgagctgagatcatgccactacactccagcctgggtgataaagcgagactccatctcaaaaaaaaaaaaaaaaaaaaaaaagagagtttaaagtagagtgatatggttacatgactaccaaggtggttgaggaagcccttgccgaggaagggcctttgatttgacatgcaggcagcccctcagagatctggggacaaaatgcatcaagcaaaatgaagagccagtgcccaggtcctggaggggaacaaatgtggcatgttgaaatagcaaaaaggctgggagacttgcagcatgggtgatatggtttgggtgtttgtcccctccaaatctcatattgaaatgtgattcccaacgttggaggtgggggctggtgggaggtgtttggatcatgagaggagatccctcatgaatgtcttggtgtcctccctgaggtcatgagttcacacagcatctggttgtttaaaagacctgggatctcccgttctctctcttgctccagctctccccatgtgatgcattggctcccccccacccttcacctttcaccatgattgtagcttcctgaggcctcaacagaagcagatattggcaccgtgctttgtgtacagcctgcagaactgtgagccaattaaacctcttttctttatagatgacccggtctcaggaattcctttataacaatgcaaaaggactaacacagcaggtgaggaagggaagagaggagggcatggggtagggaaggacagccacaacatgggggaccttgtgcatgggtcatggtgcacgatctacatttaactctggctactcagggcagtcatgggagagatgtgatcggggagtgatgcaatctgatttatgccttaaaaggaccacgctggctactatgtggtggatgcacaaacagctcttccccttctgcctcctttgccttgtgacccacaaggacccatgatacccacctgcagctggctgttgccatctattcggagttgtcaactaataacagacaatctcctctgccctgtgacccacagggacccatgatactcacctgcagctagctctttccatctatccaaagttatcaactaatagtagtctctgtgcctacaaatgattaaaattgggcttgaaaatatggcaccattatcatcagcatttcttgagcgctggccacttgtttctggtgctcgtgtgtgtacatgaacatccttgctgtgagtgctgggccccaccctcactgccatttaaaaaaaaaaacaacaaaaaacaggtgtctgcagcctctggtgaacatcagcttctccgtaaggctataatgggagacaccttcatagattttgagttcggctaaaataccctcctgtccagttactacctataatgctcttttcccttggatcagaaagccttttctctgtggattatttccctccatctataccccacattactaccccatgccttcataaggttttactctttactggcgttatgtccatttatatttgaattacacaagcatgaccattcatgctctttactcatagaagggcaccctgcccttcctggaaaaatgatttactttcatattggataccatttgaatatacccagctgtctgcgtggaaatagagaagtagacagaaagaagcctcctgctacagcctaggagcagaacagtaaacccaggtttccaaaatatctttctgaggtcattacagggtcatagccctggacagcactattcctaagtcatcctgaggcattctttgtgtgacaggcccaatggcatggcaatggatttcataatgaaaataatgaaacattgagataaaaagttaatttcttcctggaagagtctatttaataatgcaggaaaatgttacactttttagttatacttaattataaaatgctagaaaaataggagtggttttggtgttgaaagagttatttatctgagagaactatgaattatccagaatgcttctctaaagtttcctttttcccaaaattttattatttggcataatttcagtggaatcttccaaaagacattagtccattcttttgcttcagtgcatgtttttttggatagatattatctatttttgtgtagtgttgtaaggtttccaggatacgtaaaagttggaggatatatggttggtgcaaaataattccgtagagtaatgagattgaattgggggaggtggtttaaggaatacaaattcagtttgcctaaatagatgtaaaaaggaagggaaggaataacatctgaagctaaggaaggaaacttttgggctggagcatgactagataggagtcgggtagagctttttaacacagttgaagatagctgtggacgtagatcatgggcaaaactggtaatgtgaggatttaggaagcacgtttttaagctactgttgagtttcataggaaaccataccccactggtcataagagacattcaccaatagttttccatgggccttttgtgctagtggtagttttgttgggggcaggatttacaaaaatgaccatgcatttgaaaggtcaatgatgaaggtaagtttgagaatgaattttccatgaatgtcctgcaagttttattctttctgtgaacagcttgaattttcatttggtttgaagattaggaaaataacagtcatatatactcacagatcaaattcaagtactgattttagccatctatgagcaaaggccattcttggtgttagacatgaaacaaacgagagagaaagaaggaaagagagagagaaagatgtgatggactgccttggttctcataatttagaagtgagactataggtatatgcacaaggagctctgatgtgaaacatggatatcatatatgtcctaatggaaatgcacaaatatcctaatgggcttaggaagatttctagaaggatagggattccaatctggtttaaaagaaaagcctgaaaccttggcaaatgaagtcagcaaggatattccggtagcagaatgagcctgggcaaaggtgaggagtggagtgttgcctattttgttttgtgaggatgatagattcctgtaactggagctgcggaggaagtagatgtattggagattgtccttgaaagtatccagactgactcagacagcaattgtgaagttcttgctgatagatttgtactgtattttccatgcaatgcaagatccattagagggatttgagtaggagattgtcatggaatatttagaggatataattcagatttaaaccatggaatattttccttgatactattaaggaatgatagattctttgagctaaaaggagcactagagattatctattgaggtagtttccaaatattgttttagcacagtggaaaccttctttcaaatgacatcttacacaaatgccccagctacaaaacagatagaagagcagttcttgtggaatcatgatgggaagagtcttgatttgctgctttctgtttcttcattcctgtagcaatccctgaggtacctctgtagaaagcacaaaatcatggaacaacctgccgttttaaagatgagtaactcaaaagaaatgaaaacatattatgaaaccacacataccataacatcaccagcagccttattcataataactgaaaagcaggataccacccaaatgtttaacaggagaacggataaactgcgttgtgttcatacagtggaatagttctcagatgtgcaaagaacaacttactgattcatgcaatggcatacatgaatctcagaaatattaagtaaaagaagcatgacccttggatttcatttatatgatacacaagaacatgtaaaacgaatctagggggaaagaaattaggaagtgatggcctgggtggcagggaggagaactgattcaaaaggagcacaagagaactttctgggatgttggaaatcttctctatcttattttgcgggatggttacatttgtgtattccgttgtcaaaactcatcacgtggaacacctaaggtgtgtattttattgtatgttaattgtatcttaatgaataaaagttgagtttgaagattcttggagggagatttgctcagttcccatagctaggcatgagaaagactagcagctagaacttaggtttacaggattcctggtccagctcttttaaccgcatctctctccctcagagtcatcctcctcttcaccaacacagcatcaaggctggcttctccctccctggacatcctcttccctgctcaaaccccaccgtggctgtgaagtattaacttgacgacactgtgctctttgactcagcttttaaactttcctccagtgaaaccagaactggcaaacacagctacacttttcttgtaccatgctttacctgtattgccaacctgctgataaatggctccattccatagccttgagggtcttgaatagcttaaacattttatagttccatgggaatgagacaggggagaagacaccagtggcttccattgtaggcctgtctacactgaaggaatgccaactgcccacacacacttgttgttagatggcctggaggctcatctgcacagacgtgcagtttaactccattagggatcacagagtgatcacacactgtgctgtgctctttggtatatatatgaaaagcatcgctaagagaatgggagaggtggtgagagtttattgctgccttctttctcatggaagcattggacagcagggcagccctagtgaattgttgactgctccataagaatatcttgctcatttaacctcttctgtactaggtcttctgcctggagagtcctgggctacactgcccatccccagtatcccatgtattcatgtcagattcttgcagtctcctgaggatctttcaaggactggaactgcatcttcaccatctttgtgttcccagtgtctgcaacggtgccttattctagaaaagaacatcttaactgggagctgttttgccaggaccatcatcaaaaatgtctgaagatgtttttggttgtcaaaactggggacagggtgctactggcatctggtggataggggccagggatattgcttatcttcctacagtgtacaagacagttccccataacaaaaaattaccccacccaaaatgtcagtagtgccaagatcgagaagcccttctctagattatactttattgtatagaagataatagatcaaccacatcctcaaggctgggaccaatgctttgcattatgatgggtgtcttggtttcttttatttccactcttgattctctaagcatcatattcaagctctgagatgaggtgtatctgactgggtcaggtagccactgagcaaactggaataggcctttctgcagagtttgaacccaagtcaatgttgcctcgactcaagctcagatacctcatctaatcatcagtagccatagtaatagtagcccttagcacagaccactgatatctactgcttagaaggggtttgtgggggtagaaaatgaggttatattaagtttacttgcccaaagtcacacagccagtatgttttggagccagattcaaacccaggttgtctgaaggctccaaaagtcatcatttatcactgtatattttcttcttagctttcttgcatttcctttaatgttcccatctctccctagtgaaactgatttccctcaccaggaggttctctaggaattttggtccagggcttagattcttaaataagagcagggacatcaccatgtttgttatacgctgtcatttcacctcctctgttctgaatcagaatgaggccagcactctgggttctaagttatcgttttttttttttttttccattctatatactccctaagaatcttttttatgcttaaggtacaagtttaaatatggaaaaaaaaatctagattgaaatgaaaagccagacatttcctagttatatcactaattaactgtgttactagtgataagctgcttataaatctttcatcattaagataagattaccttctagatcttaacatttatgatcacagggataagttttttgttttgttttgtttgagacagagtctcactctaccacccaggctggagtgcagtgtcacaatctcagctcacttcaacctctgcctcctgggtttgagcgattctcatgcctcagcctcccaggtagctgggattataggtatgcaccaccacacctggctaattttgtattttttagtagagacacggttttgccatgctggccaggctggtctcgaattcctcctgcatcacctcccaaagtgctgggattacaggtgtgagtcacagtgtccagccaggatagttcctttttattgtaacatatccattttttcttcatttatacctccagtatccaacaagttaggatgcaggaattaagaaagaatcgtcctaaagtaggaaaggcaagatttgatgaagttggtagaaatcaagaagcacagttttgtaagctttgcttgggtgtggattgggaagctatttcttatttctccaagagtgtttagcttctcagacaatttctgcctcagtttccccatattttaatggggggaccaaacacagcatggtcatgcatgacatgtgaccgtaatgaaagtgtgactagcacattggaaacctggtgtggcagaaatcacacttagaatcaggtcaattaggagtcaccttagttttcttattgaaaattatgtgtaatgctgaaaaattaataagagagttccttaaaataacagactgaatttcgaagtttaggtgataattattttccgaagtctgacctgcccaagaccttatataagcacgttatggaaagcaagagtggtatatctttactaataaataagtatttctccaaactttgaaaaacattctgaagcttcaggttaaaaatatgtaaatggaaatgccctccacttgactgtatcacagctgttccctgtccctcatttgctgaaggactgagtacaccccaaactggtcagagcatgatgactttcagtaatgacctaaatgaccttaaaatatcagtaagtgacagagtattcgaagtcacagtctataacattcgcttagaatttccccttaagctgctggctgaagcactaattaagatctgaaatggaaggtaggtgacagatgctttgtgtcctgcagcagaggcacagaatgctgttctttcacttactgtttaataataataataacagccatttaatctgtttgctgatacagtctcctttgctttattatgttgtttattttgtgtgagctttcgatattagttataaaaatgtcactgtgtctgcagctgcatttttcattttagaaactcccagagatctcatcaatttaacctgccttgtacagttcgcaggaaaccactacaggcaaagataggcttaatcaaggttttttcttaataacgaacacaatacacaggaaagcagggcaacgaatgagcctttgattctaggtaaagacttattatgtgaaaatctatatttaaattaggggctttttgctaggattcttaactgcacaagacaaattactgtaggatgtctctaaacagcaagtgtgtcttaggcatttgaaatataatttaatctattaacagtttaccctagattttaagccattcattgttggcgaacacaatctagattctttaaaataaaaatagaaaagcatttgcagtaactggccattattatagctatagaaatcaaaggtatttcttgtataaattttgaattatatattgtttatctctccttaataactttcactatagaaagagctctctttcttgctcaatttacataaaagtatctggaacagttcagtgacaacagtgttggaaattaaggactgacttgagactgaagctccctccataactcccatgcccttctccagtactaagtagtataaaggccaaaagtcagataaacaacataagagaaggtggcagtgctagagatggggatgaggctgtttcatataatggaaggacaccagttgacattttccaaagattttccattataatcttttgcaaaggttctctttcactagttaacaaatataaaagatgccaactcccaccagactccagatgcttgtaatagaattagaaggccctccaacctttctttccaggggtcctgagggggacgtctttgttggcaccccaagcctgagtcactcctagcacctcaggaaagcatgtgttgtgtggcttcaaggataggcatcctaggagattttaccacctatccaggtgccctggctgggtgaaaactgtgcatcttatgcttcctcaatagtgctgtgagaatgctccactgccagtttgaggtatcaggtttgggttttcaggattgcaagactgctgtgctgtgcgtgtactggtgagttggctccctgcctttcccagcacccccatgcctccttcttcacatcccctttcaagtagaatagggaactgataacccaaccaggccccttattcccatcagatagcaagctaatcactgagacaacaagctttgcagtagagaaaagattttattcaccaggcagccaagcaaggagacaggagaatagatctcaaatctgcctcctcaaagatgaggtttaggaatatttatggaataaagaagcagtgtggtctattgtggggggaaaggtgattggaggtgggggaaaggtgattggaggtaagaaaaagggaggtaattggtgatctgcacagacatagtcaaaattcatggctcttcataggatgtatgttcatgaaatggcattgttagcatgatctgagggtggagtttttgtcctctgatgtcaaaagtcaaccaacagacattcatacaggcctagttgatgggttggtggtctcagccagtttgaactgggtaagaactgacctcaagttcctataaaacaatgtaagcaactgttaccatgatgacctatacattagagatgttacctatgaggaagctagtgagagtttagatacttttaggtatataggttttaagatcaactagaagtaagcaactaaaagcaagtgaggcaggttaagtttgtcaggcctaatcaggttagccctcgctttcagagtcatctgcccaagtacagtaaacagatccagctactacttagatactttgagaagtttagggttgggctctttcttcttagctttccccttcatagaggaaagtccacatttacttcacatgctaacttgtttgctgttagtagaaatctgcgggaagtttgccagagaagggtagcctttggggattggccaaccagctagcagggacctctgctgtgagtggcccatgctgtctgggcagctctgttaggtaaaggagaaagccatttggcttgtgtagactgcagctctgcaggaacctctccccaccatctctagccaccacctccagagtacagtaaattgtagacttagatttgctgtttccagcatagatgtcttacactttctagagggttccctctgctcacatagagccgttggttaagtggtggtgctcattttccatgccctgctggctagtccttggacattgtgagcatttttgtctccaatgccactgaattccttaaggccttttgggtgggtgctaaatatttaggcaactcttactaagaaaatagaaaacacttgagttctctgttttgcatgtggctatctttacatcagagccttggaagtggtcaactgtatgtagccaatttcatgaggctgttttaactgggaggacattgtcacctggctgggcttatacagctgagtcaataaggaaaacgcagcttttgttggcttgcttaccttttaaatcagtaagtaatgcacaaaatgggtccctcaccaccactacttcctttaaacctcatccccaactccacatcccatcatcatctctcatctcatctcgcagctttagctgatcccatggtggggaactggggaggcatgaggttgggggtatatgtgtgtatcatatattacttgggagaaaaaaaattgttttaggttttattacaaagcacccaagttaaaagagcagtgttaaaattgtcttatcaaaatatcccgtaccattgcattttcctgtttaaagagactgccataaactctaggggctacccaagtgaggagacgagattatgattaacaatcaaagtgatggggaaagttataaaaataggaaaaaaatatttagatataaagtcactgacctatgaaaccaccttgcaaatggtaggcaaaagaagtagtattactgaaaaagtatgaattgttacctttactctgaaattagtatgtaaaggagcactttgtttactgcactaaatctttgtctccagtttttaaattatgagatttatattgcctaagtatagactgaatacattttaatatttaattgttttttctcaaactatggtttgaaaaacaagataattcttaagctgggtttcattactttgaaaactaacagtgttttctaagagaacacgttactgatttaaaaatgtaaagtaataaaaatagtattcacataaagtttcagtagagttttagcacagaacacaattaaccagggcttaaaaaaaaccatttaattttgaggcaattgtagttatttcttgcagttgcaagaaataacacagagttctagcgttagcatttaccctgttccctcaatggtactatcttgtaaagctatagtacaatatcccaaccagaatattgacattttatagttaagatacaggacagttccattaacacaaagatcctctgttacccctttataactacaacccctcattcccatccctgacccctggcaactcctaatttgttctctgtttctataacttatcacttaaagaatgccacataaatgggatcatataatatgtaacctttgagatttttttttccctcagcataattgcccaagattcatccaagttgttgcacgtatcaagggcttgttcctttttattactgagtagcgttctgtggtatggatagaccacagtttaaacatttgaatgacatctgtgctgtttccaaatttttgcttattataaaaaagcaagcaggacttttaaaaaacacacttatagaaatgcttatggctgtgtcttattacagaatatttataaggagagtaagattaaagagttagagtcacttaggattaaaacaaatgttataaactatgacagtccagctcaaagtagcttgatttcataaatatattctctttatggtatttcataaatgccataaatcaaagtagcttgatttcataaatgtattctcttttgattaaataatcaaacttaagtaaattattggccagtgtccacaatagaatttgtaaatagttacattgtgttcatgtttgcatttctgttctcaacctgaatgactgctcaatatagtacactatattcacttttattaagcactgctctcacatctcattgtgtttgttgaacctggaaatgtgatagcatttgattgtgttgattttttttttttagctgccaagacgaattgttagatgtttttaaaacattatatacccttatgcccttggtgtctctgatgaagcagattcattaaataaacactcacttatgaatagcagagccagcacagtcatagtggatgaagtttataggttattgacggacggtaggaaatcagttgaaagatgcccggaaacatgtggttatgttggtaggaagtagaaaacgcctgcctggagtccttcagatcccacaacgtatgcgtgtgcatcttctcaggctccgtattagccctggtacgcacagagacacacagcgaccagcctattagttgcctggcagatgccgtcagtactggtcattttgtgaatgcttttaatatgattcacagaatgtctgtagtcagtcacgttttagcactgacagtaaaatgtcacctcttcagcagttttcttttaaaaaaggtgtaaagcctcttaaaaatttttgctttaaactcctatcgatcgtttagaaatcttattagcttgctttgggctttcttttagagttggagaaattaaaatttagagaccaggttgggctgagaaaactgcgtggagaaggggaacttgagttgaatcttacttacaccagacagtagggacactaaagaaggcaatactgctggaagataaaagttgacagctttatgaaagaaggaaacaagtgaatgagataattcggctgagagctcccggaaagcaagaattctttttcatctgtgccctcagtccctagttggagtacagcccaaagtaaggttcaataaatatttgtttaatgaataaacaaatggatgaacaaactgaaataagtgttgatatttgttatgaaatatgcctttctcagactgttccacacacctcaccctggctgtgccaagtttctatggctgcacaacaaactactccaacacttagtggcttataacagcagatggaggttcacaggcttccactggacagttctccttgacatctgttctgcagtcagaaggcaactggaactgaggtttccggtggctccgcttgactacagggatgttgggctgtctccttctcagggcctctgctctttgtgtggcttttccagcagagccgctgaacttctaacatagtgtggctcagggcttccaaaaagcacaaagggagaagcttccaggcctcccaaaggctaagacctggaactgtcactgtgttgctccctcttttagttaagcagacaagggggccagaccagattcaaagggagggaaaagaaaccccacctcatgatgaggcaccactgttttcccatcgataactggtatcaacccagcatcctacagctcaattcagttctgacactcaccatcccgacttagtacagaccctacaggttaagggctcagtccccttagactgcccccacttcagatgccagctgaaagtggaatatgcccaagttacccacacttcttcctggctgactacaaatgtgggggttgggagaacccccaggtttggcaattcactagaatgactcacagaactaaggaaagtgctatacttacaattacagtttattataaatgatacaattgaacaaccagctgagaatttatgtagggtgagggccagaagggtcttgagtgcaggaacttctgtccccatgaatgggacatatcactgtcctggtacatcatattttcaccaaccagaaagttcctgaaccccattgttcaagagtgaacaatgcaggcttcattgcacaggcatgattgaggaaataattggccattgatggttaactcaatctccagtccctgtcatttccccagaggtcagggacaaggttgaaagttcctctaattatgtatccatgtggctggcaccttcctggaaactatctaagggcacaccttgagtcaccttgatagcataaagatacagctcaaaggggttcattatgaacaacaaaagatgttcctgtcactcaggaatttcaaatggtttttgaagctctgtgcctcgggaactagggacaaagacaaaatagattttgctgttctatcacagggttgatgacaaagaatgtgtggccatctttaatctgtgacactggtcctctgcagactcaagcaaaatagatgaaattttacaaaggactgttttcctatcatttgcttagaaaattaccctacatgtttatcccactttcccctagagcaggtttctggaaagctaatgctatgtcttacgtatacataaacggatgaatgagacaaagtttgttgcattggtatgtgtgttggggggataggagggtgatgggagagcctcctggaatagtcttagagttggacactgtttccccttgtgactccttttgcagctactgccttgatcccctcttgtgcctgctaggctctgccttggggaaagctcaactcttctgtttccctacacttgaccgactgtctccatcgttgccttgcccatcttgtgttgtgtccacccaaacctgactcagatctactagttttcatctttcgctcacggactattctcttgagccagattcctagtcccctaactcaatcatcttattctggcttctccagtgttctttcaacccaatcttgctaaaaagctattttaatgcccgactgtggatttttggcatcgttatctcagcaggcctagcttggaggttcctctgggatttcctgctggagtcttctttttaggatttcccagtctacttgggatacttaaggaaaattatcaccttgtcttaggaagaatcttattatctcaaatcaaatatttaaaattgcaatgctcccttatctggaattttattttgtaagggacattttctgataagctgccaatgacagcctatgatatgaaattctgtatgtccctttgggttcaacagtaaccttaatgggatagttttgtctccctgtctcacctcaggtaacagaaattgtcaagtgcaaagaaacttttgtatccttcccacatccagagctagcttggagtttgaccttaggcaacaaccaactaactgtgccttgaagataactctctggggagttaattaggatagactgaataattcaaggggcagttttggtgaattaaattgggaaaagattttcgagtgttaaaggttgaagcattcccttcctattatttcagctcttacctctactttctcaatatacattaaagaaaagcaaatctgttcaatagatttgagataatctattaatttagaatgcttactagaagcccaccatggggctaggctccacaaagtttgaattgtggttatactgtcggttgttttttaaaaatgtacagcaaaatcctaggcgatcttcatgaactactccagaggccaccatcctagaaatctaaactcagctctcctttaagattagtcattttcttatccaaacaccacagagctttttacatagctttattacagtgcttcagatattgtcttgtaattatttgtttctcaacctgtcttacctattggacctgattaatttagaggtgggaggctgctggcttcatttccttatccaatcatttaaattaagcatctgacaggtaccaggcactatatttggttctagtgttccaaaggaagtagacaatcctcattttgtatgtattcttcttcttcttcttttttttttttttttaggtggagtctcactctgttgcccaggctggagcgcagtgacatgatctcggctcactgaaacctccacctcctgggttcaggtgattctccttgaactcggcctcccacgtagctgggactacaggcatacgccaccatgcccggctagcttttctatttttagtagagacagggtttcaccatgttggccaggccagtctcaaactcctgacctcaagtgatccacccaccttggcctcccaaagtgctgggattacacacatgagccaccacgcctggccccattttatatacatgctgtatgtttgttgcatgtgtcaatcattttgaagttgcatttccacttcacacactctttttttttaaacggataattaggaaattcagccattttgaagttacttgactctggttatggttgttttctaagctctgttaacacacctggtcaaaagtttggaagtcagacatgttttgtttgtcgtttttttttttttttctctgtcagacatggcctgcaccataagcttctgaaaaactctttgaggccagagacttggcttcattgatcttagtatctttggcaatgttttgttcgtagggaagattcagtaaaaggacatttggcatcagactaaaggaaatgtgttccattagatgtttaaatcacggtggtttattttcaaagccatagttttgtagtgtttctttacaacgtgattgaatttaaatgcactgggatgacttcctccaagaagaaggaaactggggggccgagaagatgtggcaaaagcagaaacatgtccatctctcattgggtagggacatcattcatttatttgttcccgtatcattttgcagattccttttcaacctgtacactggctgtctttctctcatccccaagtttcaagatctctggtggtatttcttttccatatcctttacctaccttgccttgctcctccacattcccaattccttcaatttttttttcctctctaatctgctgttttatggatgtcaagatatactctagttactcagctcttaccttagaattgagacttcagagtttcccactaagttccctttgcgatacacaggaaagggaacattaagaggagcacactgagactttaagcaggaaaatcggtaaacgctgaccatactgaacaattaagtctactattacttactggttttcttcttcagagcataaaccgggcttccctttccccagacttggctactgtcccctggcttgcaataacccctggctcctcaaaactctatgccttatacatatgcctttccaagtactcttgccatttggaggatgggaagatactatgtcagagaatcccaggatctgattggatggatataattgtgactgcctcttcctccactgtcaggtaagtctctgaatgtgcctggctgctctgctttctctgagtgccttctgccatgagccaagcttttctgtcaccataagcaatccactcatctcttcaagcagggacacgcatctacgtgattggtggccagatcaaatttctgccttctagaaggcatctttcatatccagtctttcacccttaccagtaatgttatggtctagacttcattgacatggttcctccatggaagatcataatactgtttcccaacccagacatagcatctttctcaacacagaactctaggcaactgctttcattgattggagttgtcattcaaattcaaaatgaagcctacttggcatccctagcagctagtcttctcttgcctagatcattcctcttcatttatttctagccacttgcctcaaccccctcgagtttaaccattgccagttttgattggaaaacctatttattgaacatctctggtgatttttctgctgtacccagttacctctgaatgtgttgcccatctctggaagaagaggtattcctatatacacaccccacattcactgagggcttctctgtggttagttcataactctctttcatatgtggtagccaatgctccattaattaggaatgatgttgaccattctttcttctaaagtctgcacatattccttctggagttgtctgtcatgatagtgtcacacttcaacaatgttgaggctcctggtaaattctacagaaacatttccattttcctttgttttatgtacagaaatatagttattaattaggtccttgggcacaaaaatggaggcaggcatgtgccatttaacatgtgtgttagggttctccagagaaacagagctaataggagagagaaagagagatagacagataagaggagacttattatgggaattggctcatgtgatgatgaaagctgagaaactccataatctgcagtctgcaagctggagaaccagaagagctggtggtttaactcagtctgaaggcctgagaaccaggggagttgatggtgtaactaactcccaagaaccaggagctccaatatcccaggggaggaggaggtggatgtccttgctcaagaagagagagagtgaattccccctttccccatctttttgtcatattcaccttttcattgtattcaggcaggccctcaacagattgggtggtgtccgcccacattggtgagggcagatgtacttgactcagtctaccaattcaaatgccagtttcttctgaatacaccctgaaagactcatccagaaataaagttttaatagacatttgggtatcccttaacccagttcaactgacacataaaattaaccatcacaatatgcttcacatatgtttttaaaatagcttaattttttgtctataagtcttgtacatgggtagtggttgagttagtatcttatcccttgagtttgccaaccccttggatagggtcagtgtcttgggttctctgaatggcatttaacacatggtcacaaaaaccttggtctgaagaactttataatgataaagttcaaggtactttggtgtcttgaggaactccctggactgtgaggcagagactcgcttggctctagtcctggtgctggatctaactggctgccattgtggggctcccctaaagataaaggaactcagtttcctcatctgtgaaatgtgaggatggaattcatcaccatgtcccctcccagctctaaacttctctgagtcttgtttttccctgctctgtatcctccactttctggcatgttttttatatttactattataaatgtgtccctattttataagttgttacagcacgagagagaggtaaggaatagttaacaaaattgtattctgagtagcctaatattcttttttttttcctgctaaacttctttttcctcaccttctcctaacatttttgtgggggtgggtggactggtgggtgactgtagtgatattgatattcagagaggagtgaaaaatgcaaaattgcaaggttaacaacagatggttatatggtgccattttaggagtgttattaaaagaacaaatctattttcctgaatagtaggatgtcttaagtgtttaggcttaaatctactgttgaaatagaaaaagaggaggaagaggaggaggagaggaggaggggaaggaggaggagggggaggaaaagtcaaggaaacacttagaacatttttgcatgatctcaattttcttcttgttccaaggtttttaatttggacagtggtatgtgcttcagattgaatgcaaggaaatttgttgcaccatttgcctgacagttatcattttccttgacgaaaagtttttctgaatcttgctttgctggagctacctcttcccttgccctgaataacctcacttgcttaagtcatcgatgcagtggactgacaccacctttctcttaaggaattaccctgttctctgggtaggtctaatttacactcccactatcacccaaagaagagacactctctatattgataactagaaagaaggaactgagactgttgtccaaggacatcttatctttagcatagagcgaatatgtggtttatggtaggtgttcaacaaacttaaaaaaaaaaacttgtattagtctgctctcatgctgctgaataaagacatatcgaagactgggtaatttaaaaggaaagaggtttaatggattcacagttccacatggctggggaggcctcacagtcatgacagaaggcaaaagtcacgtcttatatggcagcaggcaagagagaatgagagccaagtaaaaggagaaaccccttataaaaccgtaagatttcacgagacttactcatttccatgagaacagtattggggaaatcactccccatgactcagttacctcccactgggtccctcccacaagacgtgggaattatgagagctacaattcaagatgagatttgggtagggacacagccaaaccatatcaaaacttaatcaaaaataattgaaatgtcaggaaatagagaaacttattgagcttttttagggaagtggtctttgaacctgttttgctctgcccactggagtatgctgtccatcaaattgttagttcagtgaattatggtacaaacactcagttacattaatatgactattttcttgtatgctaatttgagaacctactccctggagatatgttatcccatgtaatttccaagtgaaatggagagaggatgccttagactgttacttctcatgtttttcattccaatcttcctcagtgcccctctctataatcccaatcctatacatttttaaacaaaggaaagccactcagatcacagtagctcatggacattggtgagaaacgtgaggaaatgtagaggatccccaaattctcacacataaactaaggtgcagccactgggtatcaagcaaggtttcctcactggtttaatgactccagttttccacattgacatttgtgctgggagccttacatatatgattttgtaaaaccctttctgcagcccttcatggtaggtagcagaatatttaaccctattgtaagagacaggagaaaccaaactgctttttctattctcacccgccattctacacagttctccagcagaatcccactggatgtcctatagtttggcccggttctaacactgtctacctggagatagcctcagatctcacaggtaaagggctcagccccacaagactgcccttcacttaaaatgccaatcgcaagtcccagattgtggtctgtacttctgagcaactggccataaattgggggttcccccaggccctttgtcatgtttgattaatttgctagagtggctcacagaactcagggaaatgctttacttgctactgcccatttatcacaaaggattttttaaagatacaagtggacagccagatgaagagatagatgcatagaacatggtttggaagcatcctgagtgcaggagcttctgtccccatggaattggggaacactaccctttgggcacatggatgacatgcatgtgtttttgttcacaaactgagaagctctctgaacccagtccttttgggtttttatggaggcttcatcacataggcacaattgtttaaatcatttacataaatatgattgatcaactcttccctctcagatgttgaaggtgggactgagagtcccagccctctaatcatatggttggttcccctggcaaccaacccccatcctgaggctatccaggagcccccagccacaagtcaccctaatactatacaaaaggacgcttattttggagattccaagggttttaggagttgtgtgccagggatgaagaccaaatatatcttattataaatcacaatatcacacctattataaagcactacatataaagtttacactccaagaataaaagatacaaatatggaatcttcaaatgccaagggcctactggatactgtgaatgacaatataagctacatcacctgttattgaaaaccagaatgcaagtgtaaacttgaccagggaacctgcggagatggagaagtttgacacctctccagcagcatcatagaaatgaacatcatgagcgcattgagggggagggttaatgtcttcatcgttcttcctctggtagaattatatttgcatccttcctggtggaaacttgatacttcactgtagtgcacctgtacctgtttttttttttttttttttttttttactttcttggagggagagttcttctatctcagaagatagaagaaatagctggaaactctatattcctgtgccctagcacaggagaccaggggtctccaactggtctgtggccttttaggaactggaccacacagcaggaggtgagcagtgggcgagtaagcaaagcttcatctgtatttacagtgactccccatcactcatatttccacctgagttctgcgtcctatcagatcagcagcagcattagattctcattggagcacaagccctgttgtgaactgcatatgtgaggaatctaggatgtgtgctccttatgagaatctaatgcctgatgatctgtcactgtctcccatcacccccagatgggactgtctacagatgggactgtctagttgcagaaaaacaagctcagggctaccaccgatttgatactatggtgagtatgtaatgataataaagcgtacaataaatgtaatgtatttgaatcagcccaaagtcacccccaccgacccacccagtccatggaaaaattgtcttccatgaaaccagtccctgctgccaaaaaagttggggactgttgccctagcaggtagagcaagggtatttcacttaggcttgaccaatcgaatgccttcattctggattttggatctgggagaagtcttgcagagacgaagcaacatttgagaagggttttaaggctagtttgagtttagtgtgctggtcctggctgccatgcattgagcagatagttcctgtggtaagacctgctgcccaagccacccttggtttctgcctagttttctaacacttctgtcaattctccattcttgaatagtcttctaatataggccttttctgctttaggtagccagacagaactgttccttgcaaccagtgactgtctaattcagtcacttaatgttttgtagctttgttcagttactgggcacaacccactttctgctcaggcggcttggagacagccatgggccatatgaatcgctattattttaactttcatagtaagaacttgctccatgtgggaaagcataattattttggtttctgagtttaataagcagaaagcaaagaagaaaaaaaatactgtttgcactgagcattaaaatataaggaagtaaagttgtttatagatagagtttcagctaagcaccaaaggtttatttatattttttgccatttatattttctgcctagttctgcctaggaaccagggaaatccatggcaaggagaaaataaagcatcaaagaggatgaaaatgttgaataaagtattagaacccagaacacttaaatctttaacatccatagtaagagtccttcacattactcaggcagactttttttttttccacctcttggtattctgtgcctacacttgcatgtttaaataacgatttaaaaatcacatgagaaatgatcaggctttctttttcccacttgactctcagttatttcaattctttgagacttgttaaagaaaccgtttagtgttgtaaatgccaccaagtctctacctagtagagattagaaatcctctcaccaattccaagttaaaaaggtcctgacatattttgatggaattggcccatgttctcatttaccagtgaccagctcatctccatgctatgatgctccccaggaaatgtgcatggtttttgtagaaggtggcgagaagcttcatgggcaccagcatccacaacccacttcttgaaaaacaaaatcagatttatatttagctgaccacctggcaagatctcctgtaggaagagaaggaactatacccctattactatttcagcttttattcacaaagtctttatatttgaaaaatgctttataatcattttaattagtggtttctcaccaaagccctggatgtggtattattggcaccattttctgagaagaccgtgtgccattgagatggaattgacacaagatgttaatgggttagaagctggtactagaatcagaatgataggccataggactcagcaagccatgctatttactgtcatcttagagggctaggtagggtggagggaaggagttgatgactgattgttataagtgaaaagggcagcagtgacccaaaacaccattgcaaatgttaacagaggcctgttacagagttaaagctgggttttccaaaacaacacatctgagtaaaagcgcccttggtacattagccagtatggagccagcacctgagatcacactgtgtttgcccctttctgcaatggctattggtgctggttgcttgtcttggcctaagagttttcagctgggcttttgagcaagctgcatcttgaatctgaggatgcgggcaagccaggcacagaactgtgagggtccttgcaatgggctgctggtgttcctgtcattcataagcttggacttggtccccactgtgtttgatttgggagaggttctttgaccatacaactcttaccgtgtaaatgtgctacaatccttgtcaagacatagcaaactatatttgaacattgttttaccatttactgttgtgtgcatgtgggccatattttcctagtcagatggtgagttctgtgagggcaaaggctgagtcattctctatttacattttaagtaggcatccagagacttggttatattctgagtctgtattattgatcaaagccctcacctggagtttctggggccattcactgacccagaatctggtgacattgacacagggagggaataacatccagctacagatggttaacacaggtctttagtgccccaatccccattttgctgactcatctatgcctcaagaactccaatcttcatgcagattctgttgcccttgagtactcagttctgtctcttctgcatacctctgtggagccttggatcctgtcagactcttcgtgttgctgaagttctcagtcctctctctcagccgagtgtaatagtgccccagtgggcactgtagggacagaactgagtttcttcttttcttttaggagttgattctctccgggtaatatctggagctctctaaagtttcagagagaaatacgttccttataaaccttgtggttgtcatgctggtgactccttgagcctgtcctgtgctggaccgtgaggaaggacacaaggccatccagactcctggactcacagtgatttcttgtcctccccaaagatgcctttgcctggtgcactctttaatagcccatcacttcttgctggctgtgtccccagctgagttcctccaggatatggcatcaactctgaacacatctctgtatattccctcttaggaccataagattcatgttaaacttagtgccagaaataaccttgggtagccatgttccttatggttccttagattacattcctagattacacattttacattaaaaaaaaaaaaacaaaacccaaagcacctagaaccgtgctggattcttgataaatgcttgtatccattaaatacatattgaagtaacttctactccagtgacccctctcttgaggcttactgtttacctcctcactttggggagctacccagccaggaccttctgagagagaaaagtggtatatttagtagtcaccagatagttactgttaacggtgctgagttcttaaaaaaacctgttaattgtactagcttaagactaaagtatatgttcctctcctcgtagagtgatgatgatggttttataaatactggttggatagcactgtaattaatgggcacaccagcttttattttggtaacaatgtattcttataccacatttaagaggtttctctttcctgtggtcataaagtgattaaaaaaaaaaaagagaggagagagatgacatcctttttaataaggcatcccaagcagtctaagtacctatgaattataaatgaaaacttttcagtgattaaaataaatataccaatgcagtccccttctctgcgtcattgcttcgccaggcctgcatgaaaatcactcagaggaagtcccaaggggccctgagatcatttgcatctgttccatgtgtttctctgatttatatcagagtgcatcaagggcagtggccttccagctggtttgggaagagggattcttttatccagaggaggcatcagctgatggtcagttagggctctggagtgcagctccatgtaaacaactagcctttgtagtaatggccatataatataacctagtccatgttttgttccctcaagaaccaatttacaacatttaatgttcaaggatggttccattcctttctttgtttacacaggtgaggctttatttagtagtgggaagtgaagggcagatggtttaaggggttcttaatgctgcaggagaggcccataaactgaagtatccaagaaaatccattctaaataagaggcaaacagagtctcagatggatataaattagtattattcttaggaatccttccttcccatttctcagacttatagcaaagctcttactgatatcagtggccattgtgcaagtgggtagcagggaaatcaccctcaatgaccaaatggaagtacatgaggaaaaagatggagaatcctggataaagaagacaactggctgggctccatggctcacatctataatcccagcgctttgggaggctgatgcgggtggatcacttgatgttaggtgtttgagaccagcctgaccaacatgacaaaaccccatctctactaaaaataaaatacgtaaattagtcaggcgtggtggtgggcgtctgtaatcccagctgctcgggaggctgatgcaggagaatcgcttgaacccaagaggcagaggttgcagtgagccaagattgcaccactgcactccagcctgggcaacagagtgagactccatctcaaaaaaaaacacaaaaaactgtctttttctagccctatttatttcaccctacactccatttaccttttatttgttgttaattaaataacattaatttttgttgtaggattatacgtaagaaactattggccttttgctgattgtgctggaatttaaaagttgtagggattgtgggccattgttctaaaatggctcattttgccaaacatgattaatggcttttggggtgcagtttatgtcaaggcaaaattagtggacacttcagcaaactggaatgtggttctgagctaaggggatattcacttagccattcctagacctttcttctatcagaacacgtctttaaggttgaatatccaacattttcaaacattttagtcttaaattctacctttagagtattattgatggtctgattagataatgaaataaattttctctcagcaatgtctgtaataaaacataatgcaggaaagatagcatttaataaaatatttgtttaatgttaataatatttattaccatcagattagaatcaagttaacatcaaattagtaagagatatgtcagtcacaggacttgtagggatgcgagaaaaagaccaccagagaaactgaagaaacaactggaatcatctttgaagaatttcaaactcatcattgagacattggcgagactgggaaaattatttctgaatcttgaaagaatgatgccccaagaccagatcatttaaccattatgtgtctggagagccatcatgcttcctggtatatttactgtggaaaaccctgactctcaaaaattaaaggaaaattacaactgtaataaattggcctgaattgcatggattcataagaccactctctttccatttcttcctacttaatgttgttttcacatagtgatcacttagcagagtttgggaataataactggcaaaaaagctaaaattcttagtccctaaaggaaaagtttgcaaacttattatttaatgttttaaaacccctttcccccgatgaatgttaccctgtccctaggagaagcttctctttcatgagttcatagatcaacagtggaaagatgattgtatttttgagccttgaggttcaactttttctcttctaagtcttttattctgcaagagcccttttgaatgatttaaaatggcattctccatttattcgtatttatcgaaaatctatttggagcaaggtattacatttaaagacagagaagaaatggttcatccactcagctaatatttattgtgtgtacactatgtagctacaagctgggaacagagtggagagcaaaagaagacaccattcctgctcttctacagttgagtctggtagaggagacattcatgattcattttttttttttttttgaagcggtataaccacccagtgggttcacattgcctgctgccttcacagagccaatgtatcgagacaggggaattgcagtgaagaaagagtaattcacacagagccagctgtgcaggaatgagagttttattattactgaaatcagtctcctgaagcattcagggatcagagtttttaaagataatttggcaggtaggggctcaggaagcgaggagtgatgattggtcaggttggagatggaatcatagaggggtcgaagtgagtttttcttgctgtctatgttcctgggtggaatggcagaattggttgagccacattactggtctgggtggtgtcagctgatccatggagtgcagagtctgcaaaatatctcaagaactgatgttaggttttacaatagtgatgttatccccaggagcaatttggggaggttcagactcttggagccagaggctgcatgacccctaaactgtaatttctaatcttgtagctaatttgttagtactgcaaaggcagactggtccctaggcaagaagggggtctacgtgggaaagggctgctagcaattttgcttcagagtcaaaccatggacagaattccttcccaaagttagttcagcctacgcccaagaatgaacaaggacagcttaaaggatagaaacaagatggagtaggttaggtctgatttctttcaccatcataatttcctcagttaaaattttgtaaaggtggtttcaatggagcctcactctgttgcccaggttggagcgtactggttccatctcagcttactgcaacctctacctcctgggttcaagcgattcttgtgtctcagcctcccaagtaggtaggattacaggcatctgccaccacactgggctaatttttttgtggatttttagtagagatggggtttcaccatgttggccaggctgatctcaaacttctgacctcaagtgatccacctgccttggcctcccaaaatgctgggattacaggtgtgaaccaccacgcccagccatgaatctttagattactcaagtaaatgtaaaattataagtgtggtaaatgacaggagatgtatagtagaggaatctcatctgtctagggataaagggctcccctgtggaagtgatatttaagggaagattaaaggattaagaacaattaatttgggaagggatggtgtcttagtctgttctctgttacctgagactgagtaatttattttaaaaactcagaaatttattttttacggttccagaggctaagaagtccaaagttaatgggctgtcatttggcaagaaccttcttgctctatcatctcatggtggagggcaggaaagcaagagagcacacatgccacagagagcaacagagggccaaactcacttttataacaagcccagtcttatgatacaaacctactctcacaataatgacatcaatccattcatgagggctctgccctcatgacctaaccacctctaagttctacctctcaacactcttgcattgggggttaagtttccaactcatgaacttcagaggacacattcaaatcatagcattctgcctctggtattcaaaattcacattcttctcacatgtaaaatatatttatttcataccaattgctctaaaaatcttaactcattccaacatcagcttaaaagtccaaagtccatagtctcatctaaatcagatatgtgtgagactcaaggcatgattcaccctgaggcaaattcccctccagctgtgagcctgtgaaattaaacaatttatctatttttgatacaatggtgagacaggcataggatagccattcttattccaaaatggagaaataggcaagaaaaaaagagtaactagtcccaagtgagttcaaaacccaacaggaaaaacaacataaagtcgtaaatctggagaataatctccacacccttaatattgtctcccaaacatgcttttttcattctttacatggccaggctgaaaattttcaaaacttttactttcttcttcccttttagttacaaatttgtctttaaatcatttccttcttattttactgtaagtggctgaaagaagccatgcagcaccttcaactttgctacttaggcatttgctacttagcctagttcatcactcttaagttctgccttccataaagtcctaggacatagacacaattccaccaagtttgtaactgtatcacaaggatggcctttactccagtttccaatacactgttcctcagatccatctgagacttcatcaggatggccattactgtccatgtttctaccaacatactgatcatgacgtcttaagtaacctctaggaaatcccagtttctctgcagttcttttcttcctctgagttctcaccagaatcacccttaatgccccattcatgacaatctatgcttcttaaaatcttgctcctccaaattcttccagcctctacctattactaaattccaaagcttcttccgtgttttcaggtatttgttactgtaataaaccctcttctcgataccaattttttgtcttagtttattttgtgctgtttataacagaataccagagactgggtaatttataaagaaaagaaagccagcgtctggcaagaaccttcttgctgcatgatcctgtggcagaaggcagaagggcaagagaacatgtgcacaagagagaacaaaagagggccgaactcacttttataacaaaccactcttgcaataatgacattaatctattcatgagccctcatgacctaattgcctgttaaaggtcccacttcccaacactgttgcatggggattaggtttccagcacataaactttggagaacacattcaaatcgtagcacatggggtacagaattatattgcagatacagacagcagctcatgccaatgctgtgtggtaagagaaagcacagggctattgaaagaatgaacaagggtaagggcactggcacccagagggcaaggaagagtacaggtgggatgaatccagagtgggaggtggagactaccaccaggctatgcaggaccttataaccactttaaaaatttgagaagtctgggtgcagtggctcatgcctgtaatcccagcactttgggaggccaaggcgggcagatcacgaagtcaggagattgagaccatcctggctaacatggtgaaaccccatctctactaaaaatacaaaaaattagctgggcatggtggcaggcgtctgtagtcccagctattcaggagactaaggcaggagaatggcatgaacctgggaggcagagcttgcagtgagccgagattgcaccactgcactccagcctgggtgacagagcaagactccatctaaaaaaaaaaaaaaaaaaaaaaaaaattgagagataggagggtcacttgaggccaggagttcaagaccagcctgggcaacatagcaagaacccatctctacaaaaaaatagaaaaaaattatttgggtatggtgatgcaaacctgtagtctcagctactcaggaggctgagggtgggaagatcacttgtgtccatgagttcgaggctgcagtaagctggtattgtgccactgcactccagcctgggcaacagagtgagaccctgtcttttaaaaaaatgagggttttattcaaagaacaatggaaaatcattgatgggttttaagcagtaaacatgaagggaacacatttgtggtttgcaaagattgctttagtgcctttggagaggagtggtagtaagatcatccagggtgctattgttcccaggtgaaagatgcaataattcaggtggaccccttaaagaaagagatatggatgagttctagagatgtggaagaggcagaatcaatagaacttggtattgattgaatatggtgtgggggcagggttattagcatggcccctagatttctagcctgctgagtaggatgaatggtcacaccattcactgagatagaaagctgagataaaacaagatttaggaggaaagttgacttttactttggacaggttgaattcaaagtatagtatggtgtcataaagtaagctgttgttacatagcctaaaaatgagtggatttttaaaaggtcaagatgggcagaagtagagcattccagttatctaacattgcatgataaagtcccaacagttatggcttaaaacaacatttactgtgctcattaatctgaattttggcaaggcttggtggatagcttatctccgcaccacttggtgtcagctgggggagcctgaggctggggttggaatcataagacagcttgctcactcaaatgtatggcagttgatgctggctgttggccgaacttgagcaggggttgtggctggagcacctactcgtgtcctttacatgtggctgcttagcttcttcagagcttggtctgctgggtttcaaggtgagtgtcacaagaataaagtgagagccagacagagactatcacctttcatgacctcgcctcagaagtcatctagcatcacttccatggcattctgttcattagacatggcccagccatattcagggtaaggggaattagagttcactcttcaatggggggagtgttgaagaatttgacaacatgttttaaaaccaccacatggcggggcagagaagaaatcagttatcattccagctggaaggaacaggttgaaacgggaaggtagaaattatattcaatagaagtggagtggttgctgttggctggcctggagcatgtatgaagggttatgaacagtgtgaaatataggttaaaggaacgtttgggaccaaattatggtggagcccaaatttcctgaaacccattattttgaatctggaaacaaattgtcagagaggaatacaaatcagatttattaaataaagataaaaagtagaagcaaacagtgactggcatgggataggaataattctacttgctgataaaataattcatgccaattttggggtgtctagtctacagatttggggtcatatatctccaaatttaaattgtagacatattcaaatgtctttagttgggctttgtaccttatgccagtcaaaaacatgagtcaaaaaaatcatgcctgtatggttcccttcggaggtatctctcctttatcctttagcagattaagataagaatcttggtctttttgatcctggctgtggcttcaaatttttcccatcttactattgggctacccaaaaggactgcatcagacaagactggtgagttgaatagtgttcctcccaaattcacgtctacctggaacctcagaatgttactttatatggaaataggaactttgtagatgtaattagttaaggttcttgagatgaaatcatcctggatttagggtgggccctgaatccaattattgttgtcattaagaaattgagaaggcacagagacaaagcaaagaagcccatggggagatgcagaagctgaccttggagttatgcatctagaaccaaggaatgccaggagcaccagaagctggaagaggcaagaaaggattcttccctagagccttcagagggagcgtgaccctgtcaacaccttgattccagacttcgggcctctaaaactcagagagaataaatttctgttttaagccacgtagtttgtggcaacttcttatggcagtcctaggaaattatacacgaagttagagccaggcatgatgtattagtccattctcacactgctataaaaaattacctgagactgggtaatttgtaaagaaaagaggatccccaggctctatggaaagcatgcctggggagacttcaggaaacttacaatcatggcagaaggttaaggggaagcaggcacgtcttacatagcccaagcagaaggaagagaaattgctgcgaggtgctacatacttctaaacaaccagatctcgtaagaactcactcactgccaagagaacagcaagggggaaatccacccctaccacccagtcacctcccaccaggccctcctccacattgatccaatcacctcctaccaggcccctctttcaaccttggggattacaatttgacatgagatttgggtagggacgcaaatccaatccatgtcacgtggaaaatatgggtgttggtttgccagatgccaaacagaaacaacatttgatctgttgataattgtgtatcctctttatcaggtctatcttaaggaaatcagagagtagagcatattttcttcatggaatggtgagacacatattagcctgagacaggagctaaggagagtgagtggtgggctccaccaaagtgccttcatacaactacactggtaggtgatcagaacaaagggacacgtagaacgaagacccgggtgtgtaacccaaatgcctaacaaagtccattcaatgtatgaggtgttgctgctgtgtgctgaaggaggaaacctgggtcttagtctctgttatggtaaatagagaagaaatcaagccttcctacgacaataggggatttttaatgaagtaaaggagacagaagaaatgtcccaaaggagaatgaagtatgtcaaaaacagattgcgcatgtaattactttctcaggccttcctgacattatcagcaggacttgtgttttgatgaaaaaacttaattaaaacttaatttttttaagtggaaaatattcagcatggttacaggaagactgaaatcagggcactgtgtaattttaattgccttcgagagatgcacttcacgtgaagactagcatgggggaaaaaagctagaggcacaaagtctgaggggagtggccacgctgaatctctagctgtgtgcttgggcgccattttccccactcttacagttgacgggatggcatctcaggtttcacgtgtaggggaggagagtgggtctgttctggagtgtgccggtcaggccatacttggcatacacattgtagaaagtgtcttgatttttattctcctaaaaagggtaaaaagagattgaggagattacatatcccatgaggcagcagtttttaaatgccactctctggatcagttctatcagaaccatctggttctgattcatttaatctgttttaggacctgtgcacagtgtttctattttaaaaataaacctgtcctactcattcttggagtcaggtgtgggaactacaggtttttaatggaagaaacatgaacttgaaaatgagtaaatatgggctacgtcctttacttcccaaggagatttgggttgactgcttagtttcctccatcaaatggggataatatgcttatttgatggggttttgtgaaaataaaagataacacaggtaaagtgactgacacatacagttaagtggtctaaaaatgataaaactgtagaagaagagttggatcaggctgcttgctaaattgggaagggataaggtagtgttcttcagatatttcaagggcagctgcatgagagagagagagagagagagagagtgtgtgtgtgtgtgtgtgtgtgtgtgcgcatgcagcctttagaggtcagactcaagtccagcaggtagaagttatagggagataaatttcaacgcaacagaaagtggaactgtctagtgaatggtccagggatgtcatcagtttgctccagagggtagtacgttccaaatcactggagcaattaaagcagctgccatattttgaggatgtacagggctgtggggcagcaattgaatgagaccacttggttcagctctgtaatagggtttctggcttcctgtggggctgtggctgacatacagttgttttgtaaactaacaacacttgaagaaggttttagcagaaaacgtttaccagtaagatatgtcaggtcaagtacactgttttaggtattctttactggggacattcttgtgaccttcatcccaggcctttcagaaaagggatggggcatatttagaagttattaatgactgagaagctcctctggcacttcaggggagggaactagagctataaaatgtcctgtgattgttctaggactttctccttagtttagctaacatctgggtccttgtcacacggctatgaaatattaggcttacagacactttgaagggtgagaaaaatggaatttattgggtaaaaaggaaaaaaagggaaacagggatgctctgcagagccagattcctgctagtgtgcttcctgcctcacagactgaatcccaggtaccacccaggaagaggaggggccaggctcctccccactgcaaatggcatgaacttcccaagacccctcccccagtgtgcaggccacttggaggttctctggtgacccctttatatttggctgtctcattatgaatgggacaggagtgcgaaattatcccacttcaaatgtcacttgctctctgttgggaaaccctatacctcactgaagcccagatgatctccctgaaccagcctttgagggtcctttttggagccctttggaaacctggtattggatgggttgggttacagggctgctcagcctgacagcctcgcattatctggtgaccacagagtttaaagcagaacattgggaagaaggtagactgggccagttgcacaaagcagagtgtgaagagtgatgggagatgaaggctgtttgcctgcttttcactggggaccagatttggatggatgctggtccaatatgagtgacacagttaacttatcagtgagatccctcattcttctcatcagtgagatagctgggtattgggggaacctgcccccagtatttcaatgtaggttctttctattttccataatatcagctggctgagaaataaagagaaagagtacaaagagaggaattttacacctgggccgccgggggtgacatcacatatcggtaggaccttgatgcctgcccaagccttgaaaccagcaagtttttattaaggatttcaaaaggggagggggtgtacgaccagggagtaggtacaaagatcacatgcttcaaagggcaaaaggtagaacaaagatcatatgcttctggggaaacagaacaaagggcaaaaggcagaactcctgataagggtctatgttcagtggtgcacgtattatcttgataaacatcttaaacaacagaaaacagagttcgagagcagagaactggtctgaccaaaaatttaccagggtggagtttcccaatcctagtaagcctgaagttactgcaggagaccagggcgtatctcagtccttatctcaaccgcataggacagacattcccagagcggccgtttatagacctcgccccaggaatgcattcgtttcctagcgtattaatattaatattccttgctaggaaaataatttagtgatatctctcctacttgcacaaccgtttataggctctcggcaagaagaaaaatatgtctctttttgcctgaccccgcaggcagtcagaccttatggttgtcttcccttgttccctaaaagtcgctgttattctgttctttttcaaggtacactgatttcatattgttcaaacacacgttttacaatcaatttgtgcagttaacacaattatcacagtgatcctgaggtgatgtacctcctcagcttatgaagataacggtattaagagattaaagtaaagacaggtatgaattataaaagtattaatttgggaactgatacatgtccatattaaaatgaaatcttcacaatttatgttcctctgctgtggctccagccagtccctctgtttggggggggtccctgacttccaacagctggggaccacttaatcagggtaagggcagtagtttgtgttcacagtttgatctccctgcatggtgctaaccaggctgcatggggatctaatgtctgactttggccacggcatcaggctccagccaactgacgtgaaagcaagtttccaaatcgtctctttctaaatagataaatgatactcagtgttcctttagccttccttattttttgcaaatgcctgtccccagtggttctgttgtttgctctgattgccgttttccccagtaagtgggaaaaccccacatcttttccccatcagtattccctaatgaggcttgttccctcaaggggaccttgatgagttacaacagcatgaccatgttcccaagcagcatgctaagaaaaacaatccccagtgatgccctgcaggcaccatttaggagcgggcggtaatgaatccctgagagaattcagtcctccgtatgaaggtgatccagagtgaagtaaacaatttcaccgttaggtggttcaccctgcatgcctcattgctggctttctggaaagccagtaaataaggcagaaaaaatgtatcattccctccagagtgcagggtcccctgtcacccacacaggactcctgcctgtcactttgagtcacagctgggctttctggaacccggattcttgtctctggttagctcaggtcttgcagccatgccaaatccaaactgtgacattgtctgaacagtagggcatcctgttccctggtttggctgagctctgcggagcagaacagtggccgaggttaacatcagataatttcctccaccattcctgagtaccctgagggcttgttacctggaatcaaagacttgtcagaactcaagatgaccttaaaggccagcttattcaacctcccacccaggatatgacttccagaactaaccacccacaatgcagattagtaatatcatacgtggttactcaatgcaattgtgtcatttcaggagaaatgacctgttaccaaagtgtcatgaaacccacattaatgagctgggctgtagtggaggtttactttgatttctgaccttaattattagtggtttggattctttacgtttatgatggattttctgattaccaattatgattcactgtaagccatttttaaaaatatgacatgaagctctgacccacttttaacaacacagtggcaaatgccaaacaattggcaatttccccttctaatatcagctgtttgaatcatcacatctactgtggtggctggggaccactttatcttcattctctggcttcagtattcttttctggtattgtcattactgacctaggtgcatatctgtactaggctgggacctcagctctatgccagtgagaaaatgaggttcaactgggaaaacggcctggagcagttgctctcaggcttgtctgcagattagaatcacctgtagacttttaaaaaatactgacacttgggttccgctcttggaaattctaatggatctggggtgcagcctgggcatctggaattttacagtctacctgagtaattccaatgagcaggtgggtggccttgcaaaccggggtctgaaggggctggtcagcaaggagtatgggcaaaatagtgctggctggctgggcgcagtggcttacgcctgtgatcccagcatttgggaggctgaggcaggaggatcatgaggtcaagagttcgagaacagcctggccaacatggtgaaaccttgtctctactaaagatacaaaaaattagctgggcgtggtggcacgggcctgtaatcccagctacttgggaagctgaggcaggagaatcacttgaacccaggaggcagaggttgcagtgagccaagatcccacttggctgccactgcactccagcctgggtgacagggtgagactccatctcaaaaaaaaaaaaaaaaaaaaaaaaatagtggtggccaaggggtgtttataaaacagagttgtgatacatgttcatacattcacctttgaggtctgatttggtggtagcaggagtttcaggggaaatgtttactgatcaggttgatgagtgtccagggacaagatgtgtctgctaagagttagattgatggcaaagattgggcagattgatagttctctagcaaataagatgagatctgctatttcagcaggaaacaagtaaggaagttgaacaaaaagctagtggtatgggccatgtccacaagctgtggttaaaggcaaaggctgaagcctgattggcgtgcccacactgggctgggcactgtcagggacagccaggctgactccagagcctgccttctggttggcttctcccggcttaagtctggccctgcaggaaaaccgacaggagttttcatgccaaccaagactgagacaatcagagactggcaggtttggaaccaggaggtctggatggggaggttggctctgaatctgttgtcattatcaggtgagtcattaggaccacctggaaaagtgaagctgttcttcaccttctcttcttgtgaaagtgattcaatctcccaaacccaggttgatcataccctttaggtctaatataggaagtgttgaattaggtgatgtctctaaagaactctctctgggttccttagagaaaaatagcatttgaacattgtgcctcagcaggaaagaagatgcaatttaagtcctgcaccaaggcattcagggctcacctcaaagtggactcctaggaacaagaagcaaatgattccgtggagagggttagatgtctggccaatggaaacggggatgtagttcaggttttctagccccagaagttcagaacctttgggttcctcggtggacatgtctgttactcgcttgaaactagggaaagtctcttgtgtagaaaacctgttgcatgtcccttgactaccagtagcagcagaggtgctatgtgtggctgaagaattttcctcctttttctgagagatgatttcccaggtttccttctccacaattctgtgggcgtgtactgctgtgataagatgtttgttctctggcttataaattacaagatattttcaggaccacttggaagaaattggaacattttcctggaggcagtgggggagctgctggaggttttcggacaggcgggccacatgctgagagaggtattttgggaaaatgcacttggcagtcatgtgtgggtgaggataataatattaatacttaaccactggcttgttgggaagagtaaggggaacaatgtaagtgagtgtaaagatgcaggaccaccattcctttgttcattctttttttttctttttctttttttatactttacattctgggatacatgtgcagaacgtgcaggtttgttacataggtatacatgtgccatggtggtttgctgcacccatcaacctgccatctacattaggtatttctcctaatgctatccctcccttagccccgcactttgtccattcttttagtttctctgagacctggtgccccaaggataccatcttctcctgaccagtgtatcagtttgcgagagttgccataaaaaaatagcacagactgggtggcttcaacaacagaaatatattttctcatagttctgtaggtgggaagcctgagaatgaaaggcatcggtagggctggtccctcctcagggccgcgagggcagggtctattccaggccttcctccttggcttgtagatggtcaccctcttccctgtctcttcatgtcatcatctctctttgtgtccgaatttcttcttctcgtgaggacaccagtcatattggattagggcccaccctaatgactgcattttaacttaattacctctgaaaagatcctgtctccaaagatggtcatatgtgagatactggggttaggacttccacatataattttttgaggggatacaattcagtccataacagccagtctttttgaagactttctcttttgggggctttacacttaggtaattacaggatattttaaggggtatttcaagacccagcaacccccttctccacccaccatctcccccaaattatgttcgtcacctcctggtacctgttatatcatcactagaattgcttggttgaatcaagtaatgtttcaagataatttccgtaaacatgcactctttttatgtaagaggggtaataatagagccagtgaaatactggatgaattcatttaccaaactacgtaaaagtactgatatatgacaactacttagggaacctaagatttgggacatagagcagcctatttagaatatccggtataacattgcagggaatagcaagggctctagagctttccgcctgggttgaaatctcagctccacccttttctttctgtgtggcattcagcaagttacttaacccacctgtgattcttccttcatctgaacaagcagcataacaatagcatttacctcatgattctttagaaggtgaatgagctaatacctaatatagtgcttagagtagtgtcttgtctgtggttggctttcaataaatgttagctgctattgttgttgttaaactatttaacaaactacgaagcacattcctatctgctttcttctttgcccttgtaacagccctgtggagtagaaggagttagttacattttacagatgaagagactgaggctctaagacattatgcgaaccatctcagggcatatggcagtgttattcagaacatctatcggtaaagaacaagaattccaaaaatataggattttccccaggaaggagggccagagtgtgggctactgtgggatggcctccgggcagagtgtgagggtaggcgctccaaagagtaaggcatctggagaagagaaacaatgaaagaggcaaacgctggatgagaaggacctcaaagcagaactttgcctctcggcctctcagtcaattgtgatctgactgacatccagattgtgatcttgttcaggtggctgaactttgaacccttcttggccatttgatgctaaaggcagtctttgaatgtgatgttttcctagatcgtactggtggaatttagttgcctcagatttcccagtcatgtgccagcactgccaagtgatctccatgtgtgggttttatgatgtgtttccagtgctccacatatggcctgtgatttttttttcctatggctcctaatgaaacactcagaacactgcactgaatagaagtttctccctattctccagagtggggatccttattgcatcgtcaagcatggacaccaaaaataaatggggagaaatctctattctcttagtgatgaggcactcttggaggaagatattattaacatgactacgtcttgccaatttgaaactttgcaaatatctgtaaggttgaccagtttttataatttcaagattttaagttcaacttaaggtactttacaaaattatttttatcataataaattacagttctttacacctgtgtcttttaccgattagattgtgagctactttatgggtgagcaccagtatctacttaactttgtactaaatggctcaatattgcctggaaaatagtaggtgcccaataaatagtaaatgttgttcgatcaaatcataaatgtagatataagctaaacctcttccctgggcaactggaaatgcccatgttatgtcttaaaacacattgaattcaggtgggagaataaaaatgattttaacaaatccagtgtgctttttgaaggcagaactacaattacttcttttttccctcataatcaaatcaacctgtgaaattggaagccaataaatatgtaaaaaagtcatcaaatgtcataggagaggactactatttgattcacacgtgatctttgtcgtttaattgcgtgtggcaagaatgaatggaagtgatattaagtggagaaaaactcagtcccattggtgagttatttaccttgaccactgtgatgggctgaattgtgttcccctaaaattcctatgttgaagtcctaacccccagtatctcagaatgtgactgtatttggagatacagtctttcaaaaggtgattaagttaaagtgaaaatgaggcctttgggatgggtcctaatccaatatggttgttgtctttacaagaagaaaacatttggccacatggagagatacaagggatgcacatgcatggaggaaagaacatgtgaagacatttacaagccataaaaagagccctttcagagactaaccgtgctgacaccttgactttgaacttccagccctccaggactgtgagaaaataaatttctgttgcttaagtcacacagtctgtggtattttattatgatagccctaccaaactaatacaaccacctactttttagaatttgtagaatccaagcacttaagattacaaaaatgcatgtttattgtggcactattcacaatagtgaagacttggaaccaatccaaatgcacatcaatgatagactggataaagaaaatgtggcacatatacaccatggaatgctatgcagccataaaagaggatgagttcgtgtcctttgcagagacttggatgaagctggaaaccatcattctcagcaaactaacacgagaacagaaaaccaaacaccgcatgttctcactcataagttgaacaatgagaacacatgagcacaaggaggggaacatcacataccagggcctgttgggggctggggagctacaggagggatagcattagaagaaatacctaatgtagatgacgggttgatgggtgcaccaaaccaccatggcacgtgtatacctatgtaagaaacctgcatgttctgcacatgtatcccagaactttaaagtataataataaaaaaaagcaataaagaggaggtgatggtaataggcacagacttttgcttgcgttgaggaaatattctaagtttcacaatggggtgtggaagaatctgtgcgaatctccttctgacctctcgtggtaccatttcctcattactcagtgatgaccccagagccagtcttggatgaggcggggtggaattttccacacaggtgccatgagctagggggctcaaaacagacactgtggtgaggttattactgaaatattctgtttctatgaagtttctaacgtaattctgggccctctttctacaaccttagcaagttgctgaactacaggagtgcggagtaacaatgcctttcatgtcaattctgtttacagccaggcttgcttgcattaaactggacacatccatcaactagagtgctggataacagatgagaaaaagctaagtttgagttgtcttttatattgtataatggtgcttctattttctttgttttcttcttgttcttaagttctgtgggaaacccacgggaagaggagtctatccagggtatttgacttcaaatcatttcatctcttctgttcttcctctcatctagtcctctgtgttcttgtaatatacgcaagggcaagattaatagtagaacagaattctgctatgaaatttaagtgatgtgaattctttctcaaaattccaagaatgaaaactttgactatgatatagccaataatttgcacttgtttgcatttgacattgctcatttacattaactagcgtaaaatacctaattagtacagcagaaaaaaaaaaactatatgaggaaaaaaagaaatgattgctcttttactcactggagggaaaggttggatttatttcagctctgtgtttagaaaaatacctttgctgggcttcttggagtgtgaaaagagtggaccctgacccacctctattccctgctgggccatctggaaggattttcacaacaaagataaggctaaaccactctgcaaaatgaaaccagaggaatttcatgagttctggggagtagaaagaagtagggtgagctctgacaaggatgatggggttgggcatgtgatgtctggagttggggctaaggaggccagtccaggagatggtccctgaggtaggatgggagtggggccaggcaactgtaagacagcgatgtctcatgttattgagctttgctatttcgtaacctctatctgccacactttctaaaacctttgcataactactgggtatctaccgagaggaaaagaagtcattatacgaaaaagatacttgtatatgcatatttatggcagcacaattcgcaattgcaaaaatatgtaaccagtccaaatgcccatcaatcaatgagtggataaagacactgtgagatacacatatatatatacacacacacacatatatatacatatacatatgtgtgtatatatatatgatggaacaccacacagccataaaaaggaatgaataatggcatttgcagcaacctggatggaactggagaccattattctaagtgaagtaactcaggaatggaaacccaaacatcatatgttctcactcataagtgggagctaagctatgaggatgcaaaggcataagaataatacaatgaacttcggggacttgggagaaagaatgggaggtgggtgaggaataaaagactacaaattgggttcagtgtatactgctcaggtgatggatgcaccacggtctcacaaatcaccactaaaatacttactcatgtaaccaaataccacctgtttcccaaaaaccaatggaaataaaaaattaaaaaataataaaaataaaataaaatctttataagactactgtacctgttagagcctcctttctgggaaattaaaactctaattgtttccacattagcttatgaggtggttggtaaaagagaatgactacaggaaatgaaatgccaatgaggttgataattcagtgggaccaacaagtcacagtcaaccagtgatggagatggtaaacctactaggaatccacagaaattttgaggcaggtaccggactctcaagagtgtgtgagattggtgaggctttggcctgagccattgaaaataaatgcataaatagcaacacttagcagaccggaaaacatgggggaaaacccagacaagagacacttgggatttgtcagtaaaaaatggagttgtgaggctgggtgcagtggctcacgcctgtaatcccagtactttgggaggctgaggtgggcggatcacgaggtcaggcgttcgagaccagcctggccaacgtggtgaaaccccatctccactaaaaatacaaaaattagccaggtgtggtggcactcacctgtaatcgcaactactcaggaggctgaggtaggagaatcacttgaatctgggaggcaatggttgcagtgagccaagattgcaccactgcactccagcctgggcaacagagtgagactccatctcaaaaaaaaaaaaaaaaatgcagttgtggaagctttgaaatccctgctgtgaggttatggaaggagaatgtttctgttcaagtatgaatcttttttgggaggggtggcaagaggaaggtatgcaaagggaatggtgaataaaatgaaaaggttcgactttttggtggttagtcacctaagaaggttttgtgggggaaataatgtgttttagccagcaaggggattgtttaacctgccctctaccagtctgccgtgcctcacccacttgtctacagctgtcctgttagttgtagcattttgttttcttttatgcaaagggattttcttatgacactcaaggagaacccaggagagggaaggcatctctgccttccagggacaaagtttcagaactgtactgctctacagtggtaaaaagacaacaaagtctttgatttgcaggttgcttgtttcacttaccctgtgaagtggagctcagttggaatatttcatctggccactctttagatgttcacggcagccctgcctggccagccatgaggtcgggcggagaaaggaagcaaggatgagtgaggagggagagaaatggccctggagtttgttgttggagatcttctctgtgtcaaacatcttaagggaatcacctcatggaatcttcgccacaacccattgatatggggattattttccattttataatgaggaaatgaaaccttagaataacagcaagaagctcagacaactatgaagtggcagggtgcagttatgtgactcaaaaccagtgttattttcagaagtgggaaatgtcatgactttgccctcccctccccttctctctcttccttcctttttgttggctatcttgagctgaatggtgataacgcttaactagtggaggtacattttgaataaacagcgactgacttaaatttataatcataattttattctagagttttaacaaatggtaaaacatttagagttatttttccgcagacttgacaaaggtgatgcctgactgtgcctgccgtcatttttttctatttataaaatcagggtaaatttgcaaacttctaaagaagcagacatggcttcagcaaccagtcagggtggaggtgagaccaggaaggttggagctcatgaaaggtcctcctcttctgtctaaggggcacttacttcattggtagctcagctgatactttgggaattccaagaaagagccaggaaccctgctaggaatagagaagcaaagaatccagggctctcactttgaattgctcaccacgtctagaacatgagtcaggcacagacacagaaaagtcagcataatgcgtatgtgcagtgattatgagatgcccatgcagcgtctttacaccagccagggatgcaaggaagaatctccggagaacatctacccaacaggtggatttgcttgtggggaacagaatctgtcaaggagaaacaaagcagtgcagtagttgcatcatcatgaggaaggatgatgtgcagagttagtttcctaagtggcatcgcctataatgagcagcgtgttctcctaccaccttagctgcaagcagttatgctgtatagccaacatctttctcctagctcacaattcaaaagcacattgctgggattccttgggggctttgcgtttatttgttgtggtctagtggtttattctggcaaaatacactgcatggatttttacagtttgctttgtgcttggacatctttccacccaagcaaaatgtttacaaatgccagcacgtcgttttctgaaaatattgctgaaaagaacaaatgtgttgtgatgtgccatgtgtttgaagagaccaggcaaccaaacactaagattgcctcttcctgtcagtgtttttgctcggaatcattctttattgtgcctgtttctccagaactctgtaatccaaaatggtcctgttctctgtggacatgtgtttattctgcaagttaaaaccctttcaagcaattcttgctgtgttaaatataacaatgcactgataaaattctgtcatacattctagaaaatacctttgtataaagtactcatattactgaatttaccaaaacagcataggtaacagattctaagatatcttagagttaattgataatatgtatctgaatgttgtaaaatttatctttcctatgcaaatcccttcaaaccatcccttctagtcccatttttgagacacacacacacacacacacacacacacacacacacacacacacagactgactttgttattccttactggtttttactgatggtcatagacgtctttcttctctgctacttccattatcttcctgccttcaaaatctccactttagttgcagttttgttttactatatttcttatttttaaaaatatataggtaaatagaaattgaaaagctcccattttttgttagattcatgaattcctttatgtaattatttttccaaaattaatcctgaatacagactagtaaatttatatgacaaagaaaatttctatgacaaagcaaaattaatgctgaatacagactagaacatttatatgacaaagaaaatagggaactgtgttgtttcacatactcaggagcttctgaattcaggaattttctagatggagaagatctcattatatggtgacaccagctagccaggtgtactactgaggtctgtctgtgttagactttagaaatagaccaaggatggagggaggtttgagaaatctaagtaaggaagcataggagaccttcttgtttgaggtcaaagaataattggaaggagtggttccatctcacaatttgaaaatgttctaaggaacaaaacgtacttttttatagacctattgatctcagaagatataacacagctggtggagggtaatgatcaatcgccagactaccaccattctattttcttctctgtcaaacgtactcactatattgtgagtgttttcactgcctaatttttcatggcaatttttgaggactggtagctgaactaatttaattctcattctctcacttgttcaccaaatcatttcatgtgtgtttttgccaggtattgttttaaatattgggcactattttcggttcagtaattcaacctattttaatcccttactagcccagttgtaaatttcaaataagtcattttttttcataccagttccctgctttcgagtctctgatgaggctacgctcaagtattacccaggattaggtcctatctgaaagctcaactggggaaggatccacatttgagcttgtttatgcagttgttggtagaattcagttcccttaggacggttggactggggggcctcagctcctagctgactgtgggccagagatcacccttggttccttgacagatgggcctgcccattagggcaaattgaagcatctaagtcagtgagggagagactctactggcaagacagaagtcacaattatatataatggaatcactgaagtgacatctcattatctttgtcatattccattggttagaagcaagttacagcacccacccacatacattcaggagggtgtgtattacacaagcacgtaaacaccaagagatgggatctttggagaccatcatagactctttcctccataccatctgaacatttaatattaatgtagtctgtatttctacataacagttctctgaaaggaaactttgctgtgtgccagataatactttttgatcttcttattttacctttccttaccccacccatgattattactatcaaagctttagggcataacatagtgctaaaatagaacacttactccaaaaatttaattaacaagcaacatgaaataaaaggccatttgcatattgtaggcaaataaaaacattatcaccaggagaagtgagtcagaatatatcaaatataatagctaatattaaatagctgggggtgagagttggaataatgagcagcctctgtacagagggcatgtcaatcaattactctggccctattggagcacctgcctagaagtccttgctgtgcctggttaacccatcagttgctgaatagtggggaggtctctggtggggattctgggaagaggggctgagcagtaattgcggagaaccctaggggatcccagcagtcactatttactaagacatttttattacctaatactctatggctaaatagttaaaagaattaaaaattctcaaatgctttcaaggttggagccagttcatggggtcaggagagctatctccaggcctgcattctactccccttctttttccatccctgccccatccctttcaggcagcacctggtgcacactcaggtgacccagcctacatgtcgaggatccacgtaaacacccctcaaacagatggtcccccgcaggcctcggaatgtggcaaggtctaccattaggaatgtaggctcaggaaaggctccttcaggccctgagagtggacgtggaatcctgatggcggggaatcccagggtcctgtgacccagagcatggtctagaactgtgctgggcagcacagcagccgcacattggctccagagcactggtcgagatgttccttaaatgtaaagtacacaaccaatttcgaagacttaatacaaaaaataaagggcgtaagatatctcatcaataatttttatgttgattatgtgctgacacggtagtgttttggatatactattgggttaaataaaatatataattaaattagttctaactgtttttttctaatatagctactaacaagtttaaagttctatgtgtagcttccatttgtggctcccataacatttctgtggaacagcactgctctagaagggagaagtacggctctgctaggacacatctcctgctaccttggaccccttgccctgtgaggaggaggagctagagcagagccctctaaagcgtggagtcccaggcaggagcctttcttgccccagggtggttttgctttaaggtgatatttatagtctatttggtctcactctgtcatggctaaatgactccaaatctctctcctttgcctacttctgggttttgcccaaggcaagaaaatagtcttcctcaccttccacctgcccacccccactgccactgccaccaccaccgcttttgaatcaatataaccaggcacagaaagtaaaattgttctgtattgacatgtatctttcaagaagctgttattctttgggtgaaacagaatctaatcactaagcaatttttctacagagagagggagacttttcactccccttccccttggtttgtagagtacattcatctttgataattgattcttcgggtggagtaatgatgtaggctcaggaatacgttttttgattcaaagggtataaaaagtgctatgtgtgttaggggttaatgtaagctctgtggaattacaatacggatgtcttctaaagaaaattcactaatctaatctctagagaaggaaacttttagagagtcccttatgactcccttaagaaattattgtggatagtatgttgctgtatgatggctttaagaatttatggtgaatgcttcagaccatggctttagtgtttcaacagaaacagtggcttacttagggtggtggtgcatcttgctcttgaataaatctgatctgagcttacaagtaggaaggagtaatgatttagatgtctgaaatctctttagtttattgtttcttttcttatcgtggcagagagtgactgttaaaactttttcctcctgggcacgtagctggcctacatttcccagcatcccttacagatggctgtggccatgtgactgagactggccaatgggatgctagtggaggtgatatattcttgtccaatcatctactctttctccttttcttctgcctatgagatgcagagtataggggcacatgggcaccacctgagaactctttaggaatgcagaatctttaaccttctcctaggtgtagggaatcagaatctgcattttaccaagattcccaggtaatacctatgctcattaacatttgagaaatattgccctttgagatgacagagccagtagatggaaagatcttgggtccctgccttgtggcttagaggagagccacccaggagtgtggcttcttgaagcagcctgtttagattggtacataaacaggaagtccaattttatcatgatgaggtcactgagattttggagttgtttgttatagcagttagtcttccctggataatatactcacaaagtatttaaacaatgccatgtacctacaatgtatccccttcttaccaataaattctgccaaccaaaatgatcatattgtacctacaatgtccaaaatgtttaatacagactgaggtagaccttataaatggtattggtgaagcctagtggacaattttaagaaatcaccaacattacaaaacgttgactggcaaacttgcgttcaccctatatatgctctgtaaatgttcctagctccctcacttttttgtctttttcttcttcaacggcctccttcacttttcagtagcagcaagattaagaggtgaaaactgccattactccagtgaatgggtgaggtcactgatttgcacaattcctatgagagcccaattaaaagaagatacagagataagcatgtacgttttcatctctcttaactccattatcttattgtcatttggctatgatttatttaggtcaacattgatttctgtagcttatttagatagctagaatgataaaaatatctttttgttatcacaaggagtacaattatttacatatttacctattcatccattcattcttagtatacagaacagtccaatcaggaacaatctgtagtacctatgacaggtacagaaaagcccttaaagattagcctctaaggtgttaatgggagagatttactgatttatatttttccctatggatctggagatacagggtattaacaagatggatgagttattgggggtgcatttgtatgtctcagggtgcatgctgtctctgataattgctgtctgtgtttgattgggcagagccagtatcttaaaaccttcactagaatttcctatattgagacatctaaagttaagaaatctaggtaatttttgcttatcggtttaaattgtgcatagaactaaattattaaataaccagcatgtctaagccttacccttttctttaattacacacatatccatgcatgcacacacatacatgcacacacatacatgcacacgtgctgaggaggaaaaaaaagctgaagggattttgtctgtgcatacatgcgtacatatgcacagacacacacaagaggcacatgtacacatgtatggacctgtgcatgaacacacaaatcccatcaacttctttttttcagccagtcattatagagaggaatgacagcttttatttgctgcaaaaattcaagtggaagaacgtcatatacaagaactaccagcctagtggtagagaaaagaggattctttgaagctctttttagtcagtctgtactagcaatagtccagtgtttcccaacttgagggtgccctcaaggcgttgaaaacataaggtaccactgtgatcgaggttttaccaaattttaactttccttcacttctcacctaaaatatcttgagggtgatctgtgctcagatttgttttaagggttggggggagtattcaccttctgaagtaaaagaaggaacaatttgtcctctgtctggcttctatcatgaaacttcataacccaagagcacatcttgacttcagctttgttatttttagtggtagaggagaggaaacagtaatctgcaaagtgtgagttcaattaccctgacctttcatattgaaatctgaattcttaataagtgttttatgtgcattttatcatttaacccttacaacaaccctatgagataggtagtgttattataccactttgctgaggaggcaactgagacacagaaattaagtaacttgcccagcatttcttgggattctaacctaggccatctggctccagaagctgaactcttaaccacactgctctcctgcagggtcgatgagcttgccatgcctcttggtcattccctaaggtgtggcattttgtgattcgggatctggctaactcatttaaatatggaagtttcacaaagattcaggctgctcagggatacaaaatggctcattggcagggtggggcttccaaggaaatcgatttcattcctttcctaatgggctgcgctagtttgcaaaaatcaagaactgtgacgatttaagatgcatctgaactcttttagatttccatagaacctcactcagcagtcctttcgagatgatgtcatagttcttttgtgtaatctagtaatgccttttaggggaggaagccggtgtattttacaaatgttatcttatccttacaacacccttgaagcttagtaagtgatattagttactgtttgggggattacaaaaattaggttgtggtttttaatgtttatttttatagcaatgagaagtggtacacacacacccatacttatatgcatatttgtaaacatgtgttatgtatattattatatacacgtatgcatcctccccccagcattgatgtgtgtaattcaggtggtatttggttgactccctcctaatattttgcaactgccactaattgtgatggttgttgcactttaaaatgttaaacttttagaatatgtgagaagtgagcaatttggcattggatctagcactgtgtcctcaagtccctttcatgtgctcagtggatttttattgagtgccaattgtgtgccaggcagtggcattacaacagtgaccgaaacaaagtcactccacttgaggacctgaatgtctagtcaaggagctagagagaaaacaaatatatcctctgtcaggtgggggtaaagcgcttctgatgacaaataatgttggctgagctatggtgacatttcagcagaggactgcacgagctctcccaggcttttcttgctctaaagcagtagttctgaaccaggggtgagtttgcagtaactggagatatttttctgccctacctggggcagggctgctgccaggatttcccattcagagtgatttgagaggatctcagtccacctgtaaagaggaaaataccctcttagatttgtagggccacagcctcttttgctgtgcctggaacatactggcagacacctttcctgctggggattttgcaaaatctggggacgtttttggtggttatgcttcggggaagggtgctgctagcatctagtgtgtgaggctggaagtgctgctaacatcctgcagtgtacagggcagctgcccacaacagaatgatctggctcagaatgtcagtagtgccaaagtggataaacctctagaaccacactccccaggggttcagtagactttcccgagtgggcatggaaaggtaaactcaactccctttctgcacgacccctttttctggcccatgagagcctatgctgtggccagtcgctgtgacagaatggttttctgcagggcatccatgctcacagcaggatcagatgccatcttcatgctttgacttgccaaggacattcaccaataaaatgcgcgttcagggagacagctgtcatgacacaacacgtttttcccatgacacacatttcttccgtccctctccaataacctcgactcttgaatgggtgagggacatttcctcaagagctgtttatctgggctttggggctgtcttgtgaattctatttaaaaatactcaaagtccctgagatctttggatctaaataacatactggaaccttcccgtcccctcctctccttggggctatggtaccaacagaagatgaaagctttatttcattttcaaaagtattttatatttctttattttgtaccctcttgataattgatcctcagctgccaggatttcccattcagagtgattcgagaggatgcccaggccacctgtaaagaggataatacactcttagatgtgtagggacacagcctcttatgctgtgcctggaacacactggcagacccctttcctgctccgagtatgcggtaagggggcaagaagctgtatggtggcttctccctggagaagcagcttcagccccttgtgctcctgcactcctgtgctttaagggcgagaacacattggattctttttttttgaggtggggtttcactcttgttgcccaggctcaagtgcaaggcacgatctcagctcactgcgacctctgcctcccaggttcaagcaattctcctgcctcagcctcctgagtagctgggattacaggcataggccaccatgcccagctaattttgtagagatggggtttctccatgttggtcaggctggtctcgaactcctgacctcaggtgatctgcccgccttggccacccaaagtgctgggattacagttatgagccactgcgcccggtgaccacatctgatgctgaaccaaaggcagctcttgggaggtggctctgagcctcccagccgcaaggtaggggagctcaaagatgttttaggagtaagcttgacaagagggtatcaggaaaaattgtttttctttgaatctccccggaatatatcatgtaattcacctcttgaggggtcctagaaagaccacttgccatcccaatatctagccagtcctggagtggacccagtcagagtgcatgaactgtgatacaaggcctatgtcttggtttttttcacctcctgcaagctaggagcctcccaactacccacagattggaagggacttggtgcagggatatggcttcgggtgacaacccacctatcagagctattcaaccattgaacagcatggctgtcagtctgaggtcgcagtgatgtcaggaggtggcagttttggcagctgacagccctcacagatgcccttgtgcagaatgaacctatcaagcattttctctactggctatgaaatggaaagtgaggcaagacattcagttgctgcacaggaaggaaagcagtcagggtggttgcctgagcgtccaggtcccagacaggtctgttctccatggaatacattaagggattgatttacctgtcttggagctgcttcacattgcagtagagggactgtgccgagtgtcatgcaatggccagttatcttgcagaacttgtttgtttctgcaattattaaaagttttcctggcagtttttttgttttgaccgagagtctttcctccaaaaatcattctctccatcctctcagaaccctggataattctctcctgtttgtcgtttgcataccatgtacctggaactcttatgttctggttaagtattctagcataagagagaggaagcaaaataagtcagcagaggatactttcagcatactgtgacttttagaatgttcagttagtgatactaacgtttcatagcctgtaccaataatcaacttttctttcccctgaagacaaagtagcatggttgtgacctatctatactgacttgttttcttcatgcatgcattcaacaaatcttaattgagtgcatgttatgttctaggcgtggggctgggctgaccctctgggaaatgacaagatgaaatgagacacattcctcctttcaagaaagtttgtgtggaatgtagaagatcattcattggttgaggagattgtaaactatcctggaacacagtggtttaggatgaaacaaagcagtgcacaaatgaacgctctagtcagtgaggctccattagaggttcctcaagggtggggactgcgttgagtgtcacgagactcctagggtcagcacagtgcccagcggctggtacgtgctttctaagtatcagctgaaatgctacagcagcacggcctagtggggagggagagagaaagggaggaagagaggggaagggattgaggaaactgacctagattatgggcagtgctggtcccccactctcagcccatgtggcttgggagaatgagcctgtctcttgatgctgtgaactatcaccaagagatcccctaccttgctccccaagttcaccaccaggcttctctccatctcagagcttattgaaaggacatggaatcctctggagggagttctccattgaaaacaaagacaataaattccaagtggcaaatctcataggtggccctgagtccctgtgatttttccagtccaccccttagttgaagtaaggcaaaatttgttttggggtttcataacagtgatgtaagtgcattgctttgaagcagtttttgagggagaggggaaaagcctgagttttggagaactacatttgtggaacccaagaaagtgatacatcttccctcctcccacccctcattgggggagatgacatggggcatacttccctatgtgctttagggggtctctacagaaagggggaaatgggattttgctccttgagtttgctgagggtaggacctgcagacttgctgtggtgccttcagagcaagagggaaagaacacagaaatagataccaccaaaagggatgaggatttcagatggcacacagagcctgctgagcgcatagccatgcaccgctgtgctgtgccttttcctctgacatccctttgcccacatataggagacaatccccttacaaagagccaagagcaagcctgaaggcttctgggagtccagtcggcttggaagtgagggaggaagctgggaaagagtgagcttaggtccgtgaacagtgatgagttcatgaaaatatttgaatctacctgaatagaaagattattttaaactagggaaaatttattttaaactggaagaggctgaaaatataaagtccactaatcttgtctgtctccatgagcttttacacatacgcacatgtgcacacacacgctcgcccatgtaatgttcacttaggtcaagatacagaccaacccaccaccccagaaggagctcttgtgcccctttccaatctctccccaagataaccattattctgacttccatcaattaatcaattttgcctattctttaacttaacataaatgaaatgatatgtgtacttttttgtgtctgactttcttctcctcaatataacgtttatgaaatttatccaagattttgcatgtatcatttttttaatgctgtgtataattccacagcatgaataaaccacaatttgtttatccattcacctgttgatggaaatttgagttatttctaatttttgtttttttcaaatgaaactgccgtgaacatcttgtgcatatcttttggtggacataggcacccatgtctctcagatggataagattcgaattataggttccataggccacatataggtaggcctatttgtatctttatatttgatttgttctattcttctgcccatgacaaaggtagtaaacagggtgtctttgagcagggaggctgaaaatgctctcttgtgagcagggtaagtagatggcttgtgctggtgcagaaaggcaggatgctggagaaatcccaggggaagcatggcaccagtccaaccagagactagggaagactcattaagaataactttttactacatgtaggtccagggaaagctgacatgggaataatgattaaaaggaatcaagtaaaggggcagagaggtagatttaagtaatggaaagatttttggtctgctttctagttttgtcctctagcacaatacgaaataattggctgtgggtatattacaggatcccttagatcttattgtctcatttataaaatataaaggctgtacagggtagttcctaaatggcctttgagctttcatcttctcataattgcatcaataatggcttagttgtaaatgaccaattctagtaataggagaaaatcgcatggaaattactgagaaaagcccagtttacttcatgctgttatcttaacatccacaactacatgtcgagagaatacgaaaatgtgttcttaggcttttccttgttcaaccagtctagccatgtgccattggtccttcaagggcagtggctgagcctcttttcttcctcccccactttttgctccctaccagacaaccttctcccataggtgctagtctgtttcctccctgactcgcattcctgcagccaatgcacctgctggtctgctggctgttgtttctcactcactgaaaaccagatctcaggatggacataggttggtggaccattttcttccagtcattcattcattcacttacagattaactccagttacagtcactgtagctagcatcacatacactaagctatctctcatactcttccagacattgcctaaggctgtggccacccagcccctgccctactgggtggagcccacacttgtgatatctcagagtgcttcctccaaccaaagaacccagccttctgcaggagggacacccctttccccctcagacagtcctgattctggcatattaccagaggccagtctttcctgatctcctcctatcctgagacgttctaggcctccttgagttccagttcgctctttcaagagctgcaccaaaacatctttacaacttgtgtttattatttgctgaagtttagctatcttaataaagaattatacttgtgatgaagtcagggccaggtcagtttgtctttctattcttggttcttagcttgttatctggtatatacaaaatgtttcatgaaaattcttcgtattgaagaaagggaagggttttgccaaaagccctactcaaggctgggaggtactgacgcattactgacacctagggataggctacctaaattgcagggtcatggactatgacaaaacagagtgttagtagtgaacatctcaggtaataccacataactttttaaaggggaaaggtcttcctaatttctataaatagttcaaactttcagacttagaatagtcctgcacttgtggcagtgccctcatagatccagaaagaactgatgttatctgatcttggggaaagtccccgccttgggtttgtaaatatccttactgacggtttctagacatttatgcacgacgttttgtcatgtgggatccagcacatatttctgacctggcgaaaactaagaatatctcaatcataaaaataaccagaaaatcataaaacagaaatctggcccaagattttctctggaaaagtaagaagctgctttgaaaggtgaaaatagaccagtgagcccccgcattggaacagattattccaaaaattgtgagcaaaggtctttttctgtattgtgcaagttaatctcctttgcccctttttgtggctgaaatgcatgcctaatctgcatatgagtgcctgccccaggtgggatggggcatgctgggattcctaaaattcagctggcttgcttgaagagggctatcaggctagatttcatgtctcaacaatttctagccggtctccctgagctggcaagcaccgctcagtttataatagtgcctggcacatggtaggtccagtgtttattaaactaacagatattcccaacaggtgtgggcagcagtgctgctaattagcagtaacatagccgcatggcagggacaggaaaggggagccttctgtgtgtccctactatatgcaatgtatgactccaatctcaaaagaagcagagaatactcagccaaatatttgcattgattcctgccaacaccatttttttgtgatttgtatgttcccttccccaccccccaccccctgtactgttaacttcatatttgaagggggttatacttttaggttatttgtgaattgagtcagctcatgtaacagtgattctcaaagtgtggtcccaaaaccagtgggatgggcatcacctgggaacttgttacaaatgcagattattgggtcccaccccagacctactgaatcaaaaatcctggaggtgggtccagcaatcagtgttataatgagcctaccagatgattctaatgcacattgaagtttgaaaaccaccattgtttaaggatcacaacaaatccaacagcactgtcagaagaacaactccttattctaatgggtcaggtgctttctgtgttggctgtcctgcagagcatctctagtgatagttgtattttcaggattagaggtgcaaaactaatgggagtttaagaaggaagtttgagcctttactgctgggagaatcacaagccaagtttatttctcttccattatttgtatggtagctaaaactgccaaggactactgtgatccattgaaacatcagtgtatcacatctcttcttacatctgagctggcattttgggtgtagtgcttcagtaacagttgtattcccaagcaaataaaatcttagccaccagaaatcttgagttggactagacaaaggcacctctccagatagcagctgttgttggaattgaatataagagatgcttaatcaatgtttgtgtaattgaatagaatgggaaatgaatggctcactccaaactttatacaagacagatgaaggcaacttcgatcttaacctttatgatacatagcattttgtactacccttgagaaaatctcagtctcgggttatcatagactcaattggctatcatgggaaattctgtctcagtgatgctccatatctatttaattgaggtttattatcaatttgaaaaatggaaaattcacctcacatattttaaatagccaagatagccagagtgtatgttgtggtttcaatatgtccccaagagttcttgtgttaggagcttggttgcctttgcagtagtgttgagacgtggggcccttgggaggtgattgaatcgatgctgttatcatgggaatgagtttgctatcttgggagtggggtcctgatataaatgatacatttggctgccattttctcttgtttcatgtgcttgcttccaccttcccccttccaccatgggacaatcctctccagatgcctgtgccatgctcttggacttcccagcctccagaactgtgagaaataaatttctttataaattactgagcattctattatagcagcacagactaagacagtgtaagaaagctcttatattataactctctccttctatttgtattcaggttttctcttaattctggaaagtttgggcagcagctgggaatgggaatttattataagacatcccttcagtgtctctacagaattgctttaattaaagtactttgttttatttgtccccatttaattataattcacatcagagaaagctattgttaaaatattttggttagttcagtgtggggaatgggattttccatcccttgaccttcatgactcagtaaggagcagataaaataattttctttgctgggtgattattatgcctcagggacaagtcatatttaagacctgatagtttgattcaagctctcataattgctgtgcagacagtgttcaaagccaaagtcttcctgatcataaggtgctgagaggacattcattttttgccatcattcagagctctgcaagagagcaaattgcttgttacttaaatgtgttacctttgaagaataaaaatctgaattgacactgctgttatttgagccttcaggtgtagggacttggagcacctatgtataccatggaatgtggcttaacaggactaaactgattccttctgcataatgtgctatatactgatttgcactgtatggagtaaaacctcttcaaccatatttgaaagattgatatttactctaaaaagcctataccttgatgatatggtaaaataatcaggttctctataaccttgaatactagtaagctgtttctttgccttcctaataacatgagggtttttagtttttgtttttaaccagcatttgagtacctactatgtgcctaatagagtcagagtgactcacattaaaattaactagagttaccaaaaatttgtccttcttacacaaatatgcaatgacaacagaatgattatcagtaataaatgtatgtgcacttgcagattactaagtgactgatttaccacaaaaaaggaaaggaacattacttagatttgttgctgtccactccttgtttttcattatggttcagtttggattttcaccacaattcagacatgaaaactattctttccataatgaaatcaggtgtgaggttttttttctcattcttttctttagaaaatgtatagcttaggccaggcgcagtggctcacgcctgtaatcccagcactttgggaggccgaggtgggcggatcatgcggtcaagagatcgagactatcctggctaacatggtgaaaccccatctctactaaaaatacaaacacattagccgggcctggtggcacacgcctgtagtcctagctactcagtggtacatgcctgtagtcccagctactcgggaggctgaggcaggagaatcgcttgaacccgggaggcggaggttgctgtgagtcgagatcgtgccaagagagactccatctcaaaaaaaaaaaaaaaaaaagcaagcaagaaagtaagaaagaatagcttatattttctattaactccaaccaagcaaaatttaaaatgctaggttgcactccttgcactccgtagtgcaacccaatagcaccatggctttttaattccctgagagagagatggtggacagggtgttctgggaaactgctgacagtaacatctgtccataccgaaagtcaagtgaaaacttggttcacatgagagcaaatgaaaatatgatgtttttaaagaggctgggaaaaagtcagagaagtgctcccactattttagatgagctcagcagcaagtttctagtaggtaagagggaaaatccattgtggggaaatgtgccaatgactgtttttggttaaaggtttgaatgggcacgatttagcagaactttacaaagctgtgtcttgaagagctttggaaaaacatttagtgttgttgtcgttgatgattttttttcatactctctgttgttcaggttatatgtgactgaaagaaagaatgatgtagtttcagttacttccatgacccaccccgggctagcacctccttcagccacatggtaaggtcccagaaacatttgatagagaccacatgaaagtagatgcttatgcagatgtgacttttgaaatacattcttcctggctttcagatgtgctattaattgcaggtttaaaagcccttttttgtttgatctgataaggtaggcttactttatgtcaccttaaaatgaggttaagccaagaattgcaagatataaagtattcaatgactactctccatttctgctgggaaaaagaccatctgcttaggtaattgcattgtaatactcaaacctggctgaattgcttctgtccctgcaaacgtctcttctgtcttttacattcacagtcatatatctctcctgcatgtagatccaagacccagtgtagccttttgtataatttgtaggattaatagactctgggtctggcctagtacttatattgtaggtctataaattatcataataacataggtataattgcaggtagagttttatatctgggtctgcagtggtttgatcattgactcactgagaacaattattaatcttcaactccaaggtaggacacacagttccaattggtacataaatagtacatacatttacattacagcagggggacattgtctttgaaagaacatgaataatacgttaaacctggaagctgggagggggacatacagtaagtgggaaaagagatattgcagaaagtttaaaaacagagaagaagaaaataaaataaataccaaagcaagcatgctgatatcttaaattaggtgcaaggaattctttttccttctgtgcctcagagctgcctctatgtggccatatgtgccttgagggggaaggagtatagtaagctttgggaatgatgattcttcatcttgcaggatgtagttgctcgtgttggctcaactcagggtaaatattctagatgattgatgtatgaaatcctaatagtatgccatttaggagtttgtttaccatcagtctccacattcagactttttcttgtgggtttgaatgttctgtagtttctgtaatattgaattcaaaggtttgcttttgattggactttcctaattaaaagcaaatttattgtccctacaccttgcctctacttagcccaatctcacacaccctgtgaggctttttcccagatgttatttctccttcttgaagcttcttataggcagaaactggacctcattcatctttttatcttttacagtgctctcgcaaatatttattgaataaataaatgacataatttatacagtctgtgaggcttacaaataccttctttaagctattagtaaaacaaaagtactggcacaaagtgatttcttgttcatataacagaagtattttactttcaaacacacacacacacacacacacacacacacacacacacacacagaaagagggagagaaagagagagaagcccaacccaacaaaccacttaagggaaaccatgaaaatggtatctttgttgagagttaatgagtttatagttaatttatgctttccctggaatacatattatactcattatgtacaagtaaactatgactgtttttacacctatcacagatattccagatcttaaaatgctctgtttgaaataaaaggcagaaggggggacttgggcatattcccttatagttattcttgtgtctcttatggaatagatgcaaaaaagtctaatttgcctttctgtcacttggcaaagtttattatttgcttaagcacaagaagataaatgttttatcctactggcaaaaagtattgtttgcacaaatgtaaaattctgttaaatgtatttatatgtattgtcttagtcagggttctctagagggacaggactaataggatagatagatgtacatatgaaagggagtttattaaggagtattgactcacatcatcacaaggtcaagtcccacagtaggccatctgcaagctgaggagcaaggaagccagtccgagtcccaaaacctcaaaagtagggaagccaacagtgtgcccgaaggcccaagagcccctggcaaaccactggtgtaaatccaagagtccaaaagccgaagaacttggagtctgatgttcaagggcaggaagcatccagcgtgggagaaaaataaagaccagaagactcggcaagtctagtccttccatgttcttctgcttgctttattctggctgtgctggcagttgattagatggtgcccacccagattgagagtgggtctgcctctcccagtccactgactcaaatgttaatctcctttggcaagaacctcacagacacccccagtgacaatactttgcattcttcaatctaatcaaggtgacactcagtattaaccatcacatgtatgtttctatttgagtgtttctgtaaatgacatgctttagtttttgacaagtcaaatcctaccaaaataccctcatagaaaactcttgatgagagtaatggttatatccaagtcctctcaataacaaatttatttcaatcaatatttaatatcacaaaataacagtatgacaaatgaaggatagaatgtggttaactagtgtagagtgtgaattatttggactggattgtgaagtagatgtaactgatactcatggatgaacttgcagtaattatagataataaaaaattaccagccaagtgctgtggctcatgcctgtaatcccaacactttgggaggctgaggtgagcggattactgagcccaggagttccaaaccagcctgggcaacatggggagaccccatctctacaaaaaatgtaaaaagccaggtgtggtagtgtgtacttttatgtaatcccagctactcaggaggctgaaattggaggattgcttgagcttgagtcaaggccgcaatgagctcaggccactgtacttgagcctgggtgacaaagaccctgtctcaaaaaaaattataatgcgtacataattttttcacacatcaaccactttcctaacaagtcattgatcctcaaaataatcctgtgagtattattctcttctatgtaaatggaggaactgagtatctaataggtgattgccacatctaggcagctggcgtggagggtgttgaagatttgagtccggtgcctttgaccccaaagcctatggctggagatgcctgccaaggcaaaactgcccttaccaaagcagattttatcagctgatcccatttctctctcactaaactgagtccatgaatccttctcaatgtagacaaaatctatctgctatcctgacctatgttatttctaagtgtattttgctgggcattaacgcagatggaatacagccgagtttgcgtaagttctgtatagtacaccaccaagcaccttaacaggagcctgcaaattgccgttgagggaggtaacttttagcatctgaggctttgatgtgtttatcttctccaggaattttgttttgcctcctttgggaggggagaggtcttctgctaagcatctacttcctttatttcttactgcacaagaacttcggtctaattggccaactttgagtgtgctgaggtgacctatttctgtctgggataataaaaacattccagatgactgacgccttttactggggacaatttgacctgattctaaccctcctgctctgcctgccaaggaagatgattactacaggccttagtaccgacctctatttacttcatctactttttttttttcattttcttgcaaaaatagcaggcttgtccaagtgcctagctactatggcaataagtgctatttaaacagatgccgatgccgaatacatgtgtcccagcttaaatgagtcagtgggagcagttgtaggatctgattgcataaatgcatgggaataatgtctgtctctggggcaacagaacttcttttgagcccttgagaggaccagttcagttgcagaaaggctgatgtaatgatcacacaccttcaggtgaaagggtcagtttctccctgaatggaaagtgtcaaaaaatggccatttagactttctgctttgtaactagagcaaatgcctcaagaaagagaaaatgaacaggaaagccctcaaaagctttaaagggcttagaaaatgtaaagccattattgttggttattcaaatatccctctgattcaaatagatgcattgattttttaaaaaaatctacagttaacatcaagaaacttgagcctcagtaaatgagcactgccttatagaatattgctgaatatgtcttgaataagttgagaaagcacttggctgtgtataactactcatgtaaaatgctattggcacaaagatgacatttttttcaaagatgcctctatcatgtggctacaagtagattgtgctgattctattcctctacaaagctcagggtcacaggtggtctattagtagttgttggttgttagctctgccataagaagatggcatggttccttaggttagatgcattcagagttggtggtggacttgagtgtctacttatgcgcagagattttcagtcttttatttccatcttgacagtagacagagaagcaggggacaggcttgaaatttcagtcaaatatcaatccagcatgaaggaggacaccctgattttaaacacccactaatatttccttggaaaaaaaaagagcctaacacatctctggctccagctcttctctcctcccctcccttccctcagcccccaattctcttttcttttcctgtcttcagaatatgtgaaatgggggaaatcataaaacagtcaatcttcattattcacagtttccatatttgtgaattcactacttgctaaaatgtcttcgtaacggcaaaatcaatgctcactgtgcttttgtggttatttgcagacatgtgtggaacagtgaaaaactggagttgttccccatgcatgtttctagttgaagttaaaccaggtgacagccctttttgtttcagccctcatactgtaaacaactctcctttttgtggtcagcttagtgccacattttaaaacatttttctgcttttttttttggtgattttactatttgaaatggtccaaggatagtgccagcctactgtccagtgttcctaagtgcaagaaggctgtgatgtgccttgggaagaaatatgagtgttagataagcttcgtccaggcctgagttgtagtgctgttgctgtgagtccaatgttagtgaatcaacaatatatactcaataaacagtctttaagtagaaacacatgttaaacaaagttatgtatttatcagttgatgaaaatgtgaccagaggctcacagacacctagccctgtatctctccccagagcaatgcttcagtatttgctcagaaccaccacaagtaatgagaacaggctaacctaccccttggagttgacgtgaggatctcatgagctaatgcccctaaaatgcatggtgccttacagtgtgccccataggtgctaactatagcagttatcatcatcatcatcatcatcatcatcaatgaaaatacgggagaagaaaaaattaccaataatcccactattgtacctcaacaactctcttcattttgggtattcccttcagtcattgtttcgttgcattcacatctttgtataactgcattaaactgcatacaattttgaatatttctttgctatcattctgtcatgtgcatcaccctgtgttgcgacacagcctccatttctgtggtcttcttgatggaaagcggtaaaaactttgttcctgggctcatgtaagagcagctctcttcaagcatagggatgacttcattgctcacgacaccaatatgccttaaaattctgtgattaattgtaaaaaagaactctctctgaacactacagagaaaactctcacagagcagagaaatttattatgtgatcttcttctctccagaggaaaatggtgtgttttaagtcagaaggtttgggtcattattcagtagaacgaggtgctcgagggattacaaaagaagagtaactctaatctttgtgagagtgatggcctaatacaggtgttagcaaacatttcccgtacaggctcagatagtaaatgtgttagaccttgtgggccatatgatctccattgcagccactcaactctgccattgtagccaaaactatggataatattaatggataatattaaacaattgagtgtggctgtgttcctataaaaccttatttacaaataaggcacaattccaaacaaaatagatctgaacaccaaagtgggcagttcgtttattgctttattcttccacaaaacttctagtatgttaggccttgtcctggttggcagtaacatcagcaagagtagcaaaacatttttctatgcctcatgaagtttatagtctgaagggggagagagcgatcttaataaaataattgtataaatgaatatataattgcatgtgttgataaatactgcaaaggaagaaaacagtgggaaataggactgtgtcagatattcaggcacgaagtttagggaaggggctgcactttgaggtggccgccagacactcattgaaataagagggccttgatcattgtgcagtaagtgatttttattaacaagaacttagtcattacatacctagctgtaagtagatgctagctctgaagaatagattttcggtggtcagtttggcattcaaccaggaccaaaagagaatcccctcattcgctgacttggggctggatttatgagtgtcgtcactccctttgtattttctttttttgtcttattggtctttctaggcagaaatgaataccacatggttgagacacgcataagattcaggtccatcaggtcttgagcatctttctggtaacttaaacataagccaggatccacatatctaacggctacatgggatatagggcctcgttcataaaaacgcatacccatacttcttaatatgcccttgcctgttcctctttagttctctcaccccctgcaaatattcttcctttttaaaccctcagtttcttcaccaaactttcccagacaacctatccccaaggactttctttatccctctttgccagccaacctgtgtaccccttttcttctggaggtgcactgaggacttttccctcctgcctgatcatctgggcctctctgggctacccgggccttgcagcttcatggttcctccctgagcctctctccctagggagggaagcacaaggaactcactggagtgggcagttctgttcacaccctggtaaatgaaatcctctgcctcattacactctgcagacaatttcagcatccagtcatgcttatttcttgaaggaaaaggactgtttttccaccatttgggtctatgactccactggggattaaggaaagagacaacattgtggaatgtgtgtgtgtgtgttgttggagacagcttttgcttgggctggtatcatgtctactccaggattttctgaagtgactgtgggacaggaagaggcccattggtggctacttagcaacaccaggcccttcacgggcagtggaaagtcactggggtaatgccccagaccctcaccctcaacaggctacacctggacagagacagggcacccttatggggctttcagggatgagatgtgttcatccacaaataagggagaagcacagagacttctacaagtatgtagaggagaatctaggagatacaatgcaagggctgagaatttgggatatacacttattactgttggtgtggtcctagccttacaacaggttgtgcagcccaccaaagcatggattacagtgttaacatgcagaaattcctgattgtacctcttttccagctgttcaatcctacatgaggcctttcaaaacccctgtgatttcttacgattagagatgtaggctgtcccatctagtaaatttgtcaaaccactactgggtatcaggtagaaatagagttccctttcatcactagcaatatgtttcttttctcaatggtttgctctcctttgctcattttccatggaaggtcttcattactcctgtattttaaaagctatcttgtcaatattattccaagcgaatttctcagtatattttaaaagggaaaactaataatgtgatcctcttgcttaaaaccctttacagcttcccaagagtgttagaattaatggggctggtactagcatgcaaaatttaagggaatgtcaaaaaagtcagtagtcaagataaataatatttaatgcactattttaaaaatgttcttggcaaactttcgtccacacctgcgtttgtaaatgaggtttcaactcacaccgtgcatgtgacttgagaggccactgcagcacggccaggcctcagtgcactctctggcctcaacgtaactcccttgaccttccatgttgtattagtcctttctcatgctgctaataaagacataccccagattgggtaatttataaaggaaaaaggtttaatggactcacagttccacatggctggggaggcctcacaatcacggcagaagatgaaggaagagcaaagggacatcttacatggcagcaggcatgtgcaggggaactgctctttataaaaccatcagatctcatgatctgtgacttagtcactatcacgagaacagcatgggcaagacccgcctccatgattaaattacttcccactggttgcctcccacagcacatgggaattatgggaactacagttcaaaatgagatttgggtggggacacaagccaaactgtatcatgtaaccaaatatgttaagctccatccatgctgactttggtggtcatgtccatcccgggcctttatatgggttgtcccctttcttcacatctctgctgagctggcccctgctcatccttcagaactcgatcaagtgctccttccctcttgttggccaccctgagccccaaggtgggatcaggctcctctgctaggtgtcctcagggtggtgcgtgggggtcgttagtgtttgtccttagaatacctggcaagcagacatgcacgtgggtcattttgtttattaacaccaaactcctccagttgattataagctccatgagggcaggactgaatttgtcattcttatcgcacagtggcttacatgtcagtcatcactgaacagttaatggtcatttgatctgatatgcttctggtataatttcatgatatcagatctggagacatgaagtcattgttttcctggtggggagtgtgacaccaccatcttgttcaccatttgcagagttctttcctgtcttcgggcaagtagattaggttatatcgttatctctgtttatagctgtctcaaataaatcctttagaagagggagaaagatggtacaaagaaaaaagaagccaaggaggaaagtgactctcagagatgctaatgactttcccaggaaggctgtcacacagcaagaactcagatatgggttttacaactcagaaactcatcctgttctaggccccaacctcactctctcaggagaaggtcctggaggagattcccctctcactttccagaaaaaggacaaagggaattaggaatcttttcttaacattaacgccttgccaatttctagacctcccctcctgctcctcccttaagacatcctatttgcacgtctctgctcttagaggctattgggtttaagcgccacaataaataaaaggcaataaaataaataaaggcaataaaagatatctcctggtaggatataattttctttctttcgttcactgtctcagagttattttatccttttcaccacgagggactcaattggaactggctctcttattagccttcaggttcaactggcttccatggaggcattgtctcctcatagacctgttcacttgacagaccttcacagaagtttcatcagtataaggacccaaaacaccatctaaatggcttcatccagccatggcagatgccctttgctgctgggttgggtttttttttttttttctttcttttttttttgagatggagtctcactctgtcactcaggctggagtgcagtggcacaatctcagctcactgcaacctccgcctcctgagtttcaagtgattctcctgcctcagcctcccaagtagctgggactacagacatgcaccaccacacctggctaatttttgtgtttttagtagaggtggggtttcgccatgttggccaggctggtctcgaactcctgacctcaggtgatccacctgccttggcctcccaaagttctgggatttcaggcatgagccactgtgcctggccctgctggttttacttctgcctgaaacccactggggtgaaaggacaggccttggaaatgttgcattagtagcaactgctccctctaatgggaggacacatcccttccccatagtcagtgcaggagtcacagaagcttgagcacgacctcaggaatcggcttccattcattcattcaacccatatttactgagccccagtgtgtgccgggtacttctggacccttgggatatgaggtgaacagctcacagatccctgccctcctggagtttacattcttatgagagaaacggtcaatgaatgagtagtcaaataagttttacttccagtaatatgtggtatggagaaaaagaaatgaaggagaacagagataaagtttggtgatggtggaaggtggcagacagggtagccaaggaaagccttgcaaacgaggtgacatttgagcagagacatgacatgaagttctgggagaaaagtttatcaggcaaggtatatggctggtagaaaactctgagtccaaggcaaagtgactatccacaatcagccagaggtcaccatggctgggaagcatggcaggaagtgggaccagggatgcatgcaaaggccaaaacaggagggagttcatgctgctcatatctgttctggaaggacactggagaaatgtgtgtgaagaggaacatgaactgacttatgctttaaagggaccattctgaccgtcatgtgcaatgaatggagttgaggggctagtcaggagtagggcagagagatcaggtgagaggctcctagaataatccaagtaaaagatggaggtgactggattggggtgttggcagtggaggtggtgaggaacggtcggtcagatcgtcatgtattttgaaggcggagttcattcaccattgttgctgtaccagttgtgggctaggaaagaaagcagtgtgggtcaagcatcactcattcattcattgacacatacttgttgaatacctatcatgaacctgcccttgttctgggtgatggctataccggtaaacagaatagtcaaagcttcctgcccttgtggaacttacactttattattttatttttatttattttgttgaaacgaggccttgctctgttgcccaggctggagtgcactaatgcaatcatagctcactgcagtctcaagctccttgggctcaagtgatcctctggccccagcctcccacgtagctggaactacaggtgatgccaccacacctggctagtttttgtagagacagggtctcactatgttgcccaggctgatcttgaactcctggcctcaaatgatcctcccaccttggccttccaaagtgctgggattacaggcgtgagctactgtgcccggcctggtttacattttagaaaaagaaacagaaaataaaggtaaaaaaacaataagtgaattataatacatgttcagaagatatttgttatggtaaaaagaaaaaaatagagcagaagagggaccctggggcaggggagcagctgcaattttaactagggcaaccaaggtgggtgttcttaaaaggtcgccaggttttgggccctaagtagttagatggaagctaatactactatttaatgagaggtctataaagattacacaaataggctgggtgcagtggctcacacctgtcaatcccagagctttgggaggccgaggcaggcggatcgcttgaggtcaggagttcaagaccagcctggccaacatagcgaaaccccgtgtctgctaaaaatacaaaaattagctaggtgtggtgacacacacctgtaatcacagttactcaggaggctaaggcaggaaaatcgcttgagcccagaagtcagaggttgcagtgagccgagatcgcaccactgcactccggcctgggcgacagagtgaaactccatctcaaaaaaaaaaaagaataaagaaataaaagtgggaagaggagcaggctggaggttagggtggggtaaacaagctgttgtcatacttgagtccttgagtattgaatttgagctgtctcttagtgacaataccaagtagatagttggatattcaaatctggggcttaggcagaggccagggctatgtatatacatttcaaagtatcagagtctagaaggtctttaaagccataagaccagatgaggtctacaaggatgagagtggagagagaaaaaagagggcccagggccaggggctactgagtcctcagagtagagagaagaaaagaggaattagcaaaggagatgcagaaggaatagccaggaaagtgggagaaaaatgaggcgcttgaacgaagagctgaagaggtagaaagcaagtcacagcgctcaaagcagcaggtgagatggtgagtgggttgggaaagtgactaggagaactttttataagcgacttcctgagcagcaagtgatcaagttaccctgttgttagctatttgacggtggtgtgtagagtcacagaaaggtggcctctccctgtgtgcccacggaaacaccagggctgagccctttgcgtttgccagtgttcatgtgttcacttaagaattaatattattctccaaggcaaggcagtgggtacagatcgcagaagagtcaataccacacacaagattttgaacttaaatttataggcaatggggatttagataaagtttttcagcaggagagtgacatatgtaacctgttccatgtaaatagtttggggagcagaagggaggatgagttggaggaaggagaggtgatagggaggccattttagtagtggagccatgaaatgggggagggggagactgaaccaaaggagatgcagcgagaattcgaaagcagagatgcgagagacacggagaaggtggacatacagcctctggtacgtgattgtgggagggtacaatgagaggaacattgaagaccactcttggggttctatcttgtgtgactgggggatggagcccactgtgggtttttgctgggagatggagaggagaggctgtcagattaaccagtttatggattaattattaagaaacagcagggacctgggatttcccctcctcactgattagttagctggtaattaggcagtggctgagaatgctactgtctgtcccccatcgggtgggaggagcagagctgagcctccccacagttgctgtggtgcatggagtggggacctagaatcactgctatcacgtgacatgccccctgttcctcctgggaacccaactctgaaggggtcttcttgacatccgattttctccttccagagctcttctgaagttcttgcctaatgaagaaaaagcaagaaaagggaaaatatgtgtaccacagaattttccttctctctggtggtgttttgcaaaaatgccatggcaactttcctcttcaaatacttgggatttgtttctcttgcatctgtcaagtgcacatcaaagttgaattttccactttggaattatgatttgtattctgcttctcccatctgggcttctgttctcctgaaaactgcctattctactgtgaaatgagcattccccaaggctgatgtagccgcttcatgctaagtgttgatgggaaacctgaagctgagttgggcaaatgtttttgagatctgtaaattccccagagacttaaattgcttgaattattgagggacattttgacctcttgttggaccaatgagaatgaaagaaaagattggttaaatagaagaaatgttcagaatccccctcagccctccaaattccaaatattttcttttttctttctttttgtttcttttgagacggagtcttgctctgttgcccaggctggagtgcagtggcacaatcttggctcacttctacctctgtctcctgggttcaagccattctcctgcctcagtctcctgagtagctgggattacaggtgcacgccaccatgcctggctgatttttgtatttttaatagagatggggttttactgtgttagccaggctagtctcaaactcctgacataaagtgatctgcctgccttggcctcccaaagtgctgggattacaggcatgagccactgcacccggccaaatgttttctagttaagttcatatacccatgccagagtgcctagctcacacttcattataaatgtctgcctcaaacagaagtcctgggtccatgtttccactgtcctgcgagggatacacaagaacacttggcaaacgaagaagggaaggcctggggctacagtgggtagggagtaccagagacccaggggacaatatatgggttaaatgaggactttatttaatagtatttttaaaaattaaaattgtgacaaaatttaggaatcagtaattatttaaaaatccaaatattctgcttctcttgaaaaatcagaagacatggcatctcggggcccaaatttctatttggcagttttcagctggaggtcagctggtgtccccctaaactcaaggcatgtggtccccagtgggtcacgcccaccagaatcctctgctgtcttgatagctctgaggtccttcagggatcactggggaatgatgttctcctagaagactttctggatcctccaggtccaggttagatgctaaccaatgctcttaaagtagctatagcaacttttattaatatagataatattttatatttttcatattatataatttttgttattatattttaattgcttcctgacttatctcagtcctcttcagtataatttagtctccataagaataagtacttgttgtgtttgttattaatctccaacatcttggctgggcgcagcggctcacacctgtaatcccagcattttgagaggctgaggtgggtggatcccttgagctcaggaatttaagaccagcctggtcaacatggcgaaaccccatctctacaaaaaataagctgggtgcgatgctgtgcacgtgtagtcccagctactcaggaggctgaagtgggaggctcacttgagcctcagaagtccaggcttcagtgagccaaaattatgccactgcactccagcctggcgacagagcaaaaccttgtctaaaaataaaaaattaacaaatctccaacatcttgcataaggcccaggccataagcagacattcaaataaattaatttactaaataaggacaatagactaaataatccctggggtccattttagttgtactattctattgctctgatgtttctctttaaagaaacagattcatgggttttctattagagtaagacactgtatttgtctctacacatacctgagtaagaatgctttgggttagatccctcttttttggttcgtaaaactagagaagagaacagatggaaaggaccttgaagttcagcttcctaatttgcaggtggagaaacaggctcagagaagatacgtggacttccttcgagtcatatagttgtaacccaggttaggacatgtgcctccagggcagagtccacctgccttggtctctagtctgaaggaacaaatgaccagtgtggtagataagaacaaagtatattcaaagcctataaaagaaaagagacagagagaggaaagtggtactagctgacaaatgtcaccttagtggcaaaaacagtaaataccgtagaggtttataggacagaaattacttcagaaacgtaacaaggtttaagcaatccagtgtttattagcaatggttctctgactggggtgtccaaatgcattctaaggggactttgagttccctttgaaaacagtgaatgtacaatttcagggattttcatcatttctgtgagggagtatgacactttcctggccattgaaggggagaagggaattgatttgtaaatgatgtgtatacacaaagtgaaggcccagtgatggaatggtgatggtttgcagtagtttggggctgtggcaattagtgacattttgtttttacattataaacagtgatgtaattggagtgaaatgccattatccactgcgtcattttaatgcagtcaattgttactggcttcgtatttagtttttacacttatgttggtgtcagaattatagaagagttgtaagcaaaagcactttgcatctagttgtgttagttttgtgtacattgatgcaacattgcaatgaaagtaatctaaaacaatgccaacagtccaagagattttatctttcttttagaaagagtctatgcattattcaagcttgttgtgaatgctgacttcctatagcacttgcatttaagttatgagaagttattggcatgagagataatttaagtggcatgagctcatctgctgtcactgcatgaattacttgggaggaacttggtgtgggagatgtgatatgctctcccctcagtaggtggctgttcccacaggcaattctagattctaagataattctgactattgttttattgactttagaaccagatcctttgtaagatgttatgatgtacagggtctaagtggtggaaggatgtgtctttcctttaatgtgatataagccagagttcagcaaactatggcccatggaccaaacacagcccacagtctgtttttgttaataaaattgtattggaatttaggcacactcatttatatacagatggtctgtggctgctttcacactataaatccttagtccaatcatttcgatagagatcctatggcttgcagagtccaaagtctttattatctgacagtgccctaggacccagggtctaaatataaccatttctgcactgtgctttcagcttctgtgtattttatttgtttctctaaagtgacctaattaatctgtcctattgggataattagggaattctagatggttgttgctttgtggaagattccgtgatttctctaataagggaatctagtctattctcaacatagattcctactttcttaaaataggatgctagaagctagcaagatgctgtttgattcaggagccccacctgccagagctagcctcaggctgcactgtgaatgagccacttgtgtttccacccgtccgccctgcttttcggaacccgcttccttcatcatgtctttgcgtcactgccttttcactccatcctgcctctcagtaacatcagtgaaggctctgatatctcacttttaccaccatttaagttcacttcatttgtccacttcttgcttcttccaagggtgtttgcacttgaagctttttgtccccactgtgtataggaagctttgccttccctgaaaggtttgaccaactcagaggagtggagggagaagggatgagggggcagcacaggacggggagtggtagggacagggctgtccctggaaacacacagtcctcctcagtgactgcacggctcattgcacctcattcctgggttgctgtacagatcagagtctacctcacctcaaaagccccacagtatttgttaaatgtctgggggattccagatacttaacaaataatctttcaatgtggtcgacttatttagggaacaaacacaaaaagactcacacaaaaggcatgggagtcaaatgctctttgggatacttgactggagagggctttctacttacacgtgcctagggaaatagtcaaaggatgaggggggttggtatgatttagggacagttcctagaaggagatacttactcctgaatgtgctctgcttaaaaaaaaaaaaaaaaaaaaaaaaaagaagaagaaaagaaaagaaattgtgttgggcgtaaccacagccttcttagccagcctgagttggcattgctcaccctctgaggattaggtcagccacagtgagctttctcaaggaagtggtgccttggggagcccgcgttggaaagcaatagcagatggctgccgtgggatgtatatggtcctgcttttttaatatgtggagaaaagagacctgcgctctctgtatgttcacatatatcaggatcattatatgttaattgcttattatggcaactgatgatttgcctcctgtttcttatgtgttctgtcagttaacatttattgggcacctactatatgtcgatagaatctgcacagtggcaggtaaagttttccctgtctttaaagagctcaagtctgataagaatgacaactcatgaataattgcaatctaggatggagaaacgggggaattctcccttagaattatatccccctcattgacttcacactaaattcgactttttaaattcagcagtgattatctaaagcctgagctgttcagattgttaaataacagtactctaagttaatctacaagaatcttaattaaagaagtgaatttgggtatgttcaaattataactcagctgaaaaacagtttctctactatgcattcccctcaccaatcccacttcccaaataaactgactgaggtgggataaaagggtccagactagaggatggcaaactccagccccaaggtcaagttacacctgccacctgtttctataaatagttctcctggaacacagaaatgcccactcatttacataatgtctatcatctgtggctgctttcaagctacaaggcagaggtgagcagctgggacagaggttgtgtgtggccagcaaagcctaaaatatttactttttgtatcacaggaaaaaaaaattgccaacccttggtctagagtaaactgaacacccataaaaagtaaaaacaacattattcaccacctctgactggcaaaatgacttaagaaccagcacactggtacattttaatagcagttaaatctagacacatttggatttaaattgaaatccaatatcctcctcttcatgatgaagtattaacatggttagctagctaagaaatatttgaccctcacgtacttaaaatatctcttgttttggtgtttgtgtacacaaattagggaatacaaattatgttcatgaagtaagtcatcttcaccaacggaaagaaatattctccaaatcgctgagaccatgcatcaaccctactgcacagttagaagaagggccacattaattacccgaggatacagaatctcttaggaagaggagtggccacagagaacaagagcatatatagtgcatttcagagaagtttctcctgccctccagattcccctgtggacctactctgagtccattctgcaagggggcatttctgcatttgagcagctcccgttcttacccattacacatccctgtgtatagggggcttcaggaagaacttacacaaccaatcgatggcctcagtttaatataacatttaaaaatatctcgctctcctgattctgtagccaaactcagaatcatcaaggccacttcctctcccaggagagtaagcaaacttactgcccagatgtcccccaaagtgtctttgccttcaactttgctgcaggctggaaaggctgtttctctacaaggactggagatgcaaacccttggaggggagggtcctggggagggcaggcacgtgttaaaaagggcagtagatgaaagcaaatgtggctgcaattgtccgcttctgcttgaacagcaagtctgtcccatgctataacagggattctgtaggatggatcctgttttttgttttgttttgttttgttttttgaggcggagtctcgctctgtcgcccaggctggagtgcagtggcgccatctctgctcactgcaagctccgcaggagaatggttcacgccattctcctgcctcagcctcctgaatagctgagactacaggcgcccgccaccacacccggctaattttttgtattttttagtggagacagggtttcaccgtgttagccaggatggtctcgatctcctgacctcatgatctgcccgcctcggcctcccaaagtgctgggattataggcgtgagccactgcaccctgccctgatcctgttttttagagaaagtagattgttaatccgtcactttatgtattgtctctaagatagcatctatcatgtatataggcacaaatgcatactggagtgaattcataaattaatagatgaattaagacctcagactctggagacaagcaaaattgagtttaaatcccatctttgccagttaatagctgttagttatctatcgctgtataacaaattgtcccaaatttagtggcttaagttattatctcacagcactgtgggtaaaggatctgggtttggctttgctgggtaccaaggctgcagtcatctcaaagcttggccaggtggggaaggacctgctttcaagctcacacatgtggttgttggctggcctcaaatccgtcatggctgttggctgacctcaaatccatcatggctgttggctagagacatcagttccttgccacctgggcctctccaaagggctgctcacaacatggtggctggcttcccccagagaggggaatctgagagaaagatccaagatggaagctacagtgtttttgttttcactgggaatgtgggcaaggcattgaaaaagatttttgtgtgagtgataaaatatacacaacattatttgctattgtaacctttctttctttctttttttttttttttttttttgagacagagtcatgctgtgtcacccaggctggagtgcagtgatacttccttggctcactgcaacctccacctctcgagttcaagagattcttctgcctcagcctcccaagtagctgggactataagtgtgcaccaccacacctggctaattttttgtatttttagtagacggggttttgccatgttggccaggctggtctcaaactcctgacctccagtgatctgcccacctcggcctcccaaagtgctggggttacaggcatgagccaccacacctggcctattgtaaccacttttaggtgtgcaattaggtggcattaagtatattcactgtgttttacaaccatcaccactatttatttctaaaacttttcatcaccccaaacagaaacttgaagctacagtgtttttgcaacctaatctcagaagcaacataccaccattctgttatattctgtttcttggaagcaagtcaccaaacatagcccacaattccagggggagggtatcttgaaggacaagaagaccaggaggaagacatcctagaaggcagtcccagaagctgcctgccatacaggctatgtgaccttaggcaggtagtaacctgcctcagtttcaacctttgtaaaacaaggatgatatcttagtctgttcaggctgctataacaaaataccataaactgggtggcttatggacaacaggattttatgtctcacagttctagaggctggaaagtccaaaggcaaggcagagtctgtctggtgagggcctgcatcctcacaggtggcaccttcttgctgtgtcttcacatgatgaaaggggcaaggggtctctctcaggcttctttttaagggcacttatttcattcatgagggctctgttcccatgagctaatcacctcccaaaagccctacctcctaatgccatggcctaggggttaggatttcaacatatgaatttcggagggacagaaacattcagacctagcagatgattttgcctgcctcatagtgctgtacttatatccagggggagcacccccaagtttctactctttaatataagattaaatagatggccccaagccatgatgtttggccaccatggactccaggcagggttttcctgcacggcttctcagatcttcatggtgcttcagcagagatcacatctttagatctctgacagcatgagcagatagagggcagagcagaggcagaactgtggcaatacaaaatatgattcctacatcttcttcccagtacaatctttatggggagcagagcttcctgtaaggaaggagaagcctcccctggacagtgttgagctcccatgtcctcatcatatctcctctgggagtggatccacccctccctcagttgctcacattcaccaccaagatactatccttgtacccattatggtttattctctttcttccatgcacattcccagtatcactttaatgtgtccgccctctttcctggtgagctgtcctgtgcagtgaataagaaacagttacttcccctggagggcttgcatatgactatgcaacgtgcaagcaggctgcttttaaaactattatttaaaatttttcaaaatggtagtatctctttccatccttgtcccctctcacaggtcaaacctaaacaattcagggtctcattccaaacaccagctcatggatgtgttctgagccatcatatattccagccatatctttatacttctgtggtcctgtggaatagtaccaatccagatccttaattagctgaaaattaattcagatgattgcatatttaagccaaagaaataaattaatattgtgtgcaaaggtttctggtgatgagtattttggaaggactgttaaacacatttgaaataaaaatagtttactggctaaggctcagaaaaaaacaaaaattattactgatcagtgttttctaaagtgtgttctgcagaccgaaatgctgtttatttgcccactgaccaaaattacattgataatctgtactaatctcatcagggttgatgagaatatggtaaaacagtcatggactgttttctgctgggagtataaattggacatgcctctaggcaagcaattttgtactatttatcagaatttaaaatgtatatgccctttggcccagcaactctacttctagaagttaatcttaaatcattcttgcacatatatacaaggggctttattgcagtactgttcatagtaagaaaacgttggaaacaacttaaatgtatgtctataatagaccaggtaaatcaattataatatgcctctactcttgaatattgtacaacagtcaaaataatgagcaggcttggtacaggggcttatgcctgtaatcccagaacttcgggaggccaagatgggaggatcttttgaggccaggagttcaagaccagcctggtcaacacagtgagacccccatctctaaaaaaataaacagcccacctgtatgtattcacatggaaagatggacatagtattttgttacctggaagaagcaagtcgtagagcaatattttaatataattacttctataggaaaagatatatacatatggtattatatatataatttctgtgtgtatgcacaatattgtgtgtgtgtgtcacacacacacagcatgttttcatgctgctaatacctgagactgggcaatttacaaaagaaagaggtttaattgaacttacagttccacatcgctggggaggcctcacagtcatggcgggaggaaaggaggagcaagtcacttcttacatggatggcagcaggcagaaaaagagagtttgtccagggaaacacccatttttaaaaccattagatctcatgagactcattcgctatcatgagaacaatgcaggaaagacccatcccataattcaatcatctcccactgggttcctcccatgacacttgggaattgtaggagttacaattcaagatgagatttgagtggggacacagccaaaccatgtcatatatgtatatatataaaatacatgtacaaccacatagatttgtttggaaggatacacaccaaactgttaatagtggttattcttcctcttgagaaagaaatagaattttctagagggtaggagggttgcttcctgctttgctgtgtatccttgcatattgtttgaattttttataattagtatacattgcttctgtaatttatgaaacaatttaaacatctcttaaactcatagacataacatatttatttttaagcaaattaagaaaaagaaccatgtaatctctctgcccaaatgtaattactattaatcttccatacctttttctatagatgtattgtttgtttttaaaaaatgtaatttttccatttagaccattttgtaatctgctgcttttatttcacaatatgggataaatgtgattattccctgcatatttatgtgccagtagatattcagttatatttctaatgacttcaatgttatggtttttaggtatatgagattactggaaactaggcatttgaaatgggcaaggtaaattcctagtgcaatatcctgttacctggcttcttgctttcatcttgttcatccgtacatctagattgtccaccctttatgcctaatctctgtcattgtcttgaataaaattttccatggctgcccattgccctcaagataaatttctagtttccttagatagattgcaaggcccctcactttccagttcatgtttcctctggcacatctttggccaacacctttatcttcaactcccatcaacagctcacctcacccaggcttattctcactctgccttccggtttcagctccaatgactccatttctgattcagttacttctctgtttctcagagcatcttccacttcttccatctcttgtttttgccacccaataggcactctcccttttcctgacaaaacagttcattgtgtgtgagagacttcgggcaaggttattaagctgtccacgcttcaggcttatcatgattcatcatctattaataggacaataatagtaccgacctcctgagattgttaattggaggaagtgaatgaatatctctcagtggattagaagtgcctggggcataataagggctctatgtgtttgaggctgcagttgctgtaattggaatcatctctcttttactcagtccacctagtttggttgaagttggttctaccctctgctctaggggttgctaaggtaatcagtaaatctcatccttctagatcctgtgatgggttcagaagagaacacaaaacccgatttgagccagtgagagtcactatgaagactttactttctgaaggagagaaactctctatctctaggcatgtgcataatgcatgctaggcttactgctattggagctgagacattgcagatggaagcccatcagagcatggaaccaacacagagggaaacacagctgagcaaagagagagaagtcctgtcctggtgatactgggatgagcctttcatgaagcgatgcctgaccagctcttcctccaattcctcagtcgtttgagccaaaatacttccttgttgcttaaaccactaagggttaggttttctgtcacttacaacccagagtttcaagagatatataccatgtcttaccaacatcataccttagtataatggtctttctattgatctctctgctgcatgagaccttaaggtctgtgaggacaggcctgggtcctatttccctttgtatctccagcttccaacatagtgcttgactatattagatgcaagtatttgttgaatgaaaaaatgtctcagaggctaccttgactatttcagcataacttgttcaatgctactggtttatccaggtctaaaagtctgctaatcgtatcagcaaggcataataggatgggaaaagaattaatattattgaatgcctgtcagtaactaggtaatgtatatgatactttacatcatgtcttttaatcagaaagcataattgctttctcccttcctgctatcccatgataggtctattactatacttccaagtcagtaaaataagaataatgaaataagaatatcaatgaaataagaatatcaatgaaataagaacaaaagtcagatgtggtggcacacacctgtaatcccagaactttgggaggctaaggcaggtggattgcttgagctcaggagttcaagatcagcctggacaaaggtgaaaacccatttctacaaaaattagctgggtatggtggcacacgactgtggtcccagatacttgggaggctgaggtgggaggattgcttgagcctagaaggttaaggctgcagtgagctatgattgtgccactgcactccagcctaggtgacagagtgagaccctatctcaaaatatataatatatgcgtacgtttagtatctaacaagaaaaatgaaaggcagataaaaagtatacatattctattctttaaaaggcaataatcatttgaatcttttgagttcaaaatgctgtgttttataaatttataaatgtgtctataaatttttctttctatttcttctacttcttcttagcattgaagtgagcaattttattaaaatctgccattttggtagtaaaacatttaaattcaaagtcaccttaagtgagtgatgtgcttgttgccagccacttaattagctgggggatgtgacacagttgtctacatgcaggacaatttcaaggtcactggtggaaaccctctcacctccccatgctgccagcttattgtcccatacatggtaacattcagatttgggactagatggccaggagaaaagcactgagtagcctcactccagaaggattttttgtgcttggctccctgacttctcctttcgttcagggagcatgcagtggtgagaacacctaaatcatgatccttgtcctccatctataactaattcgtattgttttaggttagtttctcagagcataagaatgaagactgtagtatggcccggctctttcttaagaaagcactcttgatgaaacaatctacataagtagactgaccagttaaatatggttattaatcattcagttttatctgcgtaatggtcttatcaaaactaattattgccatattaggtagatatttagagagcacccttttatggaccaaactctttgcagaatacagatactcaggaagaggatctcttgtcttgaaggagctgaaaattgagttgagttatcccagaatcgcttttttcctttagagttggaattttgacagatggagaaaattatctaataaagtgttcaaaaacttggttggcccgtgtgggttgaggattaatccgttagagccacaggcagattgagcacactattcttagctcagaagaagcaagttattcagagaaggatgagagatggcacattccctctagttcctttttgctgctagagaggtgagcttccaggggctcctagttcaggttgcttgtatttttttcacctacatttggtctccacaagccttcctttcatcgtcagatttgtccaaaatttaacacctgtgtgtgtctaatcaaggaaggacatgatatcacattatgagtgtatttaggtgagaagtcattgaggaaaataatgtttgtcatttgaaagaaagaagagtgttttatttttgagtcacttcaggtctttgtcctgaagaacagattcactcttgtttaaactctgtctcagtgagaatgtttgcggggatgggaggtagcacttcccattgcatctaatcatctagaaaacaagagactacaccttaacagtgcaaatccttttggaattgatctacctggtcttctgctttttcctttctccactctgctttgtcctgaattcccagaaatgccatcttaaaactcttctaaaactgctggctactctttcccctgtttttttctaccagtttttttgtttttgtttttgtttttttttaaaccatcatataaagagacagcttccaaatggtactctgtaattgagcaataaacaacaaacttttgtctgtatgtatccatactaccagtcaaaatacttaataacaaaatatcaataaaaaatggccaatgtgacatttttcatcttgtgtcaaaatcagaaccctttgttttaccatttgcttttaaatctggggggtacataaattcctgagaaaatactaagcatatacatcaaagaaattcagacaaatatatgtgaacagagcaggtcactgacactaatcttggccataacctagagttattcagaaaagatgtccagagacaaatcttggaggttttgaagaatcagaaagataagaggaaaatctggatacagaggtatcacagaagccaaggaaagtgttttaaaaaggaagacgaggtcaacagtgtcaggtgcagctaaaatattaagtataaagaggactgaaaaatatgtcttgaatttagagacttgaaggttattagtgaccttaacaagcattgtttttggggagttatgcagctagaagtcaaactggtaggttgaggaaggagtggaagctaaggcagttgagctgtgggtacggacacttccttcagattagctgtaaagacagtagtaatagaacagtggctgtaggaggataggggactgaggactaggaaataatttattttagatgggagatatttgaataggttcaaagcttattggaaggattcagctgaagacagaagtccggtaacaagagagaaaatataatagaatagataatgttaagttcccaagatccacaatgacccccaaacgtaagaatcatcttagaatagacttgggatacgaagttcaactgcaaaataccctatttttagacagcctccgaatttaggaaaccatgtccagcccagaggaaaaaagaagagggctgagttactattttctccatgtttgattctaaggaatgtagcattatttggatattacataaaaccttggaaaataagggaaggggcaggccgtgaagatatgtgcaattaaaattagaaactagacatggccagtaaattgattacaagttaatctagctttgccataacctgagagaggtgatgtagtcaggaagttaggttttatctcaggttggctttctaaatattgaaagctgtcaccaaagaaactagcatagaaccagtacgttacctgggggagagcacctagagccacagatgttggtgtgcctgagaaagtccagaattttaaaaataaaattagaatagctgtgaccggcagtaccctccagactcctcaattgcacacagctccctttgtgtccattttgaggactcagcaccaagacttctaagacatgaagcactgggcaatgctttggggacatgacaatgctaattatgctaaatactcatgatatgttgtctaatattgatattgataacctaagcaaagacttactttagctaagctgaccttgctgaattgcctgtgttagctgccaacaatgtcaacagagaggagagtaatggtcaaactggaggcagatagtgttatgatttatgaggggccatgaaggcagtgtttttgtccatgggagctgtgattagatgctgtgggtagctgaatacagttgagatttttcaaaaattggcaggcatgttactttggaagttctccagtgacacatcagagatttaattattacagttttgtattcttgctttctgtgacatctctcccctttgtgcttaatcaatgtttgtttcccagtatgtgtttgtcactattattaattttggaagatacaaggaaatccccaaatcagtaaatgccctctaggagtgattctctagtcttgtagttggacacaaacccacaacataacctcctttgtaggctcatgcaagaggaaaggaattcagcatagtgatggagtaggcccagttccaaggatgccactgggtatcctgtacatccagagaggaacagggcaacttcctgactcttttacgtcactttctgaaaggaaagggaacgtttcaaagtaggaccatgcacagatacctgaccacctatccctttttaaagtcccacctgtcaagtctctacaccagttgtattgcattacctgggtaaaggagtcaagtgggaaggggtggagggtagtcccaagctaatgagaccagcattcccctgggttattttatagtttatcttattaatcctagaagcttgactatgaggcctgtgttaggaggtttctccttggggaaagataatcttaccaacatctttgggctgttttcctaattcttaacactactcctgtatatttcaaactgggagctatgaaatagacaggtttgcctctcgagactttctatgaaagcttttttgatgttactcctgggagcttctcagtgggccaggaaagaggccccaaagccacactgtatactaggctaagtcaccacatgacgtatgtaagattcacagaggatcctcttgttcacctatgacgaggccagacacaggccctccaaactccctttctctgtctcataaatgattagctgaacgtttacccccctgtgatcaatctggacaaaatacttactaatttgatttgaccgctgtagtgaagcttgtctcctcctccacagcctgtaaactttgactcattcctgaagctaagcaagtgttggaactgggaacaacccctccttaatggcccttcctgagactctccattggctgcaaacaaatctttcttgttcagctgtcacatcatcccacgtgtgcatcccccatgcctagctccttctagccatgtttattcctcttcattaaaagagaagccctttcagcctgaccatctggatgtttatagatcttatggtcagagtcttttccctattgcaaaaatgatcctgtccatttggcgtattctttaaaagtaaagtctgtccttacctaagtctaggtttgtttttatttgacactactctctatattttggtatttaatactgtgtacattgaacacgatcttttcttgatgacctagcttcatctttaagactattatcacattgtgctgaagaggtagttgtcagtgaggccaattctgggtgggatattggctgacctggcactaatgctggagccaacttatttctgggatagagcagctacttttgttttatgcattttgagttacattaaactcatttggatagagtataatggtgacctttcacttggccagaagaaaaaaaactacactgtttattttcttatttttttttttttttttcactggggtctcactctgtcacccaggctggagagcagtgggtgcaacctcggctcactgcagcctctgcttcctgggctcaagcgatcctcccacctcagcctcttgagtagctgggaccaaaggcacgtgccaccatgcccagctgattttttgcatttttgatggagatggagtttcaccatactgacactgttttaaaaataatcctagaattcgtaactttctagcgtgtgtatgtataaattacaatctgttatgtttagaaattaacaagaatcaaataatgaagctaattttccaaaacgtgattgagctacaatgcaggcgtctgaccatcttatttttagcccccaaggcatgcaaatgttagaagaaaaagaatctttaaaattgcaattgatagtaaaattgcttaattatatgtataatatgtggaagaatatgtatatacagccatttatcaaaaaagaggtcaggaaagttgggtgcagtgtcacacacctgtggtcttagctacttgggaggctgaggtaggagaattgcttgagcccaggagtttgagtccagcctgagcaacatagtgagacactgtctcttaaaaaaacatggggagtagggtaaggaaagaaccaggtaaggatggaagaaaaccatccagccatgaggacttacagagcaatatgatagagaaattattctcatttcttaatataaataagaaaaatgagatttgaagatttgcaatttgcataaatttacctgacttgtaagtgccagaaccagagttagaactctgttattctattttctggtctatgactgtcatcaggacactgtgaagcctttcctttagtgagttccaggtaacacagaccagaaaacagtcctaattgtattcgttgttgttcatgtcactgtcagactctacaacttgttgcttccattactgatttcaataccaggggctgctatccactcttctcttcctccttttctaggaagccttactgttcaaatgtgtaaaaactcattcttgacttccagccaatcagccagagacatgaccttcatgcagaccatcatctctttgaggctgtgtctatttctgagtgcttggaggctgctgctttgctgacggggtagagatagaaagaaagggactgtttctctgtttctccctgttagaaatgcttgttgcccagtgccataaagaaatagcacttgaacataaatttaatttcctcagcaaggccattttttttactttctgcagaaagggtacactcaccagcagttttgccatgaaagtacaccaaacaaaagaggcagggtcatttataacctgatgcgtccaccctactgctgtgtcccgtttccattggctggaacgggacctcacattctgtatttgtcctgattggctagcaacttagaactttttaaaagaggcaaaggcagaggagaacaaaggaaggaggaagtaacttgtggaatgccgagaaaggtaaaaacaccttcaaataaggaagaggaacaggctaagacctaatgcttgcttggaccagtgtaagcatgccagggcaaatatttaggctaaattgtgggagctaagaacataaagtacattgatttctttattatggctagcagatatttaagaatgttagcacaggtctttgaataatttttgcttctaagagaagttactatttattcctaattagatggggaggaaagtctttgaagaggaacccctactttattttctatactccctcaccttcctaggtcgtctgaaggtttcctgaggttctggaaaacggaaagtatcctaaatacttaaatagtattatatgctaccaattaattgtccactctatcatctaaagatctcacgacaaacagtatatggaagtatatgtttcaccttattctgtaggtccaaattctcttttgagaattatgtggacttcagagctagtttgtttcatggaggtagctagtttgtttcattgacatgctgcatgcctcacttggtaaggctcaggcctcgtccagagcagggtatagcctttggtctagccaaccttgctggatgttgtaaagtattttagctattggattatgctttctataaatgtaaagatgtcacgggacctcaggtgtattcatgcaggctttgccatttatcctagctccaattagttaccgcaggtacagcaaaacaaatgtaaggcaccgcaccaacacgaggaattatcagtcttgttactaagaggacagaggaatccctaccatgtagggtaaatttctttctaggccctttaaatgtgaaatgtaataaggcaatttaaagatcatttcactaacatgtaaaggaaaatacaaacatgtgcacatctaattgcaggtcttacaattttggttctaaggaaaataattaacataagctcaaaatgacacttcctgcctgggaacagttctggcgaaataatgaacctgtagaaataaaattgaagagctaatcagccttgaacggcgctgaggtgtgtgtttctctctctctggttgctgttcatctcttgcttgtctctctgctttcccctatgcctttgatgagacacataatttttatgttgggcgacaaggtgacagttctctctgataattacatagatgagaatatatttggttttggaggaaaaaaatttactttacaaatgtatatatagaaataactttgaccttttggtaaagataaccaagttcttcctcagcaacagaaaaacaggcacattcggaggtgtgtgtttcattttatagtggtagctcctcctaataaaaacctttgtaaggaaaaggacaaagttgttggttcagggggctagcggtagaccccttctcctaacagctcaaagataaggtaaatcaaagtgccccccaagagttaaatgagagaaaacccacatgcagtggatagcattagccgtctgtggtgggaaaggaacagattgtcaatgaatgcatggttaaagagtttgagaacacccaaaactttaatcaaggtgatatgggagcaatctcatgaaagtagaatgggaggatggttgcatttagccattacaacctcatcagttgcattcccacaggaagactgcctggatattaagatgatgtcatcacagagctgggattctcacagtgtggtaagaagacctctagcatgagaatctcctgtaaaaatgcacatcctagggctttactgcatagacaccaaaaatatttggagtgggctcaaagaatctgcattttgtttatattcaactgaattttcttttttatagtttttttctaatttaaaaaaaagtaacacaatatgggctcattgtaaccaggaatgcaaatatgaggaaaggaaaagtaaatcttggttgatccttctttttctcttaccctgaggtagcaatactagtagcagttgttactagcaacaatactggtgagcatgagcatccttccatgccatttttcacacttacaaacatatatacatttttaagaggttttattttttgcttctcttgtttgtttttatatactaggtcatattataaaatttggagatttacttttctcaagtcataatgccaaacactccaggtattttaaaaatgtatgtacatctatatatgtattcacacacatttacacatatacatacaaacacccacatacatatgtgtgtcaggttgcttgaaaatgcagcttaaaacccatttagggctaaatactggcacagtagtccagtatcataaggaaaagttgaaaaaaactttgaagaatgacattcttttaaattctatagttttctatggaatggattattaagatattcaagcgtgtcccataggtgaacattcaggttgttttctattgttgctgcatgtgttttatttcattgccattacaaatgcctttattttggggatgatagatgagcagaaatgggatttccgagtcaaaggctatgttcattttaaattctattagtattataatatgactttcctaaaagcttgaggtaaattacagttgattatcatgattccacttagttatgtcctataaaatcaccttgagcactgaagtagcagacactgactcactgtgttaatgtattaatatgttgtatcaatatattaatattgaattaatatgttgtatcagtatattaatattgaattaatatgctgtatcagtatattaatattaaattaatatgttgtatcagtatattagttattaactctggaggaaatacagggttaggtttctgcaagctccttgtcacacatttttcaacccatcaatacataaccttgttttacatgtgtttctgtttaaatacatcttatttatttatttatttatttgagatggagtctctctctgtcaccaggctgtagtgcagtggcacgatcttagctcactgcaacctctacctcctggattcaagtgattctcctgtctcagcctcccaagtagctgggactacaggtgcacaccaccatgcccagctaatttttgtatttttagtagagatggggtttcacgatgttgtgcaggatgatcttgatctcttgacctcatgatccacccaccttggccttccaaagtgctgggattacaagcgtgagccactactcccagtcagcttatttattacatattattgataacctagcattgaactcatggccagcaatatgtcccatgcctgaacaatgcttatctaacacatggactttctctatcaggcactttacagactaaagtgcctttactaaagtctgtaaagtgcattatggagaaagtccatgtgttagataaggattcagccctgtgcagaaaatgtggcattaaattgaccaccaaaaggatactaatttacattatgagggtgaaacaagaaaggagaatgtcatcttgttctgcctggactgggaacatgcatgctgggtgaccacactgcacgtgaccatgaatgaccacaaatgatctccaaagtgccacaagtattggctttggggttacaaatacatttgagagtgtaggcaaatttgtgaatacagaatccacaaataataaggattgactgtatattcccaccagcaaagtgtttgtcatgttgattattcttcgtcttcactgtttcattttttaaaatatttgtgaaattttaggggaaaactatttcctcgttgccaactaactagtgaagttcagcctattttcttaatttattacacatttaaatgcaatctttgataacttacctgttattatattttgccctttttccaaccaagtgacttaatttttttctcatcaattcttagaaactgtatattagggatatcaatactttgttatatgttatgtaaatacttttttattctattgcttgtcttatttttgttttgggtatctttgctatatgttttaatactcaaatatatcaaccttcctcttgtgatttaaggtctcctgtcttattgtatctccaagactacatagaatttcacatttttattccaatatttttattgttacatattttgcattaaaatcttgactccatccagaatgtttttgtttctagtgttaggcaggggtctatgttcattttttttcttccagacgaacattcctcagttgttccaaataggaagagaggaaatcaacctctccatgtttgcagatagtacgattctctgcctggaaaaccccattgtctctgcccaaaagctccctgatctgatacacaacttcagcaaagtttcaggacacaaaatcagtgaacaaaaatcagtagcattcctatataacaacattcaagctaagagcaaaatcaagaatgcaatcccattcataatcgctacaaaaagaataaaatatctaggaatacagctaaccaaggaggtgaaagacctttacaatgagaattacagaacactgctaaaagaaatcagagatgacagcaaattgaaaaacattccacatgaattttttttttcccatctgaattgttcctggatctacattatccatgcctggtttccaggccctctcagagattctgtaaactacttatatcctttattgatccttttctacttagcctggataaagtagattatgattttgcaactaagagtagtaattggtgctggaaatatttgtacctaatggactgtcaagtaaatgggaacctggggttagctatttaacatagttgagtttgaaggcatgtggagcaaaacatttccgtaaatattggctttggttaattggagtgaagtgcctactgaaggcagcattttgggaaactcaagtggctgcttccgtatagtattttaagaaacgtggctgtactggctacatggaattgtgctaaaaatcttaaggaaagaaaaataaaacaggctcaaggttttaaattattgcctcaatgtagtctcagaaaacaagagaagttttgactggcctaaaagaatatcgtcttttatagcaacaaggttgatgaacttgaacatcaaacatatgctctgattctgtgacttattgaattacaggctgcattgaaagattggctgtgtttcttaagtgaaatttaggacattgggaagaaaagaatgggaccctgagaattagagtagagacatttgggaggattcagatgactcacactcccaacctccctaaatcctccttatcagcagcagcagcccttatcctctgaaggacacaaacctgtctgaagaccttagaaagaccttgcctagcttctaagaggatgccagttcctcatcactcactcctatcttattacctctacttatctatttgaagtcagatcccagtgtgtcccagagatttaatcataaagtcacaccttgggagaaatatatttcttctactactgccactgctattgcaattttttacataccaaaaaatcacaagattttgcaatttatgtctacaaaatttgcataaagttatccattgctcatcctaattttcttcctaactaaaagggacatctgtttttgcaatggctctagtagaatactacatttcccaagcttcctaatatctaggggtggccgtgggacctagtcaatgagacataagtttaattgtactgattattcctaaaaaaaagttttggtatcctaagaactgctcttccttcttctgcattcttccttactgcgtgggcttggtcacaatttctggaactatagaggtcatcttgcactcatcagggaaaggccagaagaattgctaggacttccaatctgacatttttaaacccctgaacaagtgacgacaatcacttttactttttttttctgtaattaatggaagggaaacaaacctaattgatacattcagccaaacacaatcatcagcagtgatgatgcaaaaatgtagcaaagacatagaaagcacctattttccccttgaaaaagtgaaaattcttgagtttcactgattttgctaatttagatcccataccaacactttattcaattagtttggccagagagtcgctgtgtgctagttggcttaggccagtagggccctccctgggagctggggtcaatcccattaaccccacttgtttgcagctccatgggaagaagtgctaagaagaaaaaaggagatgtttggatgtgaaataggtgagtaacatgtccacttcatccctattgtgaatatgtcattaaaatttactactcttattccactttcatggtcactgaacaatctgctggttggatttgacttctcatgtaatttataagagggatatgaactaatcaactaatactagcattgtgatctgattgctggtttagttaatacatttacatagacgattttatgaatcagcatctctgtctgagcttagttaatgtaagtactccacccccacctccaagagatctgctctgcctgtgatgacaagccaggtcttgagtctgtaaggatgttcagggccagatcccagaacagggaattctccaggtaaatggcatcctgcccactcactgcctggggaactgcctttgctgtactttttagcttctccttgaacccttgaaactgttgtagatgtcatgagtgttatttttcttcatgtaagatttcagcagtagcatgtgccctgtctccaggagtaccaaagataccatgcagggtgggacagagccagttcccatcttcctggagtcaacatgattctagaaccttcaccactatagattgtcatcacttcgattccatttaagagtgctgtggcagatgtaactagaatgataccaattgcagaaatgcagggtgagcttgcaaaacaaaaagtcattgattctgtaacccataggctaccaagtgtcatgcaaaacatctggggtatagttaacttgccaatatttattgagtacaataagatgtacatctgactaatagagatgttattagtaatactcaataggataaagagagttctggatgggaagatagaagctacactgctaagtgctaattttctttactatggatgcctccatgagcaaatcacttcaattgaacggccttcaagtttttcacctccaaaactgaatactgtactcacaatagttaaatatttcctgagcagttttatttatctcattaatttactttaaaaggcctttcttcgtatcacaaactccaactggattgtggtttctgagcaaattataacaaattttgtgtttgtggaatccaaattaatgagatttaactgcatgctaattaaaacgccttagaattctgcaaagactttcccttcaagagttcaaatttgttgatgaaattttctcgttagacttcacaatgagtgtggaaaacaaatgatcagtctgtaagccctaaaaaaagaaaaactttaagatattcttcccaggttttaataacacaacctggcagcaatggaacaacctcacaaacctggccttaaggttatcttgcaggttaactccctctcttaaagagattcttgtaatgatttaaaaccaaatggcgacgtagcattgaggttcaattagcggattccttagttgggtcttgatcacatctctgattgtcacctctaatagggcgtattaaaatttccattcattatagtcattagtctctgccagtgataaggttgtgaacaaatctgttggtgttcaacttctaatttgtgtgataatttgtttatgcttagaacacttactggttgtggatggagggggtgtgacccatttagaaactattcatgtagataaatctggaaagtttgcctggaatggctaaggcatggtgatgccacctagtctagtaatagacaagggccacttagaaggtcagatgagtcttattccagagtcaggaagagaagtggtttacccagagatgcaatggggttgcttcaaatgatccagaagggggtttttgcatggaaagaaaggttccattcggtcattgttactctacaaatggggagaaaagcacctgcatcagaatcatctgagaagcttattataaaggtaagctcttgggctacactccagacctctggggctagggccctggaatctgtgtggttagtaagcaccccagattacgcctaggcgtgctgaaattgagaaccactgcaggagacacctgagagcagagacacagaaacaaattaggtatagcaaagacatcaaaacattttgtagtaaagtattgagaaaccattcaacttgcatttatcattgggatttttgccgtcaacagctgaaatacaatatttaagaggaagaaaatttcaaatttgcaacaagccataagaaatggggcttggcaaagtgtcttactcctgtaatcccaacacgttgggaggccaaggtgggcagattgcttgagctcaggagttcaaaaccagcctgggcaacatggtgaaaccccatctctacaaaaaagtgcaaaaattagccaggtgtggtggcatgcacccagtctcagctactcaagaggttgaggtgggaggatggcttgagccctggagggagaggttctcgtgggcaagatggtgctgttgcactccagcctgggtgacacagccagaccctatctcaaaaaaaagaagaagaagaaaaagaaatggtttgggtgtgggtttttttttttatatactttagaggctttcaggttttttcttgctctgtgtggtcttattgagttatttgtgtttgagtttggtacataaaataattttagtacttcttattatatatacaagaatcatggatatgctcaactttatgtctcctatgcctgaaaagttgtgcaccaataactcataagtttttttaggacactgtacactttgtgaatctgatgaaaggcgtggaacttgattcccacaaatgtgtgtgcatcagtatataaagcattacatttaatctctggggacttagagatcagtgctctctctggactctacatcaagagcctctgacctgagcctaaaccacccagcctgctgcttcacaaagtcaagtagctccacctatgactcagccatagcaagcagggaaaggccatggtttgtgtgggaaaaatggatgaaagcaaaactgaggaattcagcagtcctcgaggcctcgactcacacctttaaatctgttggaattgccacaaaaatatttgttttcctacaagaatattagagatttacccatcttgagtggcaagcctagatgccccattcactcatcaaggcctgatgccatatttagcaaaagagccataactgaaggtgcgtttgatgaatttaataggattatgtcttactaatgacattaggctcctgggtcgggcttagcctttatatttacgttttatcactgcaaatgaagatgatattctctggcatatgagttttgcaacctcagggttagtcttgtgatatgtgaagtggcccttggcttgttttgggcccattataaattagatttttaaaaaaacattcactgtgtttattttttattttatttttgagacagggcctcatgctgtcacccaggcaagagtgcagtgatgcaatcacagccctctgcagactcaacttccctgggctcaggtgatcctcctacctcagcctcctgggtaactggggctacaggcatgcatcaccatgcctggctaatttttttggtattaattttgtagaaatgggttttcatcatgttgcccaggctggtcttgaactcctgggctcaagtgatctgcctgcctcagactcctaaagtgtcaggattacaggcatgagccaccacgcccagccaaaaaccattcgctttaggaaaaagaaaaatcaaacttcctataataccaccaccaaagatacctaacgttaataatatagcatgtattcctctagcaaaaattctatgctttttgcaaaaatagggtcatactatatttagtgtaatcaaatctggcttcttcacttatatcttaaatatctatttcaataagttccatctatcatgttcactggctgctaatattctccaatatttatgtatactttaagggtcaactaatagatgcttcagctcattccataaatgagatttttctaacatctttctatgcttatagccattaacatttgggatttttgctgctgttatggttaattttggagtctctgaagaaacaggtgctttgtagcatccagttttcttgcttaaaaggaaattcctcagagtttaagggtgtttagatgtaattttcacttttcactttgttctggaaaactaagaataaataaaaatccaaatctatagcccatgtccacccactcctttgaaagtaatcaacctcagtctctgaaatttcaaaggaaaaaactgaaaataccactgaaatcatttttaattagacatttagcagttcctaaagcaagttataatttggccttcaaaagcagtatttttaaagaagggagcattttaattggtatgttctggcttagcatattttctcagacattaaaattttaaaatctagatgtcatatcaaagtatatgagatgaaaaatatgatttcttctatctaactagctaaactgtggcacataactggacgtgtctatatggatggatctctgggagaaaagaaaaacttttctattagctatggcttgatatatctgggggcccagagctgccaattttatatcatgcatatgctgtgtagtatctcctactcaaagtgtggtccacggaccagtggcatcaatatcaactgggaacttgtcagataaatagaaccatgaatcccagcccacatatcctgaatcggaatcttcattttaacaagatccccgggtgattcttatacactttattgattgattgcttgattgattgagacagagtcatgctgtgtagcccaggctggagtgcagtggcgcaatcttggctcactgcaacctccacctcctgggttcaagcgattctcctgcctcagcctccaggcgcattccaccatgcctggctaattttttgtatttttagtagagatggctttttgccatgttatccaggctggtcttgaactcctggtgtcaagtaatccgcccaccttgacctcccaaagtggaggcattacaggcgtgagccactgtacccatgcatgctgttgaggacaccaaacaaatcaaaccaaccagatatatacacaacattcatctacttctctccactagatatacgacatttctttcaaagaacttgattcttgcaggtgtttgtaaagtgatttaaaatatgaagatgttgtatgtgcattaatataggaatgtgtgtgttcaatcaaatggacataaagagttacatatagtgaaacttctcactttattttgataataggagatttggtgagcaccttcattccttcttttcattttaatattgcatactgtgcagttttttaaaatttgttttagacacaagatctcaccgtgttgcccaggctggacttgaactactgggctccagcaatcctctcccctcaacctcctgagtagctgggactccaggcaagcaccactgcatggggcttggaacattttcttaatctggagacatctaaattaagactacaatattaaaatgatgaaaaaattgaataaagatgttcaccaaaacccctagtgttttgggcaataatgattttaaggctttgaggccccttcccaatgccagtcattctacaaattgttcataagcacaagcaaaatcgtaagttgtaatttggccttcaaatacagtatttttaaagaagggagcattttagttggtatgttcttgtttagcatattttattagatgttaaagttttagaatctagatgtcatattaaagtatatgagataaagaatatgacttcttccgtttaactagctaaactgtggcatataactggatgtgtctgtatagagggacctctgggagaaaagaaaaacttctattagctgtggcttggtatgtttgggggtcccagagcaagccagatacttgactggggaggggggaagagcaatttatgtgccagtaattacaattataaacacatgaatgtcctgggattggagaacctgttctgtatgagggtaccaggagatcttaacagtggaagaacatttaaactgaatcttgatgaataagtaggattccccaaggggaaccaggaggaaccagcacctcaggtaactggaagaatgaatatgaaaatacaaaagtaggccaggcacggtggctgacacctgtaatcccagcactttgggaggccgaggtgggtagataacttgaggccaggagttcgagatctgcctagccaacatggtgaaaccccgtatccactaaaaatacaaaaaaattagccctgcattgtggcgggcgcctgtagtcctagctacttgggaggctgaggcaggagaattccttgaacccaggaggtggaggttgcagtgagtcgagattgcaccactgcactccagcctgagcaacagagcgagactctgtctcaaaaaataataataataaaataaaaataaaaatacagaagtaggttaccatgttaacaaatacgttcatcatcttgttagtagggacccattggagggttttaatcaaggaatgccattagatttgtatttgagaaagataattctggtggttcagtagaaatagagcaaggtgaggtcagaggcagggaaatcaactaggaagccgctgcaaccatctgagtgacagaagatgaacttgaatcgaacattgaatgtagcaatagtagtgtgggactaagttcagagacatgctggaagtggagcaggcaggttagggactgagcaaagaggtagcgtggggagactagaaagacaagaaacactttgaagattctagttcggggctgggcacggtggctcacgcctgtaatcccagcactttgggaggccaaggcagccagatcacctgaggtcaggagttcaagaccagcctggccagctgaccaagatggtaaaactccgtctctactaaaaatataaaaatttagccgggcaaggcggcaggtgcctgtaatcccagctactcgggaggctgaggcagaagaatcgcttgaacctgggaagcggaggttgcagtgagctgagattgtgccactgcactctagcctgggcaacaagagtgaaactccttgtttctgtcttcccttccttgtgaaatcattgtagatacatttgggaaaacaacacaaagagattccactgtcccccaatagtaacgtcttgcaaatctatagtaaaataaacccttctaaaaattgtatgatttatgagcaattttaaattaaaatatcagtatactctcatgctgatttctaactagtcatttctctgacctcccacccctcccctcaccccttggcccctaccaccctcccacacacatacctaatggctctccagaccaggtcctgtccccatgctcccctgatcaagcagatcttgaaccttgtggggaaaatcacgtctctggtggtcactggatgcctggtgtccatcctgaccctctaaagctagggcttcccattgtgggctggtactccctacatgtaccctccatgtcctcttgtagggaccccagcttcagcagtgctctttaccatgttgttaaatatatggcaggttggggtttgattctggccacagctctccccagataactgacagagtcatttagggcctttgtcccacatttctgggaaatttgtttctataatagttaggactttggtatgctagtgacagatgcacagatcaaattaacttaagaaacataaatgtactggcttactgagttgggaagtccagggataaagctcccttcggagattctgggactcaaacaatatgatcaagattctctctcccttgcacttttgctgatttgttgacctcatgctcttcatggtgtggtttatatggccattggcagatctggagatacatccttatatctcagagtgacacatgaggcataagactcgcttctccaccatcactgcaaaaccctactggagaagggctctgtttggcctcatttacatcctgtgccaatcctgtgggccaatcacttgtgcagggcgatgtagtgtattttggatgaatcaaccaatgactcagcctgagctccttatcatctgatagacttggaattggggtatcaaattgtctggcttagtagaaccagatggaaagggaagaaagagtttttcaaaggaggagatattgacgggatgggctaggcagaacagctaatgtccattttagttattcctggatctagcgtcttctcctgtggtgaggagagaggaatgtcacatggcacctatggttgtctcttgggagttatggtcagtgttgacagaagaaggcaaggatggctgtaagcaccaagatgtttatatgtatgaggttggaatttagaggtgttcagaactaatagccttaattgtctttgtgaaattgaaaacaaaagcacttgtgaaaagacaggaaggcagggtggggagcttaaaaagctagttgagggtttgaaggatgagagagagatcacaaggacagtgtagaggactgctaagagatattgaggatccaactaagattggaaactgtagcactcaggattctccagagacacagtaggatggatatatatgcgtacgtacacacacacagaaatttatttcaaggaattggcttatgcaactgtgggggttgcacatctgaaatctctaggacaggactgcaggctggaaactctcaggcaggagctgatgctgcagtctcgaggcaggatttcttcttcctcggggaaacctcaattttgcttttaaggccttccaggtgaagagatgaggcccacctgcatgatcaagggttatctcctttactgacagtcagctgattgtagctgctaaccacatcaatcaaatacttccacagcaacacctaaattagtgtttggtgggataactgggtaccgtagccttgccaagttaacacatacattggagtgtcacagaggcctaaactctgtgagccagtctgcatgacactagatgatctatttttcctcttcagttccacagagataaatacctagcaaatagaagccaagagagtggattgttaaactgattgatgattggaggaatcttcaggctggggtcactggagtctcaaggggagatcttgacgttgctgtcgagagaatggtggacaaagtccctcagggttgtggctggactgagaagttagttccccaagcgtaaagtgacaagagcatcaaccccaccagttaaaatgaataatgcatgaataatacttatgttgggcactgaactaagtatcacattaattttaaattattatcattgttacgatttcatttaattgtcaaggaactgacactacataaagtcagagtggatttagtgggagtaagagggtgagctaaatgtggtatattggagtttatttatttactcaaccaccagttatttaataagcattgattatgagccaggaactgttttaggtgctagagatacagtggcaaacagaacagacaaagtctctgccttcatggggcttaattctgttggtgggaggaggtatctgctaataagcagacaacttcagcaagcaacactagccccaggtccagtggtaagcgtgttatgaagaatagtaaagccaagttaggcaatagagagtgatggggccagacagggctggggtaggatgctagacttataagagaaaccctttcggataaagtgacatttaaacaggaccccgaaggcatgaagggagagcgtgggctatgaatatatagggaagagcgtgttcgagagaaagaacatggtgtgtgcaaaggtgctcagaggctggaggctgcttctccctgtaagtgaggaggagaggggtgggggatgaactgggataggttgcaacaaggagccatgttgggtgtggtgggtcattataagttctctggagttcatgctgagtgaggtggcaagacagtggagagttttgaacacagaagtgacaaggttcttctctaagggccgttttggaggccgtatgaggctgtatgaagggatactgggaggacaaggatagaagaaggagaccagtgggaaactgttaccgtaatccaggcaagaagaatttgtggtctgaaagccatgctaggtatgagcatgaccaggaccatgccacgggtatgcattgctgaagcagcctgccagcgaagaccaagatggcccaggaccctagagcagcatgtctggaggggtctgctgtgttgacatggaacttcttcaagatggagacaggatgggtgggcatggggagaagaactctgacccagattctgaagtcctccaggagagggaagatggtggaggaaagcagcaacggggtagaaagaggagcattagctgcatgcaggcaggtgcttgaggctcctgcctctgggtctttgcatgcacttctttcttttctgaaacattctcttcctaatatccacgtaactcagtctcttccttcccacctcagatctttatttaaatagattggaagactgctgtcaggacatagtttatgtaagaatgaagataactctcttgcctccatccttatgtcacctggcatggggtggcatgagcagccactgcctggaaggtctacttggaagtggtgtcctcaatggagaggcggatctggcttgaggctgggaggtgaggggactctcctgtgaaaggggtaggaatgctggggaccttattgaccatgggctaggggtttcagcaggcactgtggggagtgtctttagggaagtcaggaaaggagggtagaatcaatggggatgaagtaatgagaggaccagagggaacaggtgctgggatgggagctgaggatgccagaacatgggattgactgccctgggagggcctggcaagcctgaggctggcgtgcatgcagcctgtacgcttcctggggcaccaagcagagcatgggtggccacaggagacgtaagggagcgttgtctgaggggatgtgaggaatgaccaggtgctacccacctacagagctctcaggatgcttaactcctgaagaagctgtagcctggaatggcttgtagacctgaatgtataccaggtgtaactggcagagagggagcaggccccagaaggtccttgttcatcctagtcaggtccttcatcctgtcccacttcagggcccaaagtgctctgattctaatgccagcctctttggccttgcatttgtagagaagcgagttccctatcattggaggtatctaagcaatgaagtggacagccacttagaaggagtgtgcaggatggaggcttgggtatttcttgggggctggactcgaagacctttattttccacttggcctggagcgtctgtgagtccttgtcaaatactgcctggcacttacctccatcgggacacagtgcaggcatggctcaagtgggtaaattgtttatggaatgcaaacctcgtgggacttatagatggcttatcaatgtggaaactgtattaaaaataagttgagatcagcaccttccacagcctctgcatatgaaatgtcacttacatttaaacccacatcaaaggttctgggttgattctttgtatacttgttagtagtccaatgcttaggacaccattttcaggtagctgttttttagtgtgtgtttggcagggctggttctatacaaacgttcacagtgagcagagggacagcatgatgtctcctgccatggtttcacaattagctagaagagagagggttgcaggctcactgggccagaccggacgctagaggctgtattcagtaggtggggcagtggcatggacctctctgcccatgatgtggacatcctggcagatgggctgtttcgagagcaagccatggcttcaagaccttggctgtttgtggtgatggggtgaaggaccgaatagttagagttcgtactgagtgtctgtggtgcagggagattctaatcacatcatttgggggtagcggctgtgcttagcactggttaagggaacgaacgggcatagttgtgctatgcttgtgagtatgctcacttcctggagatggggagagtcaaattcttagagtgttgtgtggcttatatattttattaagcacctgtgttctaagtccgataagcactttgcgtacactgcctttaattttccgaatcattccgttttgcttgttgaggaaggcaagcagttaagacaggctcatctcttgacatgaccccacatagtgactgtacctcagaggggtaaccattttctgagagctgggtcccaactgtgttagggtcaaaattctgatttgcataaccagaggtgaatgaagacctgggaaactgacacatactatcttgactcataagagactgatgtataaaaacagaaatgatgccagctgcttattttgtgagaagaaaaaaaaaacaattctgtgaaccagatacatatgttctctcatcagtgcattcaatatgaaggcaaatttatatgaggacataaattaagatcagaaggttgcttatcagcatgaaacagtgtaggctgagtgaggataggacaccttactgacagggttacagagctgtgatcgtcttggctccagtgccaccctgcctgctgtagggctggatggtaaggttacctcacagtgacagggacaccaccaccagtcccagccgctctcagtctctgcttgcagtgcctctaacactgatcatcatcagcccattgggctgattcatcctttctttagacattttcctcatggaccctcagtaagttgtcatcttcctttgagagcaagttttctctttgtggtatctttgcatctcaccactttatttcgttatttttgttttgtggctataagctctacagagaagttgtattgttccatttccaaatttgtgggaaaggggaagaaaagaggagaggcaccatattgtcagcctgatttcccacctcagagacgatattcttgtcctcgttttacaattgagtcaactagatggcatggctttttttcctagctcccattgccatctgacgtggtatttatttagttgtttgtttattgtctatttctcctgttagaatgtaaacttggggacagcaggtctttgccatattcttggcatctggaacggtaagtggcctgaggtaggtgtgggcaggtaggagtatgcgtggattgaagaaggatgaggcaggccctcaatcccagtctctcccacaccccaccttcagtttggtgaggtgacagaagggaggaaaatatgagaagatctgagccaaaatgaaaatcagacaaaaactcagggcatgttctgggggtccttgtgtccctacatcgtcttaaagaaccagcctgggacagtggggactggagctggtgacacacaaggacccaagaatatggaaggcctttctctggcataattgaaataaactttaatgaacaatttgtcctgttttaaatatctttatagataatatctggagctggacaaatcatgtataatctacttcctttatcattcttatttcaattatatccatctacaatgtctcagccaaagggaacaccatttacctggtagcagccacctgaattttaggcattgatatctaagagaaaataagttgctcaatggttgctcctttgtaacgccaaacctaggacttgactatatggttctgatacagtccaacaatgtgctagttgataacagcttgtagatggatatatatgtattctgcatattttgtttggtgaataacccacagcattctaactcaggtgtccagtactgcttatcaaataaggctttaacatagaaatacataaattctagaaattgtcttgcatttattgtattagaaagtgaaattggtttctttaaatctttgtaagggctattaacataatatcttgttccaaatcaaatagagctacttactactaaagacttttgtactttcttcaataattaaagcaagcaagatttgtagacaatgcaattttcatgatgcattgaaaaatgtattcttacagcagctgtgtttatcacacactttcattttcttaatatcttaaaattgcttggcaaaatgaaagggaaggagggtggtcagggatgtttccaacattctattaggatcattttcacacaaacagaaaatctgaagtaattgttcagtgggtcccctgcacccatcacgtacattttacaattaatgttttcctctgtttgcttcatcactggctatccatgtattcatccctctcttcatcttatttttggtgtattttaaattaaattgcagaaatcagtacacttcaccactaaacagttcagcatgcttattattaactcgagttaaatatttaatatatatttcaggtaaaatgtgcgcacagcaacataagcacattttaagctttccattcattgagttttgacaaatgcatacacctgtgtaatgccaatcccaagccaaggtacagacattctttttttttctccaatttaaaactttaattaaaaagtaaactttaatgtcgaaaatgcaaacttggggaaggcagaaagatcacacacaaggctgtcacttcacacttggaaggttgcacagcggccgggcagaggcgctcctcacatcccagacggtggaggggccgggcagaggccctcatcacttcccacacggtgagggggccgggcagaggtgctcctcacttcccagacagggctgcggccagagagaggcactcctcacttcccagatggcagggggcgctgagcagaggtgctcctaacttcccacacgcggtggcagctgcgcagaggcgcttctcacctcccagatgggcggcggccgggcaaaggtgctcctgcttcccagacggggcggcggcattcttaccacccagaatggtgatgctagtgcctctttccagtcgatttccaccctacgtgcacgcagagggaacccatgttctgatttttttctcagcatggattactttagtctttcctagaactgtatacagttctagaatcatatagtatgtactatttgggataagtacatgcaatacatactactttgcatgagactttttcacgcagcacatttttgaaattcatctatttttgtttgcatatgtcagtaatctgtacccattttagtgctgaatcatattccattgtgtgaatatgccacaatttttaaatctatttacttatcgatggtcacctgcgctgtttccagtttgcagctattatgaagaaaattgctgtgcatgttcttatgcaagtctttttgtaggcataagctttctgattacttttgaaactcctggaatatgtagtcttagcacagagtctacacacagtaggtactcaatgaatgtatatattgccctggcacaaaacccacatgacatgttgggttttacagtacaccagacgttttcttcctcatctgttctcagatgagcttcgtaactacctgctgaagaggcagaggcaatccacacaatggaagctgagacattacataatcgctaattgttggagctaaactagaaccctggtttcctaactcctagtcctgtactctctgactgcttgctattgagacgggagagttcccttgacccctttgcaggacttgtgaaaggggtgtggcccacttatttgactgccaccatgctcaaaccccctgcctgagagggagcatgcaggtgagcaggtacaggagctgggggaatgtggcaagaatgaaccccgtactggtactggtcaacggcagcatccagggttgtctgcgacctctggagccctcgagggcatgtgttacaacgctcatagcagttactatctgcagatagctaagtgttaaccagctcagtggcaagtcagggtgacaggcctttacaccctgccctctgggtacctggcttcctgtctggtgtccaggaagaatcaggtcacataggcttgaaggatggttcaaaatatggagattttattaagcagtgggagtggctctcagtggaaagggagctggaaaggggatggtgcgggaagaaggtgctctatctctgaagcttggccgtctctgaggaggctcttctccaaagttgttctctttgaagttaagccgcatctgtttatagtttcggacactcagttgcttctccttttcacgttcagctgcttgtctctctgccagctaaggtctgaggtttatgtgggcacaggagagggggagcgggtaggccaaaaaggtaacatttgggtgggaaaacagggataactcttctcatttagggctgtggtttccaggcttgagggtggggcctttgccaggaaactgccctcttctacccagtacttccctgtctcctgtctgtatcgctatgtcagtgccaaaccgaaggtatgtgtactttacatcctcccttccccccaagcattgctctgtgccacagttacggtctttgagagttttgggtttgtactttggctctatttaagctcctggtcatcagaacttatgtatattttccccttttatatcatcttgttttctcagtgtgtatatattgaggtgaggggaggggcagcagggagggcctgtagagggagttattgaaaagtgacctaagccaatctggtacttttgattggcaatcagagaagtcagccatgaggttcctgagtctctctttctctgccactcccagctgctctgggatcatgaaaaccagcctccaacctgattctgcaacacatgaaaacttttattaacaaggagattcatataccatgcctaaaacactcatacaacctgttctgtaaactcaagttgtcccccatccgtggtttaggcagcccggttgttaccagtggaaggtgtccgagttactggcagcaattccatatggatctgcagcaacttcaattcttgcctcctcagaagaaagaattcaatggaggggcataaagcagaaaaagagactgaagttaagtttcagagcaggagtgaaagtttatttaaaaaggctttagaacagtaaagaaaggaaaattcacttggaagagacccaagtgagcacctgaaggtcaagagccccgtttaacggtgatgctaggactttctaggattcccatgattcctcccttagggtgagctgcctgcatgcacagtgccctccttacctttgggaattgtgcacacacagtgtgtttaggaagttgtatgcatgcccatctgtggctttcttcccttttctggtggtgtgcccctggaagtcatactttgccattttgtctcttaatgcacctgcccaggaagttgcttctccctggagcctgcgtttgattaacactttaatgttaacagatgtgcctcatcaggagattgtctctccctggtgcccttggactggctgctgaattatcatttttagagaggcagtgtgataattgtcagaccatcacctgacattcctagtgggtgggggagaagagccttctcctgccccgctcatgcctgtctaactacctgtaacacagtgagcacctctcttgacaccagtaatctgatagcaggatcaggaagctgcttcttgaggacagagtctttccggaagcagtaggacagtggtgtgaaggaagttctgggcctcagccctcctctgaaagtgtttgctaggctggctaagcccagcacccttttcatggaaattttgaggtttctagccatccctcaaatctctcatagccttcatttgaccattgaaaataatttctaatatccctttatgctaattaatgaactatctgttgcagattcagatgggagagttagaagcttttatgaggccacctctgggaatataaacaccatttgggatctttcaaatgctcactaacaccactgtcttggtacttcctgcttagggtgcttcatatattaactagtaactgttgagggtgtcctaacatgaatctacacacacacacacgcttaaagctcactatggatggcggagtgtttcaacataaaacccaggtcacattggggaggtactagagtccatgtgtccttcccctaacccccaccctctaacggtggcatttccaccagactcttgagttttcagtttgagggaatcctttgaataaatatgattttctgcctccacacttaatgtggttagagctgcagccttgatcctaatctgtctgatctcccatcctcattgatagtaaaccagtgagtaggcaagtcaactgtgagttaatcggggtgggggggatttttaaatgcaagtctgatgtttaaatgtagctctgattatgcctcttggctatcagaagtgagtttcatttggatggagagccattttactgagggcacacagcacagaagctgagctgcagtgtaaagctttcaagtgactcttggagctattaaagtgccactcatttggtaactgttgctgttaattaagtttgtagccccattattaattcttggctctactattattaattatgcttctataaatttatagtaggcagtacctcagggaatttttcaagttgtatattaaaattagagataaataaacacttaagcttccttctcaatataagaagagtttggggtttttatttccggtactaggtaaatttgaaaggtatgtgatggtcattttctctccttactgaaacattttctacatggtttgcagcagaaatttctgtaacatatttaacaatgcggtttagtatttaaatatttaacccattcactgataacttgtagctaattcctacaattaaacttacgcctttggccaggcgcggtggctcacccctgtaatcccatcactttgggaggccgaggcaggtggatcacgaggtcaggagattgagaccatcttggccaacatggtgaaaccgtgtctctaccaaagattcaaaaattagctgggcatggtggcatgcacctgtaatcccagatactcgggagactgaggcaggagaattgcttgaaccagggagtcagaggctgcagtgagctgagatcatgccactgcattccagcctggtgacagagcgagactctgtctcaaaaaaaaaaaaaaaacaaaacttatgccttttatgagagcaagcagacagagaaggaaaagaaaaaaagcctggcattttgtgtataaaaaatcagagctcaagtaatgttggtcaaatatagatgcaaacaagtccatgtgcatattaacaacccctttcaccatgtgctttatttctgaaaatactttaaatccttttctgtcttctgatccagctctccagacaatagttaataaatgggttcataggtaattatgatgcattttggttcttttacctacagcaaattcctttttttctctctctcttattctaagaaggaacaaaaattgcccataattctccaggttatagaaaacgtctattggcattttgatgtagttcctttcagatgcttttccaagcatatatcaaataatttagatcacacaatgttatggtttgattttaccccttaacatttgatgtagcaattctttattattggacatttaagttgtttataatttttgtccttgcaaataatagatatatgatatgttggatagctctttaaataaatatttgagagtacctctaattatctattttaatgcctagaaatataaattttttgcctaaaggcatgaacattgttcaagttcttgatacatactgaaaaattgctttccaggaaatgacgccaatttccagtccactagaaacattccacggtgtctgtcttactgcggccatgccatttaatatagctaatacaattataataatattaacttgctaactttataatttttgaattcggaaacttgaatgagatatgctggaacatcaaatagtgacctattttatctcaacgcttcattttgctttttggagccaaaagagttctttctctctcaaattggattcagtagttgaggggctacacattaactgacagtagccatattaacaagagaaaagacaatatttatttacccatgcatgggagagctgctcagtaatgagtaacccaccgactagccagagataagggtttatataccaacttaacaaaggtgaagggggcaattagggattcagggggaaggcatgaaggtgctcttgggcttttcagtgataatgggaataggaaatatgtcttcatggcagctgaattaggaggaaactgcctttgaggggagttaatggcagctgtatttttgggaggctctgctatagtcagataagggaagttcagataagacttctttctgcatctcctgcagctcaaatgttttcaccttaaaataacctttataaagactctgagggtccaagtgcatccccatactttctatttattttaacatcacaaataaatgtgctcaataatagataaatttttcatcatgaaatgtattgaatattagtaataatggtgttttctgccgtttttgacaggtaaattaccagtaagggatgacacaggaggagaaaaggagaaaatgaagaactgtcataaggataatttttattacagatatgaatatatttgtttggaactaacaactatttttagaagacaaattaggcagaagtggtcactactgtatggacaagggtgaatagtagttgtgattttcaaaaattttttaaacatatctcttgatacagtatttttccaacttcatttcttttctttttttttttttttttttttttttttgagatggagtctcgctctgtcatccaggctggagtgcagtggtgcaatctcggctcactgtaacctctgcctcctgggttcaagcagttctcctgcctcagcttcctaagtagctgggattacaggcgcgcgccaccacacctggctttttgtgtgtgtgtttttaatagagtcagggtttcaccacgtgggtcaggctggtctcaaacttctgacctgacgatccacccgcctcggcctcccaaagtgctgggattataggcgtgagccactgcacccggccttccaacttcatttctttcaagtcacagtcatggaacatgtttacaacttctgagttacactattttggataaatagtcataaatatcagaaattgaaaattagattaattcctccttattttgatattcacctaggaaatagtttttctacagatattattctggcaaatctcagtttcttgaatctcagttccttgaatcttgacttttgtcgccacccttgatttgaacatcccttggcagctttgtggataatacagtgtgagagacataattgaaaagcatgacaagtgagaaaatgggttacatacctcaaaacaaaggctcattatacatgacaatgcaattcatttgggtctctccattgcatatttgctacaggtattgattgccttccaactcttcccacagccttttgctagtcttaaaggcataaatcacttggtgaaaggatatttctatttcagccagataaactctttcctttttgtttagatttaatatgaaggcaaaatgcactgctctcagtgaacagccttgtttcctttcgtttaatggggaagggaacactgaaacatttcctacattctctaggaaaagcaccttttttttttttcttgtctttataaccctgtatctgttgtcactgattcagctattcagtctgggacaaagcgacttttaagttctagagctatgaggaagctataaagggaatacagttcactctgtagagaaataacagcctgggagatcatggaccagaaatgttactctccaaaggtttgctagagctttactttgaattctattcatcaatatttttgttggcctggatcagtgactctaattatgtatagaagatagaaacagcagttatatttagcaagctggaaaagtccctgcagtctaccctcagaacagctaaacatacggagtcaacctgagattctgaatgctctgttcactccctgagagataatgatgactgaagagtgatagcgcagggaacagagtaaagctagaatgggaggcaaggaaagttatcagtcagacctctaggagaagtcccagcccctgccccatgcttttgttttttatttgtctaactttttttttttttttttggagattttccatttcaggcttttgttgcttttctcaaatgtcaaccctacctacctctctctgaacgaacagcccacactttctacttcatcaagaaaattgctaccacagggatgatatcatagcccattactgtatgatgctatctataccttagcctgggcttccaccatttctttgtctcccaaggagaagggacgtgactgcaccggatcttagtgtcatcttttctgcctcccattggggactgtgaagttattccaaggacagttgttccccctaccatagctgctagctccttccctcgtgccaggagccacttagtcacagggtaactgaagagaaaaaagaacgagacctattgctgagcctagagcaagctcccccatacctgcaccccacatgtgtaccaaaagcttgctttctctcccattcccaggtctttgatggggacgaagctaagaccatgtatgccattggccccaggcaataagaggtgcattgtctgcaaaagtcttaaaacaatattaaaatcaactaaaaattggtctttttttttttttgagacaagagtctcactctattgcctaggctggagtgcaatggcacgatctcagctcacagcagcctgcacctcctgggttcgagtgattctcctgcctcagccttctgagtagctgggattacaggcacccaccaccacaccccactaatttttgtatttttactagagatagggtatcaccatgttggccaggctagtcttgtttttattatcaccatgttccagcaattctaaacgatatcagcgttggggaggaaaaacatctcttctttctacctgtcttaagttcattggctggggcccctataacaaaagacagagtaacaagagaaaagcacacacgtttgttgaatgccagttttatgtggcatgggaatcttcacagggaaatgactttgctgagaccagctcagtgggggagaccctaacccagcggtactagaggaattaaagatatacacacagaaatatagaggtgtgaagtgggaaatcaggggtctcacagccttcagagctgagagccccaaacagagatttacccatgtatttatttacagcaatccagtcattagcattatttctatagatgttaaattaactgaaagtatcccttaagggaaaggaagggatgggccaaattaattgcagcaggatcacgcccttaagacacagattgctcatgcttttgtttgtggcttgagaatgcctttaagcagttttcctccctgggcgggccaggtgttccttgccctcattcctgtaaacccacaaccttccagcttgggcgttatccttccagcttgggcgttatggtcattatggacatgttacattgctgcagagattttatttatggccagttttggggccagtttatggccagagtttgggggggcttgctcccaacagacttgaagaagcagttaaactgggagtttttatgctagcttgagtgaagagtggagagtcatggagaaatgtgttaggacagaaaaagtatgagccgaggatagtcaactgggagaaacaacaaggtctgtatgttcacattcctcttgacatccctgtgtctttggagagaaagatgttattttcctccaggcatagggagggtacctttcacatgatctgcctcagggaaggatcagacaatctttgctatacatgctgttttccaaattccttcaacctaaaatattcagtattccaagtcaccatattttggggtagtatgtcttgaaccttatcatcagtgatgtaatattcctccccagaaaatccttttgttggtaagttacaaacaattgctataacgattgttgacccactggcttcctacaggcaacccagctatactcagctgagtgtcaattcataagggttggaatcatttgagtttgctgcctgcacagtttgtgtctctaagccctgtgatactacctagtcctacgtttaaaaagtaggttcaaaataaacaatggtaatacaacaattctaagggtaaagtgacagagcttgccttattgcacttttgtgtgcagatctttctctaaccttgtagcatttattcctttggacgtgtttcttttatgctctccttctcccttaaaataaatacttaaatgtaattaaaaattattaatccattactttgtttccttttttgtactgtgatagttttctaactgacttgaatgtacatacaaaatttaataaaagactatgttttatgtttgccattattttttggcttttattactattattttaagaatattattgaaggcttggcgcagtggctcatgcctgtaatcccagcactttgagaggccgaggtgggcagaccacccgaggtcaggagttcaaggtcggcctggccaacctggcaaaaccccatctctactaaaaatacaaaacttagctgggcatggtggcgtctgtagtcccagctacttgggaggctgagacaagagaatcgcttgaacctgagaggtggagcttgcagtgagctgagatcatgccactgcactccagcctaggtgacagagcaagactccatctcaaaaaaaaaaaaaaaaaattattgaagacaattttgttgtgtagaggaggagggtcttaaatgatcctctctggctgtcagatatgctggggactccctgtgttcctgcacacctgcccaggctctctcctctccttcctccctcattcctgcacctagaatgttttcaaaagttattctaaaagcctaaaataacttccgtgaagacttgctgtgataattccagctctttctttcttctctgaattcttctaacacattgtagttttccatacaatgtagcaagtgatggtatgccagcttagactttttctaatactttttttcccaagatagaatgtaagctccctgaaagttggggttagccttatatttcttcttttgtgtctccccaaagacaacttttggaagtatcccattaaaatgtatactctgtagaaaccagctcaaatccttcaaaaacagctcttctactcctgcaaacttcattatcctctcataactttatgtgatcatttaaaatcaggtttttctaaaacttcggtctgagtgaccaaatgcaattgcttatcttcaaggaaatagtgcttgctttaggcattcactccagaggcacacaaggagagataggtgaaatcaacatgagcagttaatttctggtttcacccgtaaaatactgatttctgtggtttgaatgtgtccctcgaagttcatgtgttgaaaatgtaattccaatgcaatagcattgggaggtgggatcttcaaagagtaatttggtcaagagggctctgtcctcataaatggattaatgccattatcttgggagtgggttagttatcgagagagtgggttgctaatgaaaaggatgagtttgttccattttcctgttgctctcttgtggactgtcttattcttctgcctttcactgtgggataacacaacataaagaccctcaccagatgccagcccctcaaccttggacttcccagcctccagaactataagaaataaatctctgttcttaattatccagtctgtgttattctgttatagcaacacaaaacagactaagacagtgactctacaaccctaaagaggtagtcactgaagaactattaagcattctctcagttgtgtcagtgaaagccatctctatttgtgttccctatcttaagccaacagttctcaaaatatgatccagggactcccaggagtcctagagacctttccaggggttctgtaaggtcaaattatttttataacatgacccagacattatttgcctttttctctctcctaagtgtgtcaaggcattttccagatactatatgacatgtactatcattatagatttagcgtggaagcagatatgagaagccagctgtggtccattaagccagagggtaaagagatttgccaagaatgtaaaaagaatgtcttctcatggagttttttgtttgggaaaatagagtaataattcataaaaatttcctatttatgttaacatatgagtttattgctaattttaaatcaattcataaacacatattttttaatttttcagttttaattttgtatacagcaaataacactctatgtaacccacatatacaaaaggtccttgaggccctcaataagagtgtaaagaccaaaaagtttgagaacttctatcttaggccaaagcagagatttttagaaacatattcttttaattctttctttggttacttacctccaaatcaaagcaatgtgctgcaactgaatccagtggaaaaattaattagctctatgttaattctttggctttgctgtgaaaagcctgatctttgggccattgacatctgttagaaatttaaactcttgagccctgacccagacctactgaatcagattctgcattttagtaagatcactaggtaattttaacctacaggttgagagttatgagcactgctccactttgcctttgtgaatctggctgggatctttttccaactttattgaccatgttaattaactccctcttttttgattctctcctaataaggcttgcagctataactgcagtttatcctgataaaacttatttctgtagggggaaaaaaataatcttctccttcactcttcaagaatttttagctgggactccctgtaacaaaaggtagattaacaagggaaagcaaacaaaagcttaataacatgtatacttcctgtacacatgggagataatgcagaaaaatgagtaaacctctagagtagatctaaaaaagttgtcttagtcttcaggcttaaataccatcctttgctaagacaaaagaaagttatagggaaaggcctggttaagaagaggtggccaggaaaagcatcataaacaaaaccaaggtttgttatgcagatttaagtaatgccttctgcattgataagagtctctagtgatttagacattttcctcttcctggtgcagagagggagacattcctaccaatagggatgtcctgtatagatgtaaatttatgttacaaaagggtaacttttcagtgcttcttctgtatgtgcagtttctcaaaataaccagttcaaaataatcccatgccaaagaggcctatttggatgggcatattctggtttcctacaatcatatgttgggatgacatgtcctgaattccatcacttcctaatgaaatctgataaaggactgacttgtctgacatttattttcatcctacaatgtgaatgcaatgaaggatcaatttgcaattgtattttttatggccttttggatttatgcactagagaggtgctaaagctgatgtgttgattcaagtgaggagtaagaggggtgagaaactgtgagaaaaaaaagtactataaagacacatgcacacgtatgtttattgcggcattattcacaatagcaaagacttggaaccaacccaaatgtccaacaatgatagactggattaagaaaatgtggcacatatacaccatggaatactatacagccataaaaaaggatgagttcatgtcctttgtagggacatggatgaaattggaaaacatcattctcagtaagctgtcgcaagaacaaaaaaccaaacaccgcatattctcactcataggtgggaattgaacagtgagatcacatggacacaggaaggggaatatcacactccggggactgttgcggggtggggggaggggggagggatagcactgggagatatacctaatgctagatgatgagttagtgggtgcagtgcaccagcatgacacatgtatacatatgtaactaacctgcacaatgtgcacatgtaccctaaaacttaaactataataaaaaaaaaaagtaactgtgttttcttctgtttaatgattgttgcactctcctacaaattctctttaaggaaattttcctagaagccttcttccttgaatttgtaagaaagtggcttttcagtgggttgacctcttggcttttacatgtaaatacaccgaaaaaaaaaaaaaaccccaagggatgtaaaaacattgagaagtttctcaaaaaaagaaaaaagaagtccatttagtctggtataactatgaagtaaaataaatcatagtatctgagaaagaaggggaaaatattcaattgtcaaaattagcctgtctcatttatttggccttggagaataatagtcattgatatagaccagtgggtttcaatcttgaataaacagaggatcacctataaactcaagaaaaagcccatgtctgagagattgaattggaatttggtaggtacttatctttaaaattttgacaaggtgattatgaaacacaatgagaattaagaatgtatggtatggtcaaatacgtgagcagatggaacacaaagtccctagtctttaagtgtgtggattcaatcatttattcatttttctttatccagggttagatcctgtaggggcaaagataatttccccctccccctctgaaggttcaagtctgctgaaatgaactgatgagagagattaacagggcaaaggcatacaagtttattaatgtgcataagcatggaagccatacaaaaaaatgaggctcacagaaaggccagatagctgaagcttaaaaagcactctctttgtagaggagccagagatggtggatgcatgaaattgagggttagtagtaaatgctttttaagagagcttaatggacccaaagaggaaacaatagtttataaatgattctctttggaagttgaatttatgggacggtaaggggcagaactgcaaagcaaacgaaggttgtctttttatgcagataaagtttcttgggtaatttcctgaagcggtcctcagaagggtagatgaaaagtttgtctgggtatggtcagaattttgctttcttctcttctccagtggttaatctttcttgttaatttaatgaaattcctagggagggggtttaagactattacaattcttttagaaaaagttttcttaatcagatagggaaattccagagagaggtcctccctgcacttagaagcaaggaaaacagaaagttagcaagtccttggttcagaggcactttctgaggtattccaatttctttcaattcaaaagtggtcagcatgccaaagcactttactttggaatatcatttttctgagccacaacaggcctgtccagagatttgaattaagcaaattaacacaggaacagaacaacagatgccacatcttcttatgagtgagagctaaatgttgaaaatatgtggacataaagatgggaacaatcgacaccagggactactagaggggaggatggaaaggggagcaagtgttgaaaaactacccattgggtactatgctcactacctgggcaataggattgttcattcccccaaaccttagcttcacacaatatacccatgtaacagatctgcacatgaaccccttgaacctaaaataaaagttgaaaagaaaagaaaaatgaataaatcctgtttaacacaagaattttatggccttatacattttctaatgactattagccaagtgggaaacttgttgaaggtgtagagaactaagttcaattcctcatttattccctagatgagctatgccattggagtgaagactctgaactaaattaaaaagaatgtgttagactagtttttgtaccatagataagatggatgcacttgtgctttttaggtacaggaattcagacctgtggaagatccctggagggttaaggaatgcaaatctgcattatctgtaagccaaacatgtaatatgattcactcatgcgtatgcccgccattctttgtcaaatgtatgtgtgggctttattgacagaaaaggttttcaaaaaatcatttagaagcaccactgaacaatgattctttttatcagttagtttagaaattattaatgaccatcaactatgtatcaattacatgtaccctgggatacagtagtgaatctgacagccctaaatcagggagacatacagattaacagatgattaccatctagtgaatttagtgctgatcccattatatctatctgcagtataaatttaggtgtctgtaatcctagaaatactgctttaaagccagcatgtctgctcccatctccctgttagcctgtacaaatctgctcaagtgttaattagtaatcccaggagagaagtgctgtcattcacaattttctcaaaattacctctagaaatagtaaacagtggctcgtaactgatgaatgtgatggttttagccaaaacatattctcaatctatgtctactcaaagtagggcaatagtcatgatggggggaggggtgatagtaaaaatgcattaacatgaaaatgttgaaaacaatgatgcagtccaattatctctttatagaggaggactctataaaatgttaagagagatacaatgacatgttctagattcatggtctattaactcttgatcctaggtttctcaaagggctgaactgactcaaatatactggggactccctctgctcctcacacctgcccaggagggttacttctcaaggtcttgtgccagccattagtgttgtccactcaaactgctcaggaagcgtggtaagcacggtcagttgtgtcagcatttgcacaaagtcagtgacttacggtgcttccttgtggaggagttctctatccaatggtgccaggcttggccatgtgacttgctttggtcaataaaatgtgagcagatgtgatatgactatccacatccgtgcttaggctgtaagagccatcatgtgactcagccatgctcttctctctgccatgagaatggcatattaccataggaaatagtccttcagcctgtggagatagggcaaaacagagccacggcccacctgccactggcatgtaaggtgagtaggaaataaagctttctttgtagtgtacacccctgtgattggaaggttatttgttactgctgcataacttagtgaaagacaacttatatagtaggccagagacctgccaactttttcttaaagaccagatagtaaatattttaggcttgtgggccatttacagtctgtcatagctactcaattctatggcaaaagcagctattgacaatatataaacaaataggtatggctatgtgccaataaaactttatttacaaacacaggtctttggcttgtgggctgtagtttgcccacccctgccataggattttgcttcctcacctccttgaagttggatgtggccagtgaagttgggtgtggcacttgctttgcctagtggaatgcaagctatttaaagaagtggtgtaagtggtggctactctgtcagtctgagtcttgagagataccattagagagctgagcatcggccaacctatgctggacattcagcataactaagaaataaaccttattgtttaaaaccactaagatgtatggggtgtttgttactgcagcatatataactgcgcctatctgtactgatacaggtctatctggcattacgtttcggggcaccacctctgctcactgccatcccagggcacctcacgtggcattctttgttactgacttctttataatgtttgcgttgtagaccacgatgacagaatttacttaacgatgatgttttgattatcatgcaagtgtgggggaggattgttctgttgaaacagcgtgactgcaaatattttaccaatagatcagtgaaattcacgtgcccttgaacattttcaaaggtatgaaatcacctgaaataattttttagttcattttttagtggctaaaatctgttaatagtttgattcacaagcctggcctttgaaaaagtaaaaattggataatgctgcacaagccatgttctccctggtgtgtaagggttaattattggactcttgcttgatgatgacagtgcaggttcattgaagtcatcactttatatcaccagcctgtctgcagcactgttggggccacgcctcttgtgcgatggttggctcagacctgtagcttcctttgccttatcccctttcacattgaagcctcatctgctgcttgacagtgcatgcctgagagttgcttttccacagtccctgttcttctcctaggtctggttaattgcttctctgttaaacagagaacatgttgaacagcagccttaaattattgtccaattttagcctactgggaacccctctgcagctactctgatcaccactgatatttctagaaagttcctattcacaggggactcttttctcccttctttatgctcaagggagaataaatcacagaagcagcaatccctccatgtgtcaaactatcaatcctacatggagctacaaaacaaaaggcagtatccctttgttgccagagaacatccagtccctgtacaagtctgtgcctcaggggctcaggctcattagcaccatagcagtggctcatgctttccatacacttttctctaccaacacctacagttagtctcagagttgttctttatcatgataggttacagagcagtgttttaaccatattaccttgactgaggtatggtgaggccagatgtggatcaagagaaagaaacagggatggattttatggttttgaggctcacagttccctggggagacacagcaggctgtgctgggccactcagcggaagcacagagtgaggcatgaggcagagggagatgggggatggtagggaagcagctttattgtcgtctccagggaaaggaaaaggaaaggcagggtatgcaggtttaggattggctaatttgaaaatgttcttggggctctggggcatagaggctgtccccggttgtctcatacctggccccagggtgatgaggtaggtccacggtggcctagggtgcaagagccacttaagggaagtggtgggagtttaaactacttggttgactcctcaagaaggggaactgactggcctctagctagggcctcaaaacagggtgaagacagtatagaataaaaaatatattacaactaggacagataccaacatactgggggtttgtacctaccacagttattccttacatttatgtttcattttgtctagtaatagtgaagtgaatggagttctagactgaagtctctgtttaggcagactctgaatttgttttctcattggttcccagagatggactgagatacctcagtcctgtggatacctcaggcaggcttaaaatgtggcacaaattctctttaactattcagttgatactttttcgtgagggcttcaaagaggctgattttctattgctaaaaattgcatacctctctatgttcaaagaaaataccatttactttatatatgaaagagcatttgcttatttggaaaacttttatttgcatttcacattttttatcacttcttactaaatagaagtttctcacattctctagggattgaactaagtgataacttagaaagaaagtattgttcaaatacccattttttggcttttatgttagtaaaatgtttcccctttttctagcttttctttgtgatttcagaaacgtgcaacttctttgaacgcatattaaatgtttttaaatttaaataatgaaccacttgcttttgttacagcccagtggttcttcttgcctgctgcacagacagagccaaggcactgagacagtagtgttgcagcgagaaagatttaattattgctaggcagtcaagtgacagaatgagaggcatttctcaaatccactgccccaagagctcagaggctagggtttttaaggataatatggcatgcagggggctagggaataggtgctgctgattggttaaagatgaaatcattgaggtcttcatgcactgagtcagtttctgggtaggagtcacaggaccagttgagtcagttccctggtgtgagtcatgggtccaggtagagtcagtcagtagccagaatgcaaaagtctgaaaaatatctcaaagaccaatcttaggttttacaatagtgatgttatctataggagcaatttgggggcattaccaatcatgtgacctctggctagatggctcctgagcagtaagaaattatagaaaagcaagctaggggacaatggttggttatcatttagttactcctacattttagcagaattcaggcccctcccataattctaaccttgtcgcttttcattagttttacaagggtggttttcagtccctaaacaaggagggggttagttttgggaaagggctattatcatccttgctttaaaattaaactgtaaactaaattcctcccatagttaggttggcctatatccagaagagttagcttgggaggttagaagcagaatggagtgagctattttgctgactagctttctgtcattgtcataatttttagaaaggtggtctcactcttagtaaacagtagtatgctatgctttactcagttgtataatttcatttgaattcaacaaataactacagacagctgtcaacttagtgatgttgagattggggctaggcctgcagtaatcctctgaaatatgtatgtgcaccccaaaaacatgtcattgagatgggtagacacctgcaagaggagtgcttttaaaacgtttttacatgaagatgctttctacttcagtgagacttttgccagtggtgttagaagttgctgtgaaaaccaagataaggagccactgtgtttttgatttgttctagggatttaatatccctcatagttaatcactcaggcaattactgggttaacaatatgtcctgaagaagagtagtttttgagccatgttctttgaatcactaagattcttcaaaactgctttagagtttcccatgaacatttggatcacattaaagcaggctcattatttccatcttcatgtccatgtaaatgaggttgagttcttcacttggttctcagctttagtgttgttagtatatagaaatgcacctgattttttatgttaattttgtatcctgaagcttcattgcagtcgtttatcaggtctaggagtcttttgcaggaatcttttgggtttctctaagtataagagcatgtcactggggaccccaaaagtgaggaaggtgggagagaagtgagggttaaaaaattctctattgggtacaatgttcactatttatgtgatgtgttcactagaagcccaaaccttaccattatgcaatatacccatgtaacaaacctgtacacatactttctgaatctaatataaaataacaaagaaaaaaataacaaaaagtaggctcgttagtaagacaatagctgaggagccctgaggattggtcaccttctagcagagagaggaagggccaagctgatttacaacagtcctgatcaaagaagggtgacctgtccagggcaagtccacaagcctccccctctgtgtcatgaggccacagagcactggagttccatgaagtcaatggaaaagaagagttctactgcttaaacaagtttaaaaaccactgctctagcattgtttataagaaaagaaactaagaataaaaacaatactgaattcaaacagctaattccttaagacctgggaacattgtgtgttcttatgcagttataatttaatccaaatacattggaaccacaccataattcaattctaggtcaagagcagagttttgtatacagcagattcattttggagcactctctggggatttggttacagaaaaatccagaggatttatctgggctgtcttactcataaaactgcacaatggcctagattttagagatgacattacagtgaggtctcctccaggacatgctatggtatacaccactatacaccacttaatctttagagggctcatttgaatcacattatttatgtagtgtgtccacatgttagatttggccagattctcaaactggggtgtcagttccacgtctagcccattaatttgttgccattgtgaagacagtagacttgaatgccttcagaaggagcatgctgtactgcacaagtgcgaggggcctcattcctaaagtgatcacactgtgttttagggaattgtgcccctttacaatgctgtgactttgggtgacactctctagcttctatagtacccaagtctgggttgcgtctgaatttgaaatctctactatgagactgtattgtttgtttttaaagtcgatggagcacttgacttggagccagaagagaaagcttgggtcttcacgcttcttgattaattatcaagccagttaattttctagagcctctgtttattcatttgtcaaatgggacaaataatgtctgtttcacagggcttgttgtgaagattatactctgttgtgttatagaggtttaaagtggacctgtgggtttgtatgaaatacagcaaggtaacataaattaaaagtagatgagggataaaagcggggaaagggtctaaaatggggttaacaagttgtaccttttgtgcagatctatatgcttgctaggaatgagccacaaatttgcttctgtgccctctagcagccaaggagaaaatggaaaccttattttctttaatcatggtgtctacgagattgggaacacagtagggagtcatgaaaaatattccttttcctagtaacttaacagagagagaccaccctcaggggtctgcaaaagaggacattgcatggtacagcctatagtgtctgctacacagagaggttgcaaactggcagtccaccagtgtcaccatttgttgggatttttgttttgttttgtttaggcttgatgtctaaaaagtttgatccaacatttaaaagaatcagattttgcaaaaataacatttttaagttttctttcaaaatcagatgatcagttaatattgtaactatatatcaaaattaattggcactgtgtagcagcttttttttaatgtagcaatgatttcaggtttgccacagtctccaccattccctactgccttacttactacattttatttcctacttggcatttaggcatctgatttagtgactcctattctacagcatccttgtagtaggctcagcagtacgcttcataaggctgagaatccctgagaggattgattgatatgggaaaatgctggtactctgtacaatattgttctacaataaaaatgtagaattagaatattgaagttactgttagaactttgaaatcatgactgagggtttaaaaatgcttaatgagggccgggcgcggtggctcacgcctgtaatcccagcactttgggaggctgaggcgggtggatcacgaggtcaggagatcgacaccatcctggctaacatggtgaaacctcgtctctactaaaaatacaaaaaaaaaattagccaggcgcggtggcaggcgcctgtagtcccagctactcaggaggctgaggccggagaatggcgtgaacccgggaggcggagcttgcagtgagccgagatcgcgccactgcactccagcctgggtgacagagtgagactccgtctcaaaaaaaaaaaaaaaaaaaaagcttaatgaacgagagtctcaaatagctaattaaaacaacctcaacttccaaactaatctcctagcaagtagtttacccagagtatccattccaattgctctttaatcaaataaaaatttcagaatattttatttaaatatttacatagctatatattttcatcagaaaagagtatcacaggaaagacatgttttaagtatgcttttaactgtataaagtttgattgttaggctctatgatctggtgacaatagtcgttactgttagaggtgaatccttgtaaagttgttatttttgtcaaggtccactttggcttctagacttgttgagtttggtaagatgttttgagcgctgagttgctaattttccagaaatgtaatttgcaatgaagatgttggatggggctttcccaattatcagaaggaattctccaaagttgaaaatgagtgataattatctaatattctaaaacatgctgctagacatggatatagagtgtttaataaaagatgtcaaagttgtgttgtggccaccagccaccatcacagctctagccaacattagagatgactggtgatctaggaggagattgtggagggttatctcagtgaagagcctcataaagagtattggggaattttccctcccattgccgtggagagaagagatgagtgctcttaccctttccccaagccaagagagaagagctctgatctagagataggggttatggcaaccatgggagattggcatctcacttcccacttggatgcctgcggagctctctccaggcccatcagaatggagcacagcgatgattttagggatctgtgagcatatatacagatgcttccaacatacagtatttgatagatgcaaagttgctagagcagcctgtgaaagtgaggcaaagaaaaagatgttcagtggttgacaagctcaacttccaccatttggcagagaaagatgtgtacattttcgtggggccaagcaacatcaggaaaggtagagagtttgagcaattgttgctggttccttgtccagaggtggccttttgggttgaggcaacccagactgtgagaaccctgacatgtatgttgaagtagaagatgtgtgttttgggggaggggctcacaaaaggctggtcaaatggttcttccaccatgctagggaacttggaatagagggtccatgtgggcctctgaagaacctacaaatgcaccctgtgaaggtcccaggatgtgactgcctgccttgcacagctgactttggtagccaagagaattgaaaacagcacgacctgatgtaagaagatgttccgtttcctcaccactgatgtcacttccctgtgttaacctgagaagagctacggcacagagtgatggaggagagaatgaaagcagaggaggagggtaaaaggaaaggctacagtcccttccccactacaggtcatacaaaaggaggagggaaaagctttgagttggatatgagattgaagttttgatacgaaattactatacttttagtaagtgagtgagtcttagtttccataaataaggctattataagtgaaagtgatggaaaaatgatggggtcttcctgagctgtccagctgcagggaatggagatccactggaacaagtcaaagataataataatgagaaaaaaaaagattcttaaatccccaccattcaatgaaccagttaccaaacccacacgatacagagacattgagattccaatatgaatctctccacagaaggaggcaccttctcttgccatcttctgtgtattataaccatttttgggggggtttggtgcttcttgttcaaaattgaagtcttgtagccaaaagtcaaaatcatattcttctaaaattcacttgaaaaatatttccttttacagttgaattaaagcaaattacttggttaattaatgtcaaaggtgactctgttctagagataatttctgagtcatgatacctaatatttaaaaattatgttttgatttttatctttagtcatggtgatttcaaatgaggttattaaatcactgtaattcatgatttatataaaatatgaagacattaacctacaacatcttggattgctttttttttttaattgcattagtcactagtaccttctaacagttccagtttttggaaggcagcctctagtttcctattcagcctcatcatagctgttccttttggagagcggtggagaatacaggattgaaggtgaccctcacagcatgacaaattgtcaatctggctccctcagaaaccttatagggagtgtattagtcagctttggctgtcgtaagcaagtaccacagactgggtggcttaaacagcagaagtttattttctcacagttctggaggctggaaagtccaagatcaaggtggaggcctctcttcctggtttgcagaatcccaccttctcactgtgtcctcacgtggcctcttttctgtgcacttaagggagggagagagacagctgtctggcgtctcttcctcttcttctaaagacaccaatgctacctattagggcccatctcttatgaccatagttaacttccctaaagggcctatctctacatatattcacattggggattaaggtttcaacatataaatttgggggcctggggagaacacagttcagtccataacagagaggaagaaagagattcttaaaaagtgttctcttctgcaagttgacatttctgaaaaatatgtttattctccaaatttaagagacttttagaaccaattacctgtgaaattttcttttccaaatgaccgaaactcaactcaaactagctgaagcaaaagtggatattttttggctcacatagcagatggccaagggtcagatatgtcagccacagctggatccagggtcgatgtcatcaggtctttgtcctccccttgagctctgtgtccccccatgttggcccctcctcaggagggtccttttcctgtggtggcattgattacctggggcagctccaggctgatctggcccttagaatttgcagctttaaatggagagaaactgtctcccaagagtcaactctgactgcccccgcctgggttagggatacatattagcagcctggacccagggcctatctgggtggttatgggctggcattcccaacagctgggagaggaccaaatgaaagattccaggcagatcaaactgtaaggcatgtccacagtcttccccttctaagtttctgagctaaaacaacttatttgtcctttgtgacttgtataattgtataattgatagtccagagaaggtccaaattagttcatctttatatgtgtaagagattctatctaaaggtcatcagaacctttttgaaagtcaactgatgtcatgttggcctttgctggtgtttctctgcagactctccggacgacccagccttgtcaccacctggagatttggctccagcctggctaaccacaggctgttgacatgatggctgtggtctctctgcactcctcctccaacctcccccttctctatcctcttatgcatacctattgttgtggtctaaatgtatgtgtcccccccaaattcatatgttaaagtcctagcccccaaagtactagtattagaaagtaggtcttttgggagctgattaggtcatggaggcagggccctcatgattgggattagtgcccttatcaaagaggcttgagagaggtctctcacccctttcaccatgtgaggacacagaagacaccatccatctgtgaaccaagaagtgagccctcaccagacaccaaatctgccagcatcttgatcttggacttcccagtctccagaactgtgagaaacgaatgtctgttgtttatcagccacccagttggtggtattttgttatagcagcccaaatggactaatacacctaatgtcacccatctcatgtgaatgtaggtgctcatctcttgcctgaaattcttggggtcaagtgtgttctggaactcagtttctaatttcagaaaggccatatcgtatacacactgtttactgacacccttagcagagtctgggacagcacccagaaatccatctcattaacatttctgcagagaaacacgtgaacattcatactacgtaggataaagaaaatcaatagtagccttatatcagttcaggtcaggttttgtcaccaaacacattacgagaaaggtttgttctcagggcttttcgtaatttcagaattgtaaacaagggatcccgaatttatattttcttgtatgcattaagtgctacctttgttggactctcagcagctaggactggtctccataaaatttaaaacttaagaaacattttaacttaaagcactttaagcagcactttccaaagtttaaagtatgtaagtaaatctgtgtgagtagataactataaagaacaaactttcagccaatatcttcactttgagtggttactggggggcaaagaattagaaagccactatgtataaaattaaacatttttatttgttcatttctttaaagtacaacttattttccgggagaggaaagtactctcaccaaagaagatttttacagagagaaatcaggtcaacttgaaacttgtttgcaactctctatttgtaacaacctttgtggggttttcataaaaggattttccaagtcttttgtcttcaagaacataaattagaggacactcttaccaggagtacatgcagtttaagtacccaaaaataagtttgtttaccacttagaatcatggagttcaagagaattttcaagtttgcaatcctgggtctctcccagggacattgagagggcagaatcgattctagttttgctaatgcgcctgccaactggtgtcaccatttcccatcacgatatctcagttatcccatctgtcagctctaagagtctttgatgtatttcaacataccatgctttcaggaacctctcggtaccacgttctggtgcttggcagctgtccaggatgaatttgatgtacctctccctgatgcctgccaggagggagttggaggaggggcttaaaggattttctggtaaatccaaatgatcacatatgagctgttatcaatgtgggagaatggaattaggggatagtcttctcattagaattgtgaaaattcaggatggtggaaatactcagtatgaagattttcaggttggctaagtgtatgtgaaatgtcctaatttgaaaaacactttggatttgattgaattagtggtgttaaattagtggggtgtggtgggcatggtgacacggtgctgggcatccttgcatacatgacggatcagaaaaccagcaatccaggcaactctgtggccaatgcggcattttgggtccaagccccttgaccctgtgtctctctccttgcttcatgggaaatcctgccacctggctcagacacaggcctgggggttaaatggagcatgtgctgccaggtactggtcagtgccctcaagggtggagaagacctcttgggaaccacagacaggctgtagggttgtcgtgtttgtctgtttttaagtgacaggctgcttgatctcatcccattagtagtgacgttgctagaggtagagcttgcaaccacccccttcccattaactctaccatcaccacctgccgctaactactgacggctacccaatggccacaaggcacataatattcacggagagccaaagtggcttgcctgtgtcattacagtagctctccttgttaagagtctcttaaccatttccctccttcccacaccccactcttcacacatacatgtacatccctacctgagctagagccctgcttccatccactttcctggccttccccaagctgcctgtgcaaagcctcccttttctgctccctcagcctccggtttcttcctttttctatacctttccccaacaatttcagcctttattaaccttttccttctctaactatcagtcctatcgcttttttgggggggggggcgggaggcaggtgggaggtgtacagctcctcatacttgctgttctgtttatgtatgctctatagcaaactatccccaaatctaacggcttaacacagtaaactgtttccctatcatcactcatgattttgtggatcgggaattccagccggactcagctgggaaattcttttgctcctcgctgtattgaagggggtcgctggatactttcactgggcagatgggtgaactggaggtgattaagatggcttcacatgcctggcgccttggtgggatggctggaaggcatgttcagctgggtgtgtccactggggcttccacacatggtggtctcaaagtagtcagacctctttcaggtagctggcttccacaagagtgagcatttctagagaaaggaagtgtaagtggccaagcctcctaagcctgggcccaggatcctctctgctgtattcggtggttgcacagttatgccgtcctcccagtttttacctagcccccacctctctgtgtgttacaacaaagtctgccaccactattaatcttccacacgtgcctcctccattctcgaatgttcttgaagattatattgctttctccaaacctaaactgtctcataagtttttggcgcttaagacaagtttcaagaaataagaattgaaaagtgttggaggaaagaaagtttccatctctaaccactttctcagaagggcatcagggtttttgcagcaatgtggggatacctcttctgatctcatagcttagggctctgaactaaactgatggccttttctagatttcttcctaggggtgtcaggttggaagtgctgagggactgctctttctccccagggctcagctgtgtcaaggctaagaccaggagtggttcccacagccaggctgggtgagggcaagtttatcctgcggtgcagcacctcagaccagggtctagccaatggtggcctgcaggctgaccccagtccaccacctgtgagcagccaccaccacctgtgtttatactacccatgagctaagcacgattgtcatattttgtttgtttgtttgtttgtttgtgaggcagagtcttgctctgttgcccaggctggaatgcagtggtgcaatctcagctcactgcaacctctgcctcactagttcaaatgatttctggctaatttttgtatttttagtagagatggggtttcaccatgttggccaggctggtctcaaactcctgacctcaagtgatccgcctgcctcagtctcccaaagtgctatgattataggcatgagccactgcacccagccaatttttatatgtttagatgattgggaaatagattttaaaaagaataatatttcatgatacataaaaattataatgacatgcaaatttcagtgtccataaataaagtttctttggaacacagtcatgctcattcgtgtacatggtagctgtggctgctttcacactgtgagagctgggttgagtagttgtgacagcaattattagatgacctgcaaaaccaaaaatacttgctatcttgctctttacagacaagtaacttttttgctgttcttgccaaagaccaaatgcatttttcaaagctggattccaggctcagagttacagcaaagagaacagaaagtatagctcatgattgggtgctgacaggacaagggagagagacgaaaaccattaggagcattagcaacaaatatattttttgccattccaactccatggagcaaatggcttcctaaaagccagcagagaaactaattacctgaactgggagaagaatgaaagactcattgttagaatattcctcagagctgaatcccttctttcagcctactgtattttagtgattcctaataaaagaaaaaaatgtatttttgtcctcacagccaattaatttctgctccaaagcatagaatatgattatttctgtcattattttagtttccagagtcattgatgagacagggaatgacacatacctattaacacactcgcacactcactcacacactcgtgtgggtacatgcatttccctagaagatgtactggaaggatctgactttactttcaggtgccttcatgtcctcgcaattattctacaaatggtttttaagatatttctattgtatttgttgaaattttcctgacattttgacttgtctagacgattattcttgcatccagcacattgtaggaaacactcatttgaaataccccactgtgcttccgggggagctcatctttctggagcatggcgggtccctcatgaggccctctttcgttaaccgaagaacaagctgcagtctgaatgtgagttgttaaaggtatggtattgggagttttctgttctcctgttttcccattctgtaatgttttctttctttctttccttcatttcatttcatttcatttcacttcatagcaacttttgaatgaaaacctccccacagggtttgacaggcaatgaaacttcctcccttgggaggtgtctcagcctgagggaaatggaacagcaccccacagaggattttcctcacttcctccctctctcctttacaaatcaatgttaaagagcctgcatggatgtggttagcaccatctctgccgcatgtgacttttcagtcattttcacccgaaataggatttcattcaccagttactataagctactcgtgccttctaatggactttgcagcagtgattcatccaccctgtgctgggagagagaaagagactttaggtgagaaagaatggttgggagaggggagacaggtaggcagaacagttgtggtaccatcccgccccataagacaataatgatattcagtgttaggcgctttataccaagaaatattccacctgacacattatcctggttgaatcttatgacacatctgcaaatagacattaccaaatacagagggggacttttaggttcagagaggttaagtgacttgcccagtaacacactgctggcaattcgacctgatctctctctttcttccgccttttccatttcagtcagtggcagtgccatctttccacctgcttctgtcaaatgtgttggtgtgatttgatttcttttctgtttctcttgtatcttttaatccagcaataaatccctgctggctctacttgtaagatatacccagaatctattacctccgcccccccaccacccaccttgctccaagcctccatcatctctctcctggagcactgtgatacccttcttcttggtcatcctgcccctgccctgacttccctaaagttgatgcccaacacacaggcagataaaccagatcagacttgtgactgttttcccattctttgggcaatcccattgcattccagataaaagcggaagtccttagagtactgcagtttgcctcctagcccacgttatctctggccttcctttctcactttctccctccattccagccacgttggcttcctgctgtctcttgaatagtcagggcctttgcccatgctactccctctgcttgaagcactcttatcccaggagactgcatgattgagacccttacctccttcatgtctttactgaaatgtttttacagtgaaacctatcttaaatttttttttttttttttttttttttttgagacagagtctctctctggagtgcagtggcacagtctcggctcactgcaacctctgcctcccgggctcaagggattctcctgcctcagcctcccaaatagctgggactacaggcacccaccaccatgcctgattaacttttgcatttttagtagagttggggtttcaccatgctagccaggctggtcttgaactcctgacctctagtgatctgcccaccttggccttcccaaagtgctgggattacaggtgtgagccactgcacccagcctttgtatagctttaatgcatcaaatatgggcttagttcctcatgtaaacaattctcccaggaaattagaggataaaaagttaaaaatagcatatatgtcctgccctcaggaagtttacgttttgaaggggggatacaacaaaaagctagaatttgtagcagcgtacaacacatgccaataaaacttgcaactcaagccctgtgcacagagaaccatttggcagaaattctagagaggcttcctggaggaggtgctagtagaggagaccttgacaaatggggatggatctagatcaaattcccctatgccacgtgctcctctttgcgttcagaatgctcttgtttgcaagatttcagccatgtacaactcttctggcactcagccatggactaaaacgaggttcatgcccacagtattggtctgcagaaaagcatgagactggatgacagtcagaacaaatggaatcctctagggtagggagaagagaaagaaagaggaaataaaacagcataatcccaggaactgccaataggaaaggatgggagaaaggacaactggcaaagactctgatgtggtgtccagcctttcagatgtcacctgaggacgttgctacaattaacatgcagccagacacacacagtgactacacattttggtgtggttggcggcattagttgagtcttaaacaaaagcaatttcagttgcaaatcttgtgccaggctttcagagaaagagaataaattatgctgctgtgacaagctgttccactgtggcaacaatagtttggacttccagtgctgcctgtcaaccaggactgaaaatacatcttcatttgttgctgggcagctgggaagatgagtcattaaagaattttataatacatcaaaggccatgattttctacctttcacgcagttacaccttttcccaagtcctcattctgccacaaaaaacttttgaatgcaccgaaagttaagtagaattccttttaaaatgttctgttctgtgcacatatctctaggggaagtgcagaagacatggggcattcccttttgtcatgcatttcagctccataaagatttattgaccacctactatatgccaagcattatgttagtcagtggggttaaaaagatgagcaaattgtggtcttgaaacccatgccttttgttcagattattacagtgcaagagaagcagcatcagccatgtgtctgagaggccagaggaaggagagagtgaggaaatattgtacctcattaatattgttcctctcgtttcaccactgtattaatctgttctcatgctgccaataaagacatacccaagactgggtaatttataaaggaaagaggtttaatggactctcagttccacatggctggggaggcctcacaatcatggcagaagttgagagaaaagcaaagggacgtcttacatggtggcaggcaagagagcttgtgcaggggaactcccatttataaaaccatcagctctcatgagacttattcgctaccatgagaacagtatggggaaaaccacccccatgattaacttacctcccactgagtccctccacgacacatgggaattatgggagctacaattcaagatgagatttgggtgggcacacagccaaaccatatcaaccactgtagacatgaccaagttcagacttggtcagtagtcaaatgagcctgtgagagaatggtgccacatctttcctgtaagagcacagcattttaacctgcgatggatttgtgagcagtcattccaactctgtattagttttctacagttgctgtaacaaattaccacaagcttaatggcttaaaaccatgtaaatatattatcccacagttctgaagtcagaaatctgaaatagataggctaaaagcaaggggtgacaggctgcattcctttctggaggctctaggggagaatctgtttccttgccttttccaacttctagaggccgctggcattccttggctctttgccccttcccttcttcaaagccagcagcagtagttgagtcctccttaacacagcatcactttttttttttttttttgccttcttcttccacttttaaggactctgtgatggcactggggccactgggataatcgaggataatcttcctattttaagaacagccaattgacaaccttaattctaagcaatcttaattcccttttgccatgtagctgaacatatccaagttctggggattaggatgtggatgtattggggtggggaaattattcttcctaccaccaaccctcatccatctctaaaggcactgatttttttgataaatcagataagtaccagagatgtgtactctgggctcaggagtgaagagggttagctggcctttgccaacagtgacttcatatcaccatactcaatgcaattgaggtgacttaatcaaggggaaaagatggacagcatgttttatggaaatagcacttgcctggtaatcaggagacttggattttagcttctctccttcaaacagactactgagtgtcagtaggcaagttgttgaactgctctgggcctctgtaaaaaatcaaggttgtggttagatgttctcaaatcctctttcatcctctagccttccatggctctcaatttctacagggaatgtactggaaatggagagaggctagcctgtggaaaatgcagtgccattatttcagcatcaaaatcctgaaataagatacagaatgttgtgtaatatacagctcggtgtctgtgcccttttatttctctcttgggcccagccccatcatcctgtccttgatcattgtaatgcagtgttcactaccagtcttttctccccctacattggaaattatgccaaaagagtaatgaatgaattaggtaaatgaattagatgaattagagataaaattatggctctacagttgaaatatcagctttaagagaatcgacttggagaccaggtgcaatggctcacgcctgtaatcccaacacttagggaggccaaggcgggtggatcacctgatgtcaggaatttgagaccagcctggccaacatggcaaaaccccatctctactaaaaatacaaaaaattagcagggcgtggtggcaggtgcctgtaatcccagctacttgggaagctgaggcgggagaatctcttgaacctgggaagctgaggttgcagtgagtggaggttgcagtgagctgaggccgtgccattgcactccagcctcggctacaagggcaaaactccatctcaaaaaaaaaaagaaagaaagaaaattgacttggagatgtacgggttcacatataattgaaagtgagcattccacagtgacttgagaaagttgattccggctttcaaagcttgcattatgggtaagaaacttgagcctaaaaagaacttatatgtatgtgggtcattagacaatctcctccctcaccacctttttttttctttaatcaaagaattatacatatgcaagtaactgaatcacctcttctttcatttttttccctctttaatcacagctgtgtggaaagtttccagctaggcattaaattgggtcaacagctaacacagcataagtgtggacagcaggggcaatcggtggtatatacataggaaataaacgacactgtgctgctggcattgataagctgttgaatagtgcaagggccctattaagatttaaagtaataaaagatgggaggaaatatggttaccagcagctgataaacattcttgccttatgaaggcattagtttcacttaatggcttctagtgcctggagtataagctcttgtaatttttctcccccagagcagactgaaagaatacctaggaattgtcatctttgtagttgctcaagaaagatctttgggtggctgtgagcagatctgaaaatagtaagtatggcaggtacatggagctgcatccgtttgcaaaagctatcaataaagaaaggtatagaaaggatgcccttgaccccggtatgtgcagatagaagtggaatttcctccggaatgtgcatgcaaatgtgcctagctgcaaaagaagaggcattccctgctcaggtgtgtagagtgatttagaaccatttgtttctgctcaatggttctcaaatgaacagtatttcctcactaggaaacagtgctaattccaggctaggacggtccacagagatggtggctgtgcccagatcattcttggaaatctgaggaagggagtcatttcttctcatgccacacccagtaaggggtacattagatactctatttcctccaggcagatctacagtgaccaggaccacgtactaggataggagaggttctggcactattcatcattggctccggaaatagctttcccctctgagctcaaaggtaggctcatcctctgctagagtctattaggtctggtgggattggaactcaggtgcatacccctgggctctccaaccactagtgctgcatccagggcttggggtcctgctttgtgccatcaggtcatcagtgacatgactagggcagctcaacccgcacctctggcatcactgccttcctcccatggccccctagcatgaacccaaagaccacagggccggttccctccttcaggcccaaggctgggcctccaaataatggcctcccaaagatgcccacattcacatgcccagaacctgtgcatatgttaccttatgtggcaaaagagactttgaaaatgtgagtgaattacaatatggagattggcctgggttatctgggtggactcaaagtaatcaataagagggtgacaggagggtcagagtcagagaagaagttgtaatgatagaggcagggagccatgaaccaaacagtgtagacagcctctagagactagaccaagcaaggaagtggattctctcccagggacttcagaaggacctcacccctgccaactcatccgaggacttctgacctccaaaagtataaaataatacatttgtgctgctttaagtcactgagtttgtgataatttgttataacagcagacagaaactaatacagtttatcttattcctttactcatgatcaactactttggggttaacgaacaacagtatatttacttccttcaatgaaacacttacctccacccaccagagtgaaagtttgtcaccctggttccaacaaatgccacaaaccactgtatgatcatctttgggtaggtcagcttgtctgctatggtatttttcttttatattgcagtttacaaagtgctcatttgtcttgtatgatagttatatatggaaggtagcattactatttcacttttctgattttctaaaaaatatctttaatgaacacatattaattttgtgattaaatgacacaataattagaaatgttaaaaggagatggcagttttagtcacttaataaccataatactaacaaattcaggccacatgctatctcagtggatagtccccagaaccaagttaggctagttcatgaggcatttcagatagctgaagggactaagtatacactggaagattgggtacgaagatcaaaagacagctctacaacaaagcttcatgggccattggtttcacagtagggggaactgaaatccaggctacagattcaaaagcttacaacctggcaatttatgtagcatagggaatcaatgtctatagtcttaattacatagaggctaaagcctcaattattctatttctgtaggcaggattcctacataatctatagcatctattggcataaaacattcttagtggccattctgggtacaagcatcccatttctctttctgtccttccacacactaccagtgtctctcgcttatttcctcccaactctaatgttcatatgtgggttatttgagcttctaagttaattccttgcctatatgtaaggaacatattggaaaattataaccaaagtgtagtatatattgcagagtctctacttcccatgagcagctttggagggtacctcacaggagagggttagctggcatctttccattaggaagccagcatcagcacaaggggaaaacttctctccaacgtctagacctctctatcccatgagactttggggactgggactgggtagcagggcagaattgggggaaggaggcacttaagagctttttaatttcaatattctaaccattagtgagggtgtgctgctgggtacatgtctgcccataaataaacatggactgttcattgaaacttgcatttttatgtagaaaagctcatgctaccttatcactttttgcacaaaagttgacacattatgaatgctttaaaaaaaaaattataccttactcccatacactgaacatatctttcctcatctaaaactatccaagcagccaactttttaaaattaatggaaggagagggtctacagcatgtattctcaatgggggcaatgtagccccctaagggagccaaaattggttctgggttgggagtggtgaaaaaagtctttaaaaaaataaattgcagaatatacatgcagcacatagattgatatatatatctgtgatattaaaatttcatatggaggtagttgggaaaaaatgtctaaaaaacctccttagggtgatatttgatatggttttgctgtgtccccacccaactctcatcttgaattgtagctcccataattcccatgtgtggtgggagggacctggtgggagataattgaatcatgggggtggtttcccccatactgttttcgtggtagtgaataagtctcatgagatctgatggttttataagggatttctgctttcacttctcattttccttcttgcctattgccatgtaagatattccttgctcttccaccatgattgtcaggcctccccagccctgtagaactgtgagtcaatcaaaactcttttttctttaataaattacccagtctcagatatgtctttattagcaacatgagaagagactaatacaatattgaaaaaaaaaaagttgagaaacactgatctatagtaaaatttaaatatccaacttctactatttttttggctgtccattcccagtagaatacaagttccatgaaggcagggatatttgtcttttttgtgcactgatttctcctaagtgcctagaatggtgcctgggatgtaggaggtattcaatccatacatattgaattgaatgcatgaatgaacaacttccctcagtgtcccagagtccactttctctcaacactgcaagtggtggcaagctggaaggtttgtgagcagtgctggagctgggctcttccaggtgcattcacaatagtttaaaatagcaggtgcatcagaggaggcctctttgttcctggtactatgctcattgatgtttactatgagccccttgcagactcaagcatccattgtttgccttttaaatatctctactagccgggtgcggtggctcacgcctgtaatcccagcactttgggaggccgaagcgggcggatcatgaggtcaggagatcgagaccatcctggccaacatggtgaaactccctgtctactaaaaatacaaaaaatgagctgggagtggtggcacgtgcctgtaatcccatctcctcaggaggctgaggcagaagaattgcttgaactagggcatcaaaagttgcagtgagccgagatagcaccattgcattccagcctggtgacagagagcgactccatctaaaaaataaaaaaaaaaaattttaaatttaaaaatctctactctccaggccaggtgcagtgagtggctcctgcctataatcctagcactttgggaggccgaggcagtcagattgcttgagttcaggtgtttgagaccagcctggtcgacatggtgaaaccccgtctctaccaaaaatacaaaaattagctagacttggtggtatgcacctgtagtcccagctatttgggaggctgaggcaggagaatctcttgaacccagaaagtggaagttgcagtgagcaaagatcatgccactgcactccagcctggacgacaacgagactatgtctcaaaataataaaataaaataaaataaaaatcctctactgtctacttcccccacccctaatatcctagctatgtggcccaagtacttatttagcccagtccatgaaagtaaaggacagtggacagtgtcctttgataggaggatggggcagaatgggaaaagaaaatggtagggtctggaggtacaagtgggggccagagagaggggctttacagattattcgggtgtttgaaagtcagttggtgttatctttaacatacaaacatgtattatgaatctctgagcatccttcaacgattcctgaattttcaaaacagttgtgtccaaatgacacaccttgtccagaaacaatttggttttgatagaaaaagaggcaaaataaaaacactgatttacaggctcatggtgaggggtttggggaggcagatgagaagagaacctagaaaggatgtcaagagcagacttagctgacctcactttgctttgggcttgctttcctacagacattgacagtgagagttgtttttgctcaccacactgggaatatgtattgcttaggagacacatggcagttaaggcaaacagcacatgccaacaatatgttgcatgatttgatgcctgttttcagggaacttcactaggaagtgtgtgtgtgggtttatatagccacgtacatacatatacatttatatatgttttatatacttagaaataaatacggaatttgttacaggaacgtggccttacacaatcatgggagctggtctgccatcttcattaagccattgtctggtacagatgctggagtttgaagtctgtaggataggaaatcagatgttgtctcagttggcacctgctgcataatacggtaccatagactaggtggcttaaacaacacacatttattctctcatacttccagaggctggaagtccaaaatcagtgtcttgcagggttcggtttctggtgattccccacttcctggctgtgggcagtgccctcttgttgtgtgctcacgtgacctcttctttgtgcacatgtggagagaacaggctctccagtgtcttcacttataaggacactcatcctatccgattgagaccctaccttatcatcgcttaaccttaattacttctgtaaagggcgctatctccaaggacagttatattgggattggggctttaacataagaattttgcagggacatgaattgcagtccatgacagatgtaaactttgagaaacaggaaaaagctggaacctacaagcagaagtgggaacctgtgaggttggactgaaactcagatcagttcttgctgcctctgaccttgatgtatgtatcctggaggagatgctggcatctctcatcatggagctaattgtaggacaggcccagaaatggaagaagctggaagagagtctagtggaaggtggggcagcgtgggcccagctgctgttgcctgccaaagaggtgagcagcagataagtgacgaggtatgtgagctcacacacccaatccactgtggcacttctgccttccagatcctccataagaaggtctctttggcctactctgctcagaaatatataaggcaggagattctgagaaatctagttgagtccagccacgttgacatgctacaaagccaccacagactctaaggagaaattatgtccagggttgggagaagagagccattagctgtacttggatgaacagttagtggcctagaaactgatctagaaagggatctctgttgatgaaaaaggacagtggtgtaaataaaggaagagtgatttggcgatggggtgttggttcagagttaaagacatgagaatgacaaagaaaggacaagggtggcaattgagatagatgcctttattaagtatagggtatagaagtgtagaatagagaagacaaagaaaagcaaaagaactgaatagctagaatgtattaatgcagggcatcaggcatgtggagccagctaaaaagtgagagatcaaacaagattcttagagcaagagaacatcagtaggaactagccacatttatttcacggactcaatgatactgagtttctactactacagggtactgtgtttgatgcacataaaaattattaacatgtattcctgcttatcattattggaggcaggggttgtgaagtcagcatggtccccaccgccacgcccccaccccaggccaaactctaaaggtatttacctgggttttctttcgaaaaaggaagaggtcttattttttttttttatgggagctgagggcagtggataaatttggaaccagacagttgaagtattaccataagcatcagaaaaagtgaataggtttttaaaataatagggaatagagatagaaagcaatcaacaaggcttgttttagaattaaaactctacaaagtaaaagatgtagcctgaatgacccttgaaatcacatgtataatttatagcacctgattccctccaagtcatggtacagaaaatgtatgtctcagctgtgccatgctggccaatctggtctagcctcaggcttgtcacatatgaagtggtgatgacatatttatatcacagaacaattgtgaaaaacaacggctaatgtagttactcaacaaatgtagtgtgcactaaccttatgctaggcactattcccggcactagggacacagaaatgaagagagaaacaatgtcctcattctcgtggaacttgcaaggtagtcagaagagacattttattatttaatctctcactgtctaatatcatagaaatcatacattcacattcatccagagagatagttattattacctttttcacatgctgaaacagaggttacttgtctgagacctcttgctatcaagtgttaaaggtgagactgagtccaggtcttatatgactccatatgcccagcactcttcaaacggccaaatgcctcgtcccacagaaaatagaagcccacagtcctcatatactataaaacttaaatagaatacattatctcatgtggacagatggttatgactttataaactaggaaatcctatgtaggcagatgtttagttgatgaaaagaagtgtaaacatgaccctaatgaatacatgttctgcaagttattggttgctattaatacagagatagttatgctgtattaacggacaaataaggcatatgtagcaagctaaaaagtgagaagtgaaacaagattctttttttttttttttttttttggagacatagtctcgctctgtcatccaggctggggtgcaatggtgcaatctcagctcactgtagcctccgcctcccaggttccagtgattctcctgcctcagcctcctgagtagctgggattacaggtacctgccaccatgcccagctaatttttgtatttttagtagagctggggtttctccatgttggccaggctggtcttgaactgctgacctcaggtgatccgcctacctcggcctcccaaagtgctgggattacaggaatgagccaccatgcctggcctgaaacaattttcttaaggcaagagaaaccactgggaactagccacatgtatttcatgacttcaaatgatactgagtttctactactagaggaatacatgcaatagaggaaataaaagggggtgatgggatcgagtgatggaggagaagatctctttagactggttggtgagggaaggcctctgtgaggagactattgagatatacctgaggaatgggaaggaggcagatctctgaaaatctggaggaagccctttctaggagaaggaacacacaagcaaaggccctaaggcaagaatgagcttggtgtccttggggaacaaaatgaagatcagagtggctggaggttgctgagcaaatgggacctggttaattcatgcatctggaaaggtagaaaggagctagatcctgcaagtccttgcaggccacagtaaggaatctgaattttgttaatatataagacacaaggtattggaagacacaaagtcatcggaagattttaagcgagagtgacaggccattggtattttttaaaaaatcactgtggctgctataaaactatcacttatggagcaactgtaggctttttgctctttttaaagattattgtgcattggatcattcatggatgccagacttgaaatgaacaagatggggaataatggggaacttctggaatatcagtaaaaataaagaagctgctaggatcctggctacagtgtgaacccttgagttgtggcagccgtgagagatggatgtgatggctgtttggtcctgcgagtcacttttctctatcaaatatacttgaccttcatgtgaccctttccatctctttgtgaccaagtaccaagtgataagcgttaattaatttttgggtcactgtgacagatcatcagtgtgctacacttttcaggtaacaggtttccgtgaaccatttgcaatgcccaaattataagaaatcccttaatatctgactctaacagagttgcagtttccaagtctatagcatcccactaacagaggggttggaagacaagatggagccacaaaggtagcagtggcaacccgtccacccctgcttaatgctactcctggtttaagacatgagcccaatttctctttagctggtaggatgacagaaaaagttttaacagcttttttgaggcataattgatattaaaaaggacacatatttcatgtgtacattttgatgagtttggacatatgcaattacctgtgaaactatcatcacaatccagggaataaacatgcctgtcacctccagaagtttccttgtgcccccttgttgtttttgtttgtttgtgtggtagaacacttaacatgatatccaccttcttaacaaattttttaagcgcacaatacagtattgttaattatagggactgtgttgtacaacagatctgtagaactcattcacctttcataactgaaaccttctacttgttcagtaataactccctatctctccctacccccagcccctggcaaccacgattctactctctgcttctatggttttgactattttacaatcctcatataagtgtgaccatgtagtatttgtccttctgtgactggcttatttcacttagcatagtgtcctccaagcttatctatattgtcacgtatttcagaatttccttttttaaggctgaataatattccactgtgtgtatagactatattttctttattctttcatccatcaatgagacacttaggttgtttctatatcttgactattgtgaagaatgctgcaatgaacttgggcgtgcaaatatctcttcaagatcctgatttcagttattttggctatatacccagaagtgggatcactggatcatatgatagtgctatttttaatgtttttaggaatctctgagatggtttggctgtgtccccacccaaacctcatcttgaattgtagctcccctaattcccacaagtagtgggagggacccagtgggagataattgattcatggggatggtttccccatactgttctcatggtagtgaataaatatcatgagatctgatagttttataagaggttttccctttcccttggctctcactctctcttgtctgccaccatgtaagacatgccttttgccttccaccatgattgtgaggcaccccacccccagccatgtggaactgtgtgtccattaaacttctttttctttataaattacccagtctcaggtgtgtctttatcagcagcatgagaatggactaatacagtaaattggcactgcgagggtagggagctattgtaaagatacctgaaaatgtaaaagcaactttgaaaccaagtaacagggagaggctggaagagtttggagggctcagaagaagacaggaaaatgtgggaaagtttggaacttcctagagacttgttgaatggctttgaccaaaatgctgatagtgatatgaaaaatgaagtccagattgaggtgttctcagatggagatgaggaacttgttaggaactggagtaaaagtgactcttgctatgttttagcaaagagactggtggcattttgtccttgccctagagatttgtggaactttgaacttgagggagatgatttagggtatctggcagaagaaattgctaagcagcaaaccattcaagatgtgagtttggtgctgttaaaagcattcagttttgaaagggaaacagagcataaaagttcagaaaatttgcagcctgatgacgcagtagaaaaacccattttctgaggagaaattcaagccggctgcagagatttgcaaaagtaacaaggaaccaaatgttaatcaccaaggcaatggggaaaatgtctccagggcatgtcagataactttgctcccattacaggcccagaggcctaggaggaaaaaatggcccccccacctgctatgtgcagcttagggacttggtgcccggcatcctagccattttagccatggctaaaaggggccaaggtatagctggggccatggcttcagaaggtgcaagccccaagacttggcagcttccacgtgggcacacagaagttaagaattgagttttgggaacttctgcctagatttcagaggatatatggaaactcctggatgtccaggcagaagctttctgtaggggtggggccctcatggagaaccctttgctagggcagtgcagaaggaaaatgtgggattgaagcccccacacagagtccccacaggggcactgcctagggaagttgtcagaagagggccaccatcttccagaccccagaatggtagatccactaacagcttgtatcgtatgcctggaaaagccacaaacactcaaagccagccctgaaagaagctgggaggtaggctgtaccctgcaaagccacaagggtggggctgcccataggaacccacctcttgcatcggcgtgacctgaatgtgagacacagagtcaaaggagatcattttcaagctttaagatttcactgccctgctggattttggacttggatgggacctttagccccctcattttggccaatttctcccatttgggatgggtatatctatccaacgcctgtacccccattgtatctaggaagtaactaacttgcttttgattttacaggctcataggcagaagggacttaccttgtctcagatgagactttggactgtggacttttgagttaatcctgaaatgagttaagactttgggggactatagtgagggcatggttggctttgaaatgtaaggacatgagatttgggaggggccgggggcagaatgatatggtttggctgtgtccccacccaaatctcatcttgaattgtagctcccgtagttcccacatgttgtgggaaggacctggtgggagataattgaatcatgggggcagttcctccatactgttctcatggtagtgaataagtctcatgggatctaatggttttatatgggttttctctttcacttggttctcattctctcgtctgccaccatgtaagatgtcctttttgccttccaccgtcatcatgtggaactgtgagtccattaaacctctttttccttataaattacccagtcttgtgtatgtctttatcagcagcatgaaaatggactaatccaatctccatactgctttccatagcagctacaacattttacattttacatttccactaacagtgtacaagggttccagtttctttacatccttgccagcacttgtctttttgataatagtcatcctaacaggtgtgaggtgatatctcattgtatttttgatgtgcatttctctcatgattggcaatgttgaccaacttttcatatacttgttggccatttttatgtcattttttgagaaatgcctgttcaagtcatttgcccatttttaaatttgtttattttcttgccattgagttgtagtaggagttccttatatctcttaggtattaaacccttgtcagatatgtggtttgtgaatattttatcccatttcataggctgccttttcactctgttgattgtttcctttgctgcacagagctttttaatttgatgtagtcccacttgcctatttttgcttttgttgcctatgtttttggtgtcacatccaagaaatcattgcagagaccaatatcataaagttttgccccatgttttattctaggaattttatagtttcaggtcttacatttaagtctttaacttactttgagttgatttttatatggtataaagtaagcattcaatttcattcttttgcatataagtattcattttttgcagcataatttatcaagggactaacctttctccattgtatattcttggcacgcttgttgaagatcagttgactgtatatgcatgaatttattgctccactgtctcttctgttccattgatctatatgtctgtctttacgccagtaacatactattttgattactctaggttcgttatatattttgaaatcaggaagtgtgatgcatccatttttgttcttctttctcaagattgctttggctttttggggtcttttgtggttccatgagaattttagtattttttttttctatttctgtaaaaaatgcccttgggattttgatggggaaagcatggagcctgtagatcactttgggtagtatagatattttagcaatattgtcttctagtccacaaacacagggtatctttccattttttatgttttctttaatttatttcattgatgttgcctcagtttcagtgaataatcttaaaccttcttggttaagtttatcctaggtattttattctttttgctgctattggaaataggacccctcccctcccctccccttccctcccttctttcactctgttgcccaggctggagtgcagtggcacaatctcggctcactgcaatctccacctctcaggttcaagcaattcttctgcctcagcctcccaagtagctgggattataggcatgtgccaccacacttgcctaatttttgtgtttttagtagagacggggtttcaccatgttggccaggctggtctcaaactcctgacctcaggtgatccacccaccttggcctcccaaagtgctggcctcccaggtgcaaactaccacacctgaccaggattgttttcttaatttccttttcagatagttcagtcttagtacagggaaatgcaactaatttttgtatgttgattttgtttcctgatatttcactgaatttatttattagttctaacagtttttgtgttgagtctttagggtttactgcatataatatcatgtcatctgcaaacagagatattcttacttctttctttcctgtttggatttctttttcttgcctaattgctcggattaggactttcagtagtatgttgaaagtaagtggtgacagtgggcatcattatcttattcttgatcttagaagaaaagcttttatttttcgttagtataatgttaactgcgggattgtcatatgtgaccttttttatttttatttatttttttgagacagagtctcactctgtcacccaggctggagtgcagtggcgtgatctagacttactgcagcctccgcctccccagttcaagtgattctcctgcctcagcctcccaagtagctgggactataggcatgtgccaccatgcctggctaattttttgtatttttagtagagacggagtttcaccatgttggccaggctggtctcaaactcccgacctcaggtgatctgcccgccttggcctcccaaagtgttgggattacaggcatgagccaccacgcccagccaacttttttatattgaggtaaattccttctatacctagtttgttgagagttttatcttggaaggtcagatgctttctctgcatctattgagatgattgtgtgatttttgtccttcattctgttaatgtatattatatcaattgatttgcatatgtcaaactatcatcagatcccagaaataaatcccacttggtcatggtgtatggtacttttaatgtgctatggaattctgttttctagataggtgagactttttacatctatgttcatcagggatattcgcctatagttttcttttcttgtagtgtctttgttttgactttggtgtcaaggtaatactggccttataaaatgagtttggaagtgctttctctccttcagttatttttttaagactttgggaaggattggtgttttaaaaaaatatttggtagaatttgccagtgaatccataatggaaatattgtatataggtaatttagtaagtcaagaattgtccctcaaaaggtactagaaaactcagttcttacttttaagactcttctaattatcctggtggaatggcttctggaatatcaccataatactgaaatttactccataatactactgaatggaagggatccagtgctggaaactttacatttgaccaggtgcagccctcaatactaggacagtttggctagggggctacccccacaggtagcagggaagaaggctgcattggtttgactgggatggaagaagaataagctaagtagtctgtcagagtttgccaggttaaagaggaaagatgatagcacaggctggagggaggtcaaagtcacattctggggaaactagatgtatgttgaccagtaggggcaagcctagtatggaatggtgggtgacagtgaacattgagggccaatgagatttagagaatgaattgaggagtgaggcttaggggaaagaaggccgggcacattagaaggctcagaggtctaagaagcatgaggaagattgtcctccagagagctgtccccttgaaggaggtgcgttggcatgatcttgtcatgaatttctcaccctgtcagaaacatcttatgtagattttttaaagggcaacagttttcctgctcactctgagtacctgaaccttgattctaagacttaggtaaggttcacttggcctggatgtttataaatgccagtaccaaggggagtccttgaaatggcatagaagatggcaaagggctctgcagagccacgaaacccaaatttagaaatgagaattactaacaatgcatatacaacatgtctacaataaactagaaaggatgatatagtttctgataacagtctttgaactttccctacctatgaaatggtattaacccttaatcagcagctcaggaaatagtccacggtagatcctcatctttgtatttcctttactgtctggttacttactgaaaagtggtagctgaggccgtatctcctaacctgcatgctctccctctctattttctttgtctcccatgttctccctacaaagttagcattcattcattcattcttattttctttctttctctctctctctctctctcactctctctccccctccccgttttcctgtggtattgaaagcttattgtcaggatgagccccttattgcttggaacccaatctgtgtccatgaattgcccatttcacagaatcacgaaagccacgctgcttcctgagcaacacagctaagtggcattccccacccctgctcttagcaaaagttcctcaggacattattgttgaattactcaatgcctattatcatagaacctcatgttcacgctgggaggtagttactactacctttttcaaatgctgaaacacaggttacctgcccgatacctctctgctatcaaatgtcaaaggtgaaattcagcccaggtcttctgactctacatccagcattctttatagagctaaatctctcttcccacagaagatagaagcccacagttctcacatacttacaaaacttaaatagagtacattatctcatgtggacaggtggttatgactttataaactaagaaaatctaggcagatgtttagtcaatgtcaagaagtgtaaacatgaccctaattaatggatttgctgaaagttattggtctctccttgtcagaactgttgttttccctgtcacttctcagattggattagaaaaaattaagcatgaagaaaattggcatttaaaatgtgtttattcttcactatcaagacagatagaactttccattcaaaagagaatgaaaagttcattttggcatggtgaatcataaataagaaaaacagaatagagaaatcctaggacgatcaatctctcataaaataaagaaatcgagattttatcgcaaagaattctgcagcacataaaggcccttaggactggactgatctccgagttcaagcgttacacccagtatgctgcataaaccctattcagtgtttgggctcattctcaagaggttgacatccttcccattttcatatcacctccctggtccacctttgctaggtcacaggtttttcaggcactttgcattctgccctccctcctctcaaaagacttcccggcatgttttcgatagcttcacacctagcagatggcagtttttcttctgaccttctgccagccctcttccttcctcagcttccttcctctccacagcttccatttaaggtattttggaagtccctcgaaatgggtccttggtgagtaaacccctttattgagtctcggactttaagaagttcttggcttcatgggacccccttcttctagttgacacttttggggattgatttcaagaatcatctgttgctgataagtcagtgtggcttctattgctgcagaagcaaggaagaaactaggcatatagtggaagaaaatgcgcttaattagaaactggtcctcattagggattcttaaaggaagtgctcaatttgcacctatgttagcagagcctcacacggattaattaaaagctgctactctcaccagcaacacccttcatggctgggttgaattgtttgtagctgtcaactctgtgccaagggcaacaaggtttgaatctgagttctttgaaatgcaggttctttcactcactatgcagaatctagggatccagactctcaagaggcaaagctctggaagaacaggtggagtgagtatccctctggcttctgctcccgccagatgatcaccatgcctctcaactctacactcttttccctgcctgtgctccagttcacactctccacatccctggggccaggctatacctagatccttctgcttgatctctcaggctccgatgtttcaactcgtcattccctaggctattaacttcaagcccttagatggcattcaagctccttggtgacctctctgcgtccgtctccatccccatctgcttccgtgagcttcataggcaagccactctccatagttatatgtccctcaaatacccagcatccccatgccatcatttcaaccagactgtcctttttcttttcccacctaaggaaattctattagttcttcatggctgggttcaaatccacctccttcactctccaggaagactacattattcttttcctaacactcctgaagtgcttgtcctctacagcattgctgcacatattttgttctgttctttattacactagtccatatggctttactccctgctgaatttaaactcttcaagggcttgatctctgtcttattcatctctgtaacctcacagtacctaatcaagttctttgaacaaagccagtgttgaaaagtgtttgttgaattgagaacagcaagccagactttctgatgggctagaaagatatacctagaaagatagagcagagtagcatttctaaagatggaaaggacaagcctggctaaaatcatgctcaaagaaaggttttcttttagggtcctcatcacatcacaatagcaaatttttaaaaaaagaaagggccgagcacgtcagtatagttaccgagcgtacttgtgtactgggcaaagtactgagcgcaatagaaagttactaaaagaaagaacagatgctttttctcctttagagctggtcccttttcaaaataaggcctcaaagtgcatcccattattaaccctgaaatagtgggacacaaacgtccagatagatatgtgcatgccaatacgtgtttaaaaatctggcgtcacacagcacactccagaggaagccaagcctaagagacatgaacacagtaacacggtagggagccgtgtgatccagactgtcctaagcagaagaggccccgggtggagaattctcacactgacagccgcagagcctgccttccccagtgtactggttttcccagggcatcaaacattttatttaataagctacatgtttgagtcacaagcgtagacttgacacccctgtatggtcaactccagctgtcgtttgttctcctcccctctcttctggcacagtggctggaacctgtatctggtgtatcacaacgctccatttcgctgatcacacacagccagaagtgacagtcgcttctctcactgccaaggacagaggagactctggctggacaggagaaattcaggtcgaaccaaggcaagtgaacgatggaattaaaaacggctgagaaatcccatagacttagaattactcatatctgcagactagagggaaatgagttggtcctgatgacaaaacaaccctttcttttctctagtctgttaaacttctattttcccgtcagactgttttaacaatgccctctactgggtattttcaaaactgcagggttctgcaggcctgacctgctcttgttctccttgagtaattctttctgcaagatgaactgaacccaaagttttcttcacataagcaagatgttactgatgtatagtttcttaagagcataaaaagtggaccagtgcatcccctggaaggagggcctcttgccctcttgagagatttctttgtaaaggtgcatgaggaattgaaatctcaccacctcctgaactggcccagagctgtcctggcatggatgacacagggaccttgacatgggctgatggattaagaacaatgttacattttctgaacgcatcacttttccaacagctcttgatctcacatgtgaggctctttctcatccctgaaggctactgacttttccctggatatatttgtattgtgattattctgcatatctaagaatttcatccctttctaaccgctcctctgccaaaacagaaaccaaaaaaagccaaaacatcactctgtgctagttagtttctttgacccctcttaaagaaactctaaacaaaaaatctgcgtccagttatatccaagggggtgttcttactgggtattcccgtcagaacctcccatctgtctattttggttcattctttgccattatcatgtaacaagttcaagataattgtgtttcatctccagttattattcatagtccctctgcatgttgaagattgctgagacagcacagaaaaatagtaaagcaacagatgaggtctgtttgcaaaaaatgtagaacaattcgaggtgcaggatgttcttcaaattgtgatggggtgaggttttgaaaagttcttcggatgggctagtgtttgttttctctctccctctccctctcttcccccctcccctttccgctttcccacttcctctctcctccttccttcctccccatccatttctcttaaatagaaacaaaattccatatattcttagaatccataggatccatatattcttagaatccataggatccagcattgcattttatttaaaagcaaatgccgaccaagtagtcagtagcaccctttcagctccaatagttggtgctatattctgtactcagcagtagactcatttcattattttggagtatggacctgaagaaaatgaatatcagacatgggctaagccaaggccagttaataaatattttaggctttgcaaaccgtatagtctctgtagcaactattcaactctgctcttatagcaccaaagtagccacaaataatagtaaacaaatgggcatggctctgttctagtaaacttacttgtggaaacgggacaggctgaatttggcccacagaccctcgtttgccaatccctgggctaagctattgcaggggtactgctgatggatatgcgggctgtgtcctgtgtgacagtgcctagccaagggggcaagtgggacctgaaatacaacccatgctctgcttctccacgccttccaccacaagaggtcctttttgtaattcagacagaggtaccatttgttcacaggctgtctccaaccagaataagcacatttcctaatggattagggtacttaacatggtttgcataagtgggaggaagagggacctgattttcctgtattaggataagggttacctttgatcccaatggctgttattgaaatgactaaagccacatggttcaaacatggctgccttagcccacatctacagactgggagtaggtggtgggagcaattccaacagagatgtagactgggaaagtgccccaggtaagaggaaccccaaagaaggtgagtttattggttagggggcttgttggatattattaccaaagccatagtccctttatgaagtttgttctgtccaaaaatgtgatttaggccactgtatgagtccattctcacattgctgtaaagaaatacctaatgctgggtaatttataaagaaacgaggtttaattgggctcatgttgctggaggctgtgcaggaagcatggtggcatctgcttggcttctggggaggccttgggaaaacttagaatggtggctgaaggtgaaaggaggagcagcacttcacatggccagggcaggagggagggagagaggggagctatcacacactgttaaagaaccagatctcgtgagaactctatcatgagaacagcaccaaaggggtggtgctaaaccgttcacgaaggatccaccactatgatccaatcacctcttaccaggccctatctccaacatgggggattacaactaaaatgagatttgggtggggacacatatccaaaccatagcagccaccactctccatcttagaatggtagaataataaaattaggaggaaacttggtatgcttttgcatgcattttaacatcagaaccctttgttcaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaagaaccctttgttcaaataaaatcttatctagaactccagtatacgcaactgtgaaaaagggagagtgctctggtgcagctggagaggaaagacaaggagtgccctcagtaaccccctccccagatccggctggcccagagagagctgctgagactcccccaggacccagtttggagccactgatctcatcactgcataggagggagagagagaggggagatatgaaacaacggaggcaaaatgaaataaaataatcttaggtgacaacattttttaccaggttttgttggtataaaacaccctttccttttcagttcccctacctgaaagtctttggttgcttatatatatttaggatgtttttatatagggtaatatagaattgtaaggcttaatataatattaatatttgacattctattggatttaagcagccagtgggaagagagtaaataaaaataactacacaaaggaaactgctattagcgtttgttaccatgtgaatgaaatagcacatcagctgtgcatttaaagatctggatagaagtttgtttcagttatttgtttgttttgaggtacatttacatacagtgaaatacatagcttttaagtacacagtttgatctgtgttgactatacttacgtaacccacagctctaccaaaatcaacaacatttccatcatgcgggaaagttctcttattccccttcccaataaatctttcccacccagaagcaatcacagatgtgatgtctatcaccacacttggttctattctaggactttgtataaatggaatcataccatatgtactcttttgtgtctactttgtttcacttagcataatatttttgagatttatccatgttgcagcatatggccatacctttttcctttttatgcctgagtagtgttccattgtgtgaatgaatatgccagtttatccattctcctgtttatggacacttggaatgtctaaaagctgccatgaaaagccttgttcaaggctttttgtggacatatattctcatttctctaggataaatgcctaggagtagaattgctgagtgataagagtgatgcatatcttttaagaaaaaaactatcagagttttcacaattatccattttacacatccatgcaatatatgagcattctgattgttccacatccttgccaacacttaatattatcagcctttaaaatttcagctattctatttggtgtgtttctcatgtagttttaatttgcatttctctgtaataatgttgattgccttttctaagtgcttattggctattcacctatcttttgtcaaatgtctattcagatgtttgccctttaaaaaattgtgttgtctttttattgttaaattgtaggagttctttgtaagatacaggtctgggaaatattttctcccaatctgtagtttgcttattttattgagattgtcttttgataatgagttttaaattttgcagttaaatttatggatatttttctcttatggttattgcgttctgtgtttgaaggaatcttgccttcctcaaagtcacaaagatttatcttatattttcttctagaatatttatacttttaagttatacatttatgtctatgattcatcttgagttaatttttatatacaatatgtggtaagattcaaagttcttttctttttccacatggctatctagtcattccagctcaatttcttgaaaagatgtttctttttcaattgaattgctttgatatctttgttgaaattgatttggccatatatatgtagggctacttttgggctttcagttttatttcattgttctgtttctattttatttcactaaaaccacactcttgatttgtatgtttatagttaatcatgaaattagatagagtaagtccttcaactttgttcttctatttcaagaatgtttgggctattctaggtcctttgcatttctgtataaattttagaatcagcttatcgatttctacaaaacgtcttcagaaattttaattgagatctattaagtcattagataaacttgaaaagaaccaacatcttaagaatattgagttttctaatccttaaacatggtatatattattattattattattttttttttatactttaagttttagggtacatgtgcacattgtgcaggttagttacatatgtatacatgtgccatgctggtgcgctgcacccactaactcgtcatctagccttaggtatatctcccaatgctatccctcccccctccccccaccccaccacagtccccagagtgtggtattccccttcatgtgtccaggtgatctcattgttcaattcccacctatgagtgagaatatacggtgtttggttttttgttcttgcgatagtttactgagaatgatgatttccagggacatggatgaaattggaaatcatcattctcggtatatattatttatttagatcttctttaatttctctcaacagtattttgaggttttcagtatatatctcacatacctttcattaaaattattcctaagtactttctgttttgggaagctattttaaatagtattttaacatgttacattgatgaattctttatgtagaaggtttttttttgaagattatagaattttatgtatctaccaggtttgctaatttgttttagtttatttatatctttgattaattatagccttgtaaaatattacttaatattacatactggtcatttcctgttctgtcttgcagatgattttatagctgacatcggtcaagaactacattatggtgggataaaattttaatttactagagtattatagtgagggaagttttttctttcttatggagagtttttattatgaatgctttttaaaatgctttttctgcatctatttagatggccatttggtttttctccttttaatctattaatatgttgaattatattgactaattttaggatgttaaacagcctttcattccagggttaaacttcacttggccgtgatatattattattattatgtatgtgtggatacatttgagtttttaatgttttgctaatgatttttgtgtttgtgttaatgagagatattgtcattaatgttcttttttttttttttttttttttttccccccctctgagacagagtctcgctctgtcgcccaggctggagtgcaatggtgccatctcagctcactgcaagctccgcctcccgggttcaccccattctcctgcctcagcctcccgagtagctgggactacaggcacccaccatgacatccggctaatttttttgtatttttagtagagacggggtttcaccgtgttagccaggatggtctccatctcctgacctcgtggtccacccgcctcggcctcccagagtgctgggattacaggcgtgagccactgtgcctggccctaatgtttttataacttgcttgtttcagtgtctgggcaacactggccttttaaataattggaaatgttctctcctctgtttctcagagaatttgtggaggattttactattttctttctcaaacatttagtagaatttgccagggaacctctccaggttgggagagttctttgtgggaagtttgtatttatgagtgaaatttctttaattgacacagggctattcaatttttctatttcttcttgggtaattttgttcttttcagtctttgaaggaatttgttcatttcctgtaagttgttaaatttattggcataaatttgttcatacaatttccatattaccttttattgtgtctttgtaggtttttatggtagcatctttatagagatataactcacatataacacagtttaccatttgatgtatacaatccagtgtttttaaagagatttagctatacagctaattttagaacatttttatcaccctaacaagaaatcgtggtgccataccagtccttcccaccctatttacccagccttaggctaccactcctctcttttcagtctttgtagatttgcctattccagactttttatataaatgagataatataataagtggtcttttgagactggcttctgtcacttagaataatgtttttaaggtttactatgctgctgttaacattcatgtacaaatgtttgtgtgaacacacatttttatttctcttgggaatatacctaggggaagaatttctggatcataacgtaactctatatttaagcttctgaggaactgatggactgttttccaaaataactgcaccattttagactttcaccagcagtgcaggaggatttcaatttctctgcatccttgctaacacttggtgtcatctatcttttttattacagccatcctagtgggtgtgaagtagaaactcattttgctttggatttgcatttccctgatggctaatgatgttgagcatcttcccatgtgcttgatggccatgtgtatgtatctttcttggggaaatatccattcagccttgttatcctttaatgactgtagaatctatagcaatatcccttctcactttcctgatatcagtaatcttcatttctctcgtttttttcttaatgagtctaaataggagtttataaattttattagctctttaaagtgccgacttttggttttatcatttttctcttttgtttgttaattttatatttcatttctcctttttactacttcattcttttacttaccctgagtttaatttgctcctcagattatttagatcaaggatctaaatttctaccttaagaaactagctttttctagcatatgatctatcctagtcaacataccatgtgaacttgaaaagatcgatgtattgatagtagcttttactttttctctatcttttttttttctgatactattgattgcttagaagaactgctttaacatagatttccaaactctatacccataaaactggaataggttacactatacccaatttatagataaaaaaatgaaacttgaggctcagaaaggtgaaatagattgctggtctgaaacttacctagagatgaaagttaggtagactccactgcttaggttggaagaatatgcagacaggaaaccagtgggaaggggacagtacaatgtacctgcagacctgattattccagtatagcaaaagcattctgtctcagcctgtcacactttgataagatatatttgggggaatatcatgagtttttggcttatttgttaaacacctggatttttatggtctaactttagttgttgactaagcaaagtatttgttgactaatgtgactgagttgtgaaacgtctcgaaatggcatttcaattgtcagtgaagggggtggcatagacatatgattccttcatatccactcaactgagtctggcgtctccttgaatgcaggcatgcggaatgtccatgtgcctggcatcttggcggtggtcagtaaatgtttgtcaaaaggagctgaagtgtataccgtttctttgacttcttctgtgagtcaagcaccaggttcatctgagtgaaaaaatgcaatgtggatgagactgtgatgtgtcctgtacactgaaagagatcttgatcgttactaaatgggtattaaatgaggcagtgtggccatgacagaaatatgcaagaataaaagaagtgttgtagttcgcagaactttagagggggaaaatatgatttatttattacttgtggaatctcttgatttgatacactggtggaacatagcattatagtcaaagcagcagtgatagcttggcttgtgtgaaaacaaggtaggatttgtaataccatctgatattcttctccgagtttcagattcagaaagaacagtatcaacatgtaccgagcaggggaaacaatataggaaagatataaaagaaaatatgcaatccttgaccaatgtaaataaatgggaacttttgatttatttgtcatgtactcagattgatgggtttcgtagtgaagtaaatgtgtgtgcatccctggttcaggagagagtgttttgtgtatcattctagactactccagactgacatttcaaagcaacgtatcatcagtgaagtatgtatttatcgttagctcttgaaggatttttttttttagttgatagagtcatgtcttagtttctcaatgtggagaagctaaaactgtgatcctgtttctcattttctctctcaccacataggaaactatcctggtcagaagctaccccttggttgtatcagtttgctagggctgtcacaacgaagtaccacaaactgagtcacctaaacagaaatttgcaatctcagttctggaggccaaaagttcaagactgggatattggcagtgttggctcctaccaagagctgccaagaagaatctgtgccacacctcttccttagcatatgttgttggctgacaagctttggcattccttggcttgtagaagcatctctcccacctctgccctcatcttcacgtggtgttctacctgttgtatgtctccaagtccactcacactggattagggacccacactactccaggacaaccttaattaattacatttgcagaagccctacttcaaataaggtcacattttgaagcactgggggtggggacttcaatatatgaattttgggggacatgataacatgctgcttataggtggaaaataatttctacatatttattaataaggaacctctaagatgaacagatttggaaatctagtttatcttcagtttgttctaagcatctgtgtgacctggaataaattacttcattatcccaacctcagcttcttcatctgcaaggtggaagaggtgatacttgctctcctatgttatagagtcgtagtcaattataacaatagctgctgccatttattgagtggtaataagagccggcactatcacaagagtggacaccttttacaggctaggaaacagtggcacaaagaagtaaagtaatttgcccatagccaattaagtggcggagccaagattcgaacccaagaagaatggctacagtgccaactctttcaaccagggaaccaggagagcatcactatataaattctgtgtaaagtgcaagacacaatgcaaaagttcgttgtcactaaaaggagaactcagggcaaagtcttgtccttcccacttctaattctttttttcctactccagtgtttatcaaacttttcccccttttagaatacttattggaaacccatacaaaactcatatctcctctgatgtttttgaaatttcagaacctgcatcattattgaagtaaatccaagcaatcagaatttgaaaatctagctttccaaacggcctcagaggcccccaacacacacatacacatacacacacacacacacacacacacggacacataacacacagtgtgttaactcagtccttcctgccttcagtttctgtggtacagccatgatatggcttggctgtccccagccagatctcatcttgaattgtagctcccataattcccacatgtggtgggagggacccagtgggaggtaattgaatcatgggggtggatttttcccatgctgttctcgtgatagtgaataagtctcacaagatccgatggttttagaaagggctgttcccctgtacgtgctctcttccctgccgccatgtaagacatgcctttgctcctcctttgccttctgccatgattgtgagggctccccagctatgtggaacagtgagtccattaaacctctttttatgtctttattagcagcatgagaacagactaatacaagccataaaaggccaagatcatcattcctttacctacattctttttttgttatttgcccttgcttttcatcatgcaccacatcatttatgtaactaaaaataccaacttccaggccaggtgtggtggctcacgcttgtaatcccagcactttgggaggcggatgcgggtgggtcacctgaggtcaggagttcaagaccagcctggccaacatggtgaaaccccatctctactaaaaatacagaaattagccaggagtgatggcatgtgcctataatcccagctactcaggaggctgaggcaggagaattgcttgaacccaggaggtggaggttgcagtgagctgagattgtgccattgcactccagcctgggcaagagtgagactctgtctcaaagcaaaacaaaaacaaacaaacaaatgaaaaaccagcttcccttagattcccccatgagtttctgactccactacctaattcaataaaggcatttttaagaaatataaatcatatttattcatggttatatgtacatgatacaaaacatttcacagcagaaatggactcttttttaccccatcctcaatcaactaatttccttccctataaaaatctattatttgttttgtgttgtgtgtttcagccagagatactctatgcatgatgcaaacatattagcatccatatgctactttcatctaaaaagtagcatactctccacagtattctaaacctcttctttcacctattaagatatcatttctctattgtaagacttaaaatttaatgtagtgcctttgagcccaaaagtcttgagtttccctacttctaccagatattccccccaaccttcccaaagagaaaggctccctacttaaatggttcctctatcatctgggcctgctgggccgtacccattcctcaacctaacaggtttcacctcccggccagcccatgacattagtcacatcctcctgtaggaacctgaggacacctctcccccttgttactacatagccggcctcccacagcccttgtggtttgctctgctgtggactgtagcccctgtatggtgaacagtgtcctcctcccccaggctgcaagtgtatgtgactagtaaaccacgatctgtctcttttaagtggtgtggggtgttgtttgtctgaccttctcatattatttagggcagaggatccacctttaccaactgggtgaataggaggtgattagaactagtccatattaccacatagagcaatcctttgcttttcctaataagtgcacagaactctatagtatgaataggaaccaatttacttatcttgttccctgttggtagacactgggtttttactctttggttccacagcaatgctctagtgaattttctattccacattttgcatctgaagtcatcttgcatctgaaggagtaaattattacaagtaaagtatgggtcaaatgctatgcacattaaattttaataaacattggccaggcgcagtggctcacacctgtaattccagcactttgggaggccaaggcgggagtggatcacctgaggtcaggagttcgagaccagcctgaccaatatggtaaaaccccatctctattaaaaatacaaaaattagctgggcgtggtggcatgtgtctgtggtcccaggctactcgggaggttgagacaggagaactgcttgaacccaggaggtagaggttgccatgagttgagatcgtgaaactgcactccaggctgggcacagagcgagattctgtctcaaaaaaataaaataaaaaaattaataaacattgccaattgcttttcatagaatgtgtaccaatttagacccccacaggcagctggacagtctatttccccacatcctcatcaacccaggacattaccaaactttctgatcttggccaaggggagaggtgaaaaatgtcaagtccttgtggttttagtttacagttttacaagaagtgagggcaagtgtcttttcatatgcttacaagtcatttgtatttctggcctttctcttattgactcgaggaagcttttcctttattgaataaattaccactttttctatgatatgaagttgaaatatcacttatcatttgtctttgtttatagtaggttttgctgcctagatttgtattttatgttatcacatttaccttcttttgtggattctagtgttggggttacatatagatgcatcttctccagtctgtgtaggagaatctcattttattgtgcgttctttgttgtgattcacagatatcacatttttttacaaattgaaggtttatggcaactctccattgagcaagtctatcagtgccattttcccaaaagcatgtgtttactccatatctgtgtgtcatattttggtaattctcaaaatatttcaaactttgtcattatcattttttcttttatggtgatctgtgatcagtgttgtttatgttgctattataattgctttggggcaccatgaaccacacctgtataagatggagaacttaataaatgttgtatgtgtactgactgttccaccaactggccattgcacatctctctccctctcttcaggcttctttattccctgagacacagcaatattgaaattagaccaattcataaccctacaatggcttctaagtgttcaagtgaaaggaagagtcatacatctctcactttaagttaaaagctagaaatgactaagcttggtgaggaaagcatgtcaaaagctgagacaggccaaaagctagacctcttgggcaaaataattagccaagttgtgaatgcaaaggaaaagttattgaagaaaattgaaagtgctactccagtgaaaacaggaatgataagaaagcaaaacagccttatcgctgatatggagaaaattttaaaaggtcaatgcctggcttcaaaagacaggctgactctcttgttaggggatagtgcagctggtgaagccaatgctcatttaccattccaaaaatcatacagcctctaagaatgacgctaaatctactctgcctgtgccctaaaaatggaacaacgaagcccagatctgtttacagaaggatttattgaatattttaagaccactgttgagacctactgctcaaaaacaaagattcctctcaaaatattgatgctcactgacaatgcacctcatcacacaagagccttatgaagatgtacaagaatgtgtaatacaaggcatgttgttttcatgcctgctaacacaatatccattctatagccctggagcaaagagtaattttgatttccaagtcttattatttaagaaatatactttgtgaggctatagctcccatagataaggattcctcttggatctgagcaaagtaaattgaaacactcctggaaaggattaacagttccagatgccattaagaacagttttgatttctgggaggaggccaaaatttcaacattaactgtagtttagaagcaattgattccaaccttcatggatgactttggaggggttcaagacttcagtggaggaagtcactgcaaatgaggtggaaatagcaaaagaactagaattagaagcagagcctgaagatgtgactgaactgctgtgatctcatgataaaatttaaacaaatgaaaagttgttccttatggatgagtaaagaaagtggtttcttgagatggaatatgctcctggtgaaaatgctatgaacattgttgaaatgacaacaaagtatttagaatattacataaagttagttgataaggcagcagcagggtttgagagattgattccaattttgaaagaatttttgtgtgcatgtggaggtaaaatgctaccaaacagcattgcatgctacagagacttatttcatgaaaggaagaatcagttaatgtagcaaacatcattgtggtcttattttaagaaattgtcacagccaccccaaccttcagcaaccattatcctcatcagtcagcagccatcaacatcaaggcaaaacctcccaccagcaaaaagattacaacttgctgaaggctcagatgatccttagcatttttagccataaagtattttaaaataaggtatatacattgttttttagacataatgctattgcacactcaatcaactacagtataaacataattttatatgtgctgggaaaccaaaaaattcatgtgacttgctttattttgatatttgctttattgtggtggtctgaaactgaatgcacagtatttctgaggtatgcctatagttgcattaaaaaaaattctcctgatgttattgtcaagattttaatggcttcacttttacatttaaatatttgattcatctggaatctatgctgatataaggtatgagataaagatctataatttgtttttacagttgattatttgacaataattcttttttccattaacatacaatgtcatatttatcaaatactgagagactgtttctgatctgtgttctgttccatggatctgtctcttcatgcacaaaaatgagaatgttttaattattatatatttaaaatgttttaatattgattattatgtatatttgtcttttccttattcttgtttattttgttttccaaatgaactttaaaatcatcttgcctatgactccatgaaaaaattatattgctgtttttggattcttgaaaattcatatactaaagtaagaagaattgaatctttaaaatgacaaattttccaatcaaagactgtgacatgcatgttatttctttaaaggtcttcatgccctgatagtgttttagagtttagtttatatagctcttccacatgtctcattacatttattcctaggtatttaaatagtagtctttccttcctttgagactttctgactagtggtaatttacaaatattaaggctgctgatttctagatatgagcttcccccagccatctaattaaatgttttattattctaattttccaggtgtacagtgatatcatctttaaatatgatgattttacttcccttgcttcaatttttgtagtccttacgtctttctcttgtttattttgggttggccttcagaacgatgctgagtaaaggataaaggatgtcttcatcttattcttgattttaacaaaaatgcttctgtagttcccctaccgcaaatattgagtatccatgatgttctaggcaccaggatgtagcaaatacaactgtccttcaggactcaactcaaatccaccttcttccaaagccccctgtgatcatctcaaacagaaattgtctttgcctcctccaaacttcatattttccttccctttactgtcctactttttatcttgctttagaattatcagtatacttgtcttaaatagtccactaaaaatcggtatgctcagagaaggcaggatctttgacaaatcatctagtcatcctcagaactctgccttgcccacagcaaatgctcaacacagtcctgcttaattaattataaattagttagtatgaaaatttgttcaaatatatttgagcaaatactaagtaagcatctgctcagataaaaatgcaggattctcatacagagcacttggccatgagtaataaatgtaagtccggctctcaaaatatacatgtattcctatttggcactagccaaaagggggtgcaatatttacctttaaattattatagagagaatgagctagaaaggaaaaagccagttggagccagaaagcttggagtctttgaacctccctcagttctctaaatctagatgaaatgatatgaatcatcaagtcatttcatgccttttacacttcactttaggatctttttctctaaaaagcctctctcaacagggataatagggtgagtggccttagtatcagtgtttggtttctttgcgatgtgtaattggttttagctagtgtggaatgtcctcttgattttaaattcctatttttagctcctctgtatattgtgttatgtgttcactgttgctccccacacccctccttgcaagtctatacagaagcatttcatgtggaaccggagctgttctagggaagcctgtcatcaaggctgccctttgctctgcacctccccagcaccctcagaggtcagagcgaggctggtgtacagggcagtggatgtgagagcttgaatttcttgccaccttgttacaagccaaagtaggaagaaagtgtatccagaccaggaaacatgatttgtaatcgtggttgcaaatctagcaccctaaacctagcacaccatttggcacatactcggctcttaaatgtccatttaatgcatgaatgactaagcagataagtgagtgagtggatacatatgtgtcttattgggagacggctcatgaactgacattcaccatgggcttttctaagtttttcagtgggatcaatgttggtagtttgtatatttgcacttggtttagaaaactttcctttacctaatcctcaggcgatactgtgaactttgggttgcttacttgataaatatagttttattattaattcatgcatttgaaataacacatgcattgaaagcagcagcaaatccttttaagctctgtgctcttttaaataggttctttctctcatgctcaggaaaaaattcagtggagatgatggcaacagactggtccctcaaatctctggccatagcccaaggaggagagaacccacaattgcaggccatatgtattgccctgtatgatcagtattaaactcaaagtatgtctttgtaactagagacatattctgggtagtgtggctgttagtttgtcccaatctttattttaaggcactatccacatctctttctcttttcctttgcccctaacattgatatcaactgagttttcagggtgccagctgcccatgtcagctctttgagagagcagcctctctcctccttctgcctctcaatcctttcctctccgccagctcttctcggcatgttggtcattcattattgatgaccctccagcaccttctccaccccggtgttcccatagccctgtgcactgctgagcagagccaggtgcaggatctagtcggggtccaggactgctgctccaaggccgccaagactctttcccttcctggctgtcagagaggatgcctggcactagagatacagcagcagcggcgtcagccgctggtcttgaggagggtttgtttctctcctctgtcttctaggaagcaaaaggttaaactgttcattttaagagcctccctgggtataaaatactgagctttgtctttctggagtgagccgattcctaggccccttgacctttgctccaacatgtctgctgcccatcccttagagtgtttttctttgctttctatttagtcagaaggaatgaggctagtgtctgccgttagcttaattattggggaaaagcgttggaagaaaagaaactgattctctccatttttctaattgttacttaaccaagtcttgacaagatacaatttggtggctaatatgcatggagtgccctttctgaaagcagaggctctgcttgtggattctgcagtgaaggctggagtcacaccttggaaatgactgtccaccttcacatttgcacacatcacttacacacatggagctccttccaccaccagcctcccctgagccttcataagacacaggctgctgctttaaggaacattaacaatccagacccttccagggacccatgtgactccagcttctcccacaatagtcagaaatcgtaattgagagttcagaattcataggtaccaggataatattgcagaaagataatcaggcacctacttcccagttccctgaaattaaaacaggtattcatcttgtcagaataagaaaacagggtcctgctgtgttccagccacctggcaaccttgttcttagaatacagaaagggagggaagcaatgtgtgcgatcactctagccgaagaatgtagagagaagcgaagaccatttttttagtcctaatttcctacaagggacaatgcacctaaagtttttcaagccttgctcagaatcatctcacaaaaggaaaggccctttgcttcacaaaatattttaatgaaagcaaaacagtgactaagagcctcatgtactgctggttctgcctgtttcaaatcttgaaaggcctttaataacctccattatgtgactatgtgatttttatcacacaatctcagattcttacattttttaaataactcaccagcaagaaccaatgtcagaactaaatgctaataagatttggcctgggagagtaacatagtaagattgttaatgtttaatgcactctcatcaaagtgggataatcctacggctgaaggttaagtgagccttttgtaaaaaaaaaaaataatagggaagaaaacattattgtagcttttccattttactcagtcaaatgaattcaacataaacttgttatagccaagcccaggctagacatttcctggtgatctggtaatttcccttgtattgttcatgtggtttgtctctttcctcttcctctttgtttctaatgatgatgatgaacagcatctctgcaataggccacattctcaaagtgctccattcattgtcacttgaaaagaccactgttgggttttattgccatcattgatatacaaggataatttacatacaaaattgtggtttggttttagagccatggcaaccagagtatcacttctgatgggaaaaggaagaatggccttcagtgatggagtaggcaattgcaaagagttctgctcccagttctcttgctaaatcaaaagattgcaagggtcaagatcgatttcttcattttctttaggcagcaatctgaagaggccccagcagaaaactccagccttaggatttctggtaatcagaaaaagaagcaactgttcttgggtaacatgtggtgcccataaaagggcatcagctcttgggggcagcctgaggttaccaggttcacctttgctcattctgcgcaaggatcgctcccctcagagtttctgcaggggaatgtgtactctggtgttcggtattaaagcttctacatgaatttatagagttgcttacattggctgagaaattgttttttttttttttttttggtactcagccctaattttccctggcaaatattgctctgtaactttgagatgaatgtacccatcaaaaactccagaagaaattctcatgcagttctattattgctcatcattttgccaaggaacgttagtaaagagagctatgaagtggctaaagaagttgtgttttttgtttgtgtgtttgtttttccttttcatcgttttatgtcttagtaggagaagaatccaagatgaaaaggacaggctctggttttagctttgccactaatttcgtgtgtttccttatgcaagtgtccagatcttcttgggaattaatttctttatttgtcaaagggagctaataatacctgccctggccaacctgtaacatagttatgcgtaggagtaaaatcacagatgtgaaagtttgcaaaattctaagatccttaggtagctcatgcgtcgacaggagtaatgaattatacacctaccgcaaaaggtgattgtggggatccagtgtcaaagggcttagaagagagtgtgacacataagtagcatttggggatggtagctggaagaccaagcagcaagggtgttaccatcaaatcccttccataacccctctcccatacaaagcaaaggggtctaaatagccccagtgctcacttcaatgctactcatattctttggctttggagactttgcttttttggagcccctcattcctactttccagacatttgcagaattcagctgtgctttctaagagattctctggcattaacacagaatgaccttgcagtgggaatgaccttggagctgcagcgacttgagtttaaattctagctctgccccttactagctgggtgggattgattccaggtaactgtcagtaccttgtgtctcaacatcttcagttggggatagcgtcctaccatctccctcatagaggagttaacgagttgaaatgacacagatgctacagtcaggagatgctacgtaattttctgggcccagtgcaaaatgaaaattcagggccccttgttcaagcatattaagcacttcaagatggcaacagcagagcatgaaaccaaggtctaggtcttctgagctcagggtcttgtgcaactgcataggtcacatgcccttgaagcccaccctggccactgatcccatagtggcagcttgccacttagtgggcactcagtagagaccgcttgcttttctttcttcctctttctctcttcttctcttgatagccttaaatccctgggagggggggcttgcatttactcttacacttcctgccacagtttctccccttatgatcgttccttctgctggttaaattgccgcttctcttttgcccctgaaatcagggagccaagtgattaagagaagctagcttatctacacgagcctcccatctctatgtctgtatttcccaagttctttcaaagataacccaataaaataaagaactaacagcatcatgatacatacaaaggggctatggtgtatgtgtggcaggctggggagtaaggatggagaaggtattttgaggcaaagaagaaagaacaaaggaaaatgaaggtattagaagataaaagcttgcacttcacagaagatattattttgctgccatgtatctaagcacaattgaggcagattagttgtaaaatcacctcatttacttttcccagcttttttcagccactttcactaaatcaaccaaccaaaccttttctgtgcccttatgtcccttgtctctgaacttcatcaactaaatatttgttatgcattattttattcagcattcacagtatctgtgggtttgggtatgctacttctttcttcattttatagagaaggagatgatagagtaaccgtccatagttactgtgttcattggaaatgttttgtctccaagtagcagaaagcccaacttacagtgtctgtgttcggggttggaagttggggagaggttcctcctaatgagatgcttggaggcagaccaccgcctcaggggttagacagctcactgacatcctggctcctgtctgctgctctcttggcttttccctcataatcacaagatggctgctgtgggtccaggcatcacaacatggtcaggagaagaagaaatgagggaagaaacagtatccagcctattgttgtcttttcttgggaaagttacactttctcaggcatccactggcttacagacttctacttatgtctcattggccagaactgtgggagtttctagctatagaaatggcggagaaggtgagtgtttagcttttcccgcctttttcctggttgggggagacagctctagagtgaagcacacaacagtatatactttatagtgacaaagatagcaaggggcaaagacagaacctgaacccaggtcctctaatcttgagtttagagattttgccattctgccacattgctcttcttttaaaaatactttcagcaacatccagcttgtccacttcctgctgagacaagccaacaggtataactccaagttatggaaatttaaaacaggaaatatgtttatactatgccttcccttaaggttcctgagagagaactttctacaagttatgtaaaacagagataatgtggcttatagaaaatttattcctcacatgataaattctgtgcatgtgaagtttcgtagaactcactgtagcgcatttagaaacacacgaccagaaattgtgtgaaacattgctttgggatggatggtgcccgtctgaccttaagctatccttcccccactctgctgctcttcaaaccacagccagtttattttttggtagaaactatttacgtatgaagatcgtatttggatgcctttagtaatttattaaactcactttcctaaagcaagatcagagtttaaaacatatgtaaatatcagctgagagattagaaacaaaagccaagaaggaatttctccactgcaattaccacatgcagttaccatggcagggaagctgtgcgggataattcagtccaaggtagagaaataacagagtctggaaatgtaaatatgtttctgttagagatacttgaaataacgtttacactggcttcttcctttttagctatgggatattgtgcaaaacttttttgttgtgttttctttaaatgctccgggcagtaaattggaagtatatagcacctgctacatgtttagtcagtagtcgaaacattgaataaatcatgaaatctgtaggtgaactgaataatagctgccctggagagaactgtaattcactgttgacaaaataaatccccctgcatttttctggggaatcttttatttttagcaagagtgtttgatactcctaagttaattagtagttttaacagagtggaatgttattgaacctaccagtgttgtttaagagctaatgtttatgtgccaggcgccagattaggtaattttataagcatagatcattacattctcgcccagccctgtagggttcctagctctgcttttccagatgaagagccaagacccttagaggttgtaactagtccagagccacatgggctaggaagaaaggaagacctttcaccacttatttacacaagtaagttcttcccaggcagtgtggcagactcagcagattggcccacttaactcttgttccacccccactctatcttgtctacttctaccacagaggccagaaaccacaaatccccagcctcctgtggcttggcttggggtagcccaaatacacagttctgtccaaccatgcataggcagaattccctggggaacatttctctctccccaagtaggtaaagcttctttgccctttaccgtttgttgttccttttcttccttcatggaaagaagagtcactttcaagacatgcagcaaccaccctctaacaatcagaaggaaatacatggttaagattgttgaaacaagaagtaaaagaagtcaagttgcttgacgatattctcttttgtctttttattttttttattttttaaattatactttaagttctagggtacatgtgcacaatgtgcaggtttgttacatatgtatacatgtgccatgttggtttgctgcacccattaattcatcatttacattaggtatttctcctaatgctatccctcccccatgcacccaccccacaacaggccccagtgtgtgatgttccccaccctgtgtccaagtgttctcatcattcgtgtcccacctatgagtgagaacatgcggtgtttggttttctgtccttgtgatagtttgctgagaatgatggtttccagcttcatccatgtccctacaaacggcatgaactcatccttttttatggctgcatagtattccatggtgtatatgtgccacattttcttaatccagtctatcattgatggacatttgggttggttccatgagcttgatgatattctcaaatagattccctagccctaggctgcctgccattgcattccttattacacaagaataatcatctcttattgtattccaatcattgattggcattattttttttctgcatagcaaaatacatggccaaatcagtaaacctgaacttctcaaagtggccatctggtagctactagcttataaactgttccctaggtatagagaattgaaagcaggtgaagtgtgtgtgtgtgtgtgtgtgtgtgtgtgtgtgtgtgtgtatttcacatatcactcaggtcaatgttcctttgaaaatggagaatgcaactctattaagataatagtgtaaatttggtaactgatcacttacagcaattacaacaaaagatgcaaaagtcaggcagaactgggttctaatgctggctgtagcactggttggttatgtgaccttgagctcattagttagccttgcacacatttcctcatatatgattgaggataagagtagttttatctcatagagatttgaggggcatttggcacaggatcaggcacaaagtaagcactcagtggtattgctgccaataataataacaataataataataatagaattatttaagacttgcagattgagggaatttgatgaaatatataacaactgaggttaaagtgttctaattttctgtctagattcatcttttatggtccctttttaatctcacaccagtgtccttccagaattaaaaggtcaatgattttacttcctagagaagcttccttaggggcttatgaatggtgaaaatgtgcacgtttgcctcgactctctatttccattgtcgaaggccttcgcaaatttacctagtgattctagccaagtgcttcctgacattcttaggggctcgaaggtcaatacttgatttggattttttgttgttgtttctttttccctccagcctcctgtgttgtgttgatttgtaaaatggccattgtaaatgttaaaatggaaagaaaaccgagtctgttataagctttgatgtagtaaaaacagcatggagcatcttaaattttaagatgtcatcagaaaagaagctcttcccagtttcctcttgaaaatcattgtattagtcagggttctctagagggacagaactaataggacagatatatatagaaaggggaggttattaagtagtattaacttacacgattacaaggtcccacaataggctgtctgcaagctgaggggcaaggaagccagtccaagtcccaaacgattttatttgacaaaagacaaaaacagaagttatttacaatagtttttgctcaaataattcagtgggggcaactgtacttttcctccaggtttatcttataaccaaacccaagcagaggctgccccaccccaacaccccattttacacagctgggaatgccaaccagaattcagcagcgtggctccctcacccctcaccaccctctattgctcagtgtacagtggggagggaaagatcccacctcagcccaagaacttggagctgaagaacttggaatctgatattcaagggcaggaagcatccagcacagtagaaagatgtaaggtgggaggctcagccagtctagccttttcacatttttctccctggtttacatgctggccatgctggcagctgatttgatggtgcccacccagattaaggatgggtctgcctttcccagctcactgacttgaacgttaatctcctttggccacaccctcacagacacacccaagatcaataatttgcaccctccaatccaatcaagttgacactcagtattagccctcacaatcataaaacagaaaaatgagtgaaaagcataaattttgctttcaaaaagctgggagattctatatccatgaaccacaatatatgacgtaaggctggccaaatgcagtggaacgaaagctcaggaagggctaagagacaatcactatgatcaggttatagattttgacaaagcaagcaaaaaacacgtctccaaaactggtacttcagagcaggcataccctaaaggatgacgccaataagcctttgtttggaaaatggcaagggtattgcaagactggaagtagaaaacctccctggaccctacctgctaccatgtagtagcaaatgaaactgaaagggaaatgcacagtcatcctgtgtgtataggaagcagtccattgttgtggcactacggcagcctgttggccgagaagaagcagtggctaaaataactcatcagcacacaaccctttgtaataagacttaacagtaaatcaggtaaatttttaccaactcacaacatcctgactcctatcccacaaaactgtcctctaaatatctgaatcaagaagtttccacattcagaggaaagtaacaataaaaaggaaccagcacaggatattgtaatatgccatacatgacactacaaagatattataatataaaaggagaaaaaactggaaaatagatggtaaatgcagaacactcactataggtgattccaacagacaaatcaaaagataacattaccatgatcttgacgacttaaagaaaccaccaaagagctcaaaacagaaataaagaggtcaggggtaatatggtgacgtgagaagagaagaaacatacactgatgtagctctccagagaactgaagggggaaatttttttttttttttttgagacggagtctcgccctgttgcccaggctggagtgcagtgacgtgatctcggctcactgcaacctccacctcccgggttcacgccattctcctgcctcagcctcccaagtagctgggactacaggggcacccaccaccatgcccggctaatttttttgtattttttagtagagatggggttttactatggtctcgatctcctgacctcatgatctgcctgcctcagcctcccaaagttctgggattacaggcgtgagccaccgcacccggcctgaagggggaaaatcatcacagatatgaagatgattttgaagcagccaaagtaaaatagacactagacactgccgaacatagaatagaggatatgatgggcaggattatcaaagcaaacaaaacggaaacaacagcttaaaagtattagaaagaaaatagtatatttgggtgacgaggaagatcccagagatacatcacaatatatccctgaagaagagaattaaacaaatgaaacataaacaaagatataattctacgtaactttcaataaataaaagatttgaatttatagattgaaggagtctactatgttacagaaaatttgctaaagaacaatcaatactactctgtattatagatgtattgatagatcttggagataagaatgatttggtcacaccagcaggaatatcaagtaacctatacaagaccacagtttaaaaaaaacctcaggctaacctaagccttccttacagcaacattccaagattgcagagagtaatgcccatgaagccctcagtgaaaaagtatgtggccttagagttttatgcacagccaaactgtcattcaaatgtaaaaacaataaataaaacgtgtccaacatttaagaacccagagaagatgattcccatgagttattctttaaaaaactattggctgggcgtggtggctaacacctgtaatcccaacactttgggagactgaggcaggtggatcacgaggtcgggagatcgagaccatcctggctaacatggtgaaaccacatctctaccaaaaaaattaaaaattagctgggcgtggtggcgggcacctgtagtcccagctacttgggaggctgaggcaggagaatggcgtgaacccgagaggcagagcttgcagtgagcagagatcacaccactacactccagcctgggcaatagagcaagactctgtctcaaaaaaataaataaaattaaaaaataaaaaataaaaaactattaaagactttatctaagagatgaatgaagaaaccatggcaaaaggattttcagtgaacactgagtctgttttgcttttagactgggtctaaataagtgcagaaacttttgttatagaaaaaaaaaactaagctctgaatgttcataaatattttaactaatataaggataaggtggaaggtggtatgtagattcattcatcatctcatttaaacatgataaatcaagtatatttaaatatacttagcatacttactaaagtatattagtaaattaatatatttactgaagtatattagtaaattaatatatttactaaatatactaagtatatttaaatatacaaaaataagtgtaggaatgaacatatatgttagtttgaaatatatatgtaatatataaggtacatgtttaatatgtaaacatataatatatattaaaccaatgtttagtgcctattaaccaaattcaagtgatagaaggaagagaaaataaagaacaatttgtattgcttttagtggaaagtaaaatgtcagtgtttcaagaaacagagaagttaaatagctaaataagggttagttacaaaggtgatcactggaaaaattaaccataatacaaacctgcccaaatagcacaaggaatactcacaaaaagaaaatatagaccaaagagtagaagatttttttaaaaaagcaatagaaacagaaatcaaaatactataaagtaagaccaaacctgtttctcatatcaacaaataaaagtgggctaaactcccatattaaaaaaaaagattctgaaatcgagtaataaagtaaaacttaaccatatgctataccccatatatacctaaagcaaagtgtctcgcaaacttgaaaatagaaggatgagcaaaggaatattatcaaatgccaacaaaaaggaaagtagaggccaataatcttagaataaaacaaggttgaatttagaacaaaaagcattaaacaagaaacataaagacaattgtgtgataagatgtatcattcacaaggaagatctaatagtcattaagtgtttctgtatcaacgtagcctgaaaagttaagcaaaaactaccaaaaagataaggaaaaatagaaagactttaattataggaggcttaacagacaaaatagacccaaaagatgacatagatggcctaaataacataagtaagtagtaaagttacatatatcaatctatccctgaaaactaaaaatatgtcatcctttcagatgtccataaaacgtttcccagaactgactatactttagaccacacagaaaacctaaataaactccccaaatcagaaatcacactgatattgtcctctaatcactatgagtcaaaaaggaatccatgtgaatgtatagaatatttaaaattaatgataatgattataaccacattacatatcctatgggctcaactaaagcatttgctcaaaagaaaatttgtatacgtaagtacttaaattaatgaacaaaaaataaaggaaatcagtgcatatgtcttctactcacgaaattaaatataagaaaaataaagttaacctcaggaaaatataaggtagctatgataataaaagcagaaaataggaaaaaagaataaatctttaagttagctctttatgaaaaatcaataaatcattagtaaacaaaccaaaatggttgccaataagttattttctaggaaaatataaaattaccaggcatgaccccagatggagagaaaacaacaatctaaggaaatgaattagtatagaagaaatacagaatgtggagaaaaagcaaacctcttgaaagaaaacaccagtcctggaatatttcacagattacttctaccaaacctataaggaaaaaataggtccaatattatttaaaccaagtgaaagcatccaggttatttttctgaagctagcatgcatcatgcatattctgataaatagagcacacaaaaaagcaaactaaggaccaatattgcttatgaatatcagtgtaaataatcctaattaaaatattagaaaacaaatctaagagctcacaaagacaagaatttgctatgttcaaatgggatttagtcttaaaaaagtaagactatttcaaaattcacaactgtattaatttaattcataaaatattgtcaaaattaagaatcactttatcatctccataaatacttgaacaggtgtttgataaaattctctaatcttgatgaaaaactcataataaaatgctattttattatacagacagagacatacacacatacatataccaatacatacttagtaacatggtcccaaagctactgatacaactgctgaagaaagtgtcattaatgtcggctacaaggaaagataccttaatcaatagcattaattaacattattgctccagagagcctagctagcctaagtaaacaaaagaaaaaaataagcagagtaattttaaccaggagttaaaattatcatatatgcagatgatatgattatgtactgtaaaacacaaagaatcacatggaaaaaatagtataaacaataaggaaatacacttaggtgattgagtacaaaaatactactcatgttaatctttccacaaacagaaactggttagaaaatataactgaagagatcccatttacaataagaataaatttaacaagaaatgtgcccaaattacacaaataaaatttttaaatgctactgagaaacatgaaaaatgacttaaacaaatggaaaggcatactctgtttaacataaagatgtcttatctaaattaagttatacaggtaatgcaatgcaataaaaaaaaaaacaatagaatctacaggggtagattctaaagttcaagaacaaataaggaagcccaacccaaaagtttctgacaaaggaaaattaagaaagggggattagccctatcaaatattaaaatgtattgtagtccgggtacctgaggtcaggagttcgtgacctgcctggccaatatggtaaaaccctgtctctactaaatatacaaatattagctgggtgtggtagtgggcacctgtaatcccagctacttgggaggcttaggcaggagaattgcttgaacctgggaggcggaggttgcagtgagcccagcggcgccactgcactccagcctgggtgacagagtgagactccatctcaaaaaaaaaaaaaaaaaaaaaaaaaaaaaaaaaaaaaaaaactattgtaaaactacagaagttaaaatatatatgtctccatatctttttttatttttaatttttatggccacatagtaggtgtatatatttatggggtacttgagatattttgatacagacatacaatatgtaatcatcacattagggtaaatagagtatccatcacttcaagcactcattacctctttgtgttacaaacattccaactgtactctctcgttattctaaaatgtattacaaattgtcactgactgcagtcaccctgttgtgctatcaaatactagatattattcatttatatctctatatcctaacaaccaggaagctctatgtaagtgtctagaaatagaccaaactacatatgacaaattttttatttacatatcaataaaaaaatcagtctattcaaaaatgttattgaaacaactgaatacctctttagaaaaaaattaacaagcacaaacaccataaacaaaatcagaaaatgatatactgagaaaaatcatttacaaaggactattcttttttttttaatttaagttctagggtacatgtgcacaacgtgcatgtttgttacatatgtatacatgtgccatgttggtgtgctgcacacattaactcgccatttacattaggtatatctcctaatgctatccctcccccatccccctaccccacaacaggcccagtgtgtgatgttccccaccctgtgtccaagtgtactcattgttcaattcccacctatgagtgagaacatgcggtgtttggttttctgtccttgcgatagtttgctgagaatgatggtttccagcttcatccatgtccctacaaaggacatgaactcatccttttttatggctgcatagtattccatggtgtatatgtgccacattttcttaatccagtctatcatggatggacatttgggttggttccaagtctttgctattgtgaatagtgccgcaataaacatacgtgtgcatgtgtctttatagcagcatgatttataatcctttgggtatatatccagtaatgggatggctgggtcaaatggtatttctagttctagatccttgaggaattaccacactgtcttccacaatggctgaactagtttacagccccacaaacagtgtaaaagtgttcctatttctccacatgctctccagcacctgttgttccctgactttttaatggtcgccattttaactggtgtgagatggtatctcattgtggttttgatttgcatttctctgatggccagtgatgatgagcattttttcatgtgtgttggctgcataaatgtcttctttcgagaagtatctgttcatatccttcacccactttttgatgggttgtttgattttttcttgtaaatttgtttaagttctttgtagattctggatattagccctttgtcagatgggtacattgcaaacgttttctcccattctgtatgttgcctgttcactctgatggtagtttcttttactgtgcagaagctctttagtttaattagatcccatttctcaattttggcttttgttgccgttgcttttggtgttttagtcatgaagtccttgcccatgcctatgtcctgaatggtattgcctaggttttcttctagggtttttttggttttaggtcttacatttaagtctttaatccgtcttgaattaatttttgtataaggtgtgaggaagggatccagtttcagctttctacatatggctagccagttttcccagcaccatctattaaatagagaatcctttccccatttcttatttttgtcagttttgacaaaggactattcttcttaacatgttaaaaatctcttgaataaaattaaaaaacaacccagtggaaatagatagggcaaataatataaataggtacttcccaaaaagaaagaaacatgatgtaaaccattgaaaaaatgcacagtctcactcacaataaatgtatattaagactactgagagatgctgatttaaaaaaaaaagcctgccagatttcacattgacaaggatcaaaaagtttaatcacacattgttggcaacactgtagggaaataaggtaccctcatacatctttggtggacccatgaattggtacaatgttgattaggagcaaattgccagtatttatcatgcaacttgcatgtatctcctgactcagaaatttcacttctaggaattcctcctacattacacttgtgcaattgtgtgtacttgcacttgtgtgaatgatgtatgtacatgaatatgctttgtcatattgtttgtgagaaccaaagattacaaaccaccaaatgctggccaatatacattcattaccacaaaggtctggtcaatttagagaaagaaatcctatgtccacgaaggatataatctctaagaaaacaaagtgctgacagcatcatagagtatgttaccattattgtaaaatggcaatagtaataattattatataaatatatgcttgtgtatgaataaaatgccctgaaagtatactgatagagtttggatatttgtccctgcgcaaatcacatgatgaaatgtaattcccagtgttggaggtgtttgggtcatgggggcagaccccttatgtcttggtgctgtccttgcaatagtgagtgagtgctcacaagatctggttgtttaagtgtgtggtaccacacactcctccttgcttctgctcctaccacatgaaatacctgctacccgtttgccttctgcggtgactgtaagcttcctgaggcctccccagaagcagatgccagcactgtgcttcctgtacagcctgaagaaccatgaaccagttaaacctcttttcttataaatcacccagtctcaggtatttttttctttcttttgagatggagtctcgctctgtcccccagactggagtgcagtgacgtgatcttggttcggctcactgcaagctccacctcccgggctcacgccattgtcctgcctcagcctgccgagtcgctgggactacaggcgcccgccaccatgcccggctaattttttgtatttttaatagagatggggtttcactgtgttagccaggatggtctcaatctcctgacctcgtgatctgcccacctcggcctcccaaagtgctgggattacaggtgtgagccgttgcgcccggccaggtatttctttatagcaatgaaagagtggcctaacacgtatacattagaacctgattacagtagatgcctcttgggaggggacttaaatggccagggttggtgataaaaagtattttttaatgtatccccttttttatctgttaatttttttatgtgtatatgtattacctattcaaaaagttaatcaattttaaattaacttagatcccaattcaaactccacatctgctacctccagctttgtgacctagagcaaactgcaggccagctgccttctctgtggagcagggactgtcagaactcccccatcccagggtgtgatcagagctacatgagataatcatgggaaagtacctggaaattacatgtaattgcttagtaaatgccctccgcttctttccccccagaattaaagtaagctgcatctaactattacaacttaataaggtgcattattgtgctttgctgtgtttttaattttcttgtcatacctgaatggtttaaacatctggcttccttaaggcataattaagtaaaagagagagcagcgtacatcaccagtcaggtgtacttctttccctgttgtaaaagtgatgctttttattcagagccaagtctagatattcaccagtccttggcacgactagaaaaagatttgaaggactaaagctgctagagcataattatgtattggctgtggacttgagatgcctgggttctgtccctcctgactgtgacttagcagccgtttgtcactggagatgttttatgacttctgcaggcttccacagtatcacttgtgaaatgggaataactatttaatagctcacagaggtgctgtattaggttctccagagaaacagaataggatttacgttatatataacaataggatatagcctagatatatagatatatatatataaggatttattgtgggaatttgttcacgtgtttgtagaggctgagaagtgccacatatgccatctccaagctagagaagcaggaaagccagtggtaaaattcagcatgagtccacaggcccaagaaccagcagctctgatgtcccagggcaggagaaaagctggatgtcccaggtcaagggaaggagggaatttacccctcctccttctttttgttctatctgaaccctcaatggattggaagatgcttgcccacaccagtgagggtaatctttactcaatctactgattcaaatgctgttctctttcagaaacacactcacagtcatacccagaaataatgttttaccagctatctgggcaccccataacccagtcaagttgacacataaaattaaccatcacagacactgactagaatgcataaagtccatctagaaaagcacccagtacataataagcactcaacaaatatttttggaaaagtatcaaacactctgtgcaaggagcaagaaatggttcctactttcacggtctacacaaattaatagggagatgaaacaatggcccaaatcactagatcaccaagccatttaggagaagaaactgaagtgaagggggtaggcatgactcataaagagtaatttcctttccctctctaaggccccaccagtgaactggtggccacgttgactaactggagacaggataccaaggaggacagacatcattgtgaggtcccattctacgtaccccaaaccaacagagtcctctggaaggcctgagagctgttaggaacaagacgaaatgggtgtgagattgaagaagtcacaaaatgcagacattttaagctattctcccaaaatacattaaaaatcttactgagaaaaatgtgaaatatatacaatactcacttgcatatactatttcttattttattttatttatttattttttgagacagagtttcactgttgttgcccaggctagagtgcaatggcacgatcttggctcactgcaacctctgccaccctagttcaagcgattctcctgcttcatcctcccaaattgctgggattacaggtgcccaccaccacacctggctaattttttatattttttagtagagatggcgtttcaccatgttggtcaggctggtctcaaactcttgacctcaggtgatccacccacctcagcctcccaaagtgctgggattacaggcgtgagccactgtgcccaaccaacactatttgttattttagatgttgggaagttttcatgaaaattctcttgtccattctcatttacatgcacacacatacatatgcacatgcatgaacacatgcttcacggcgcttcttattaatccttattgggtaaaatcttattgagggacaataaaccagataaaatctccaaccactccctggtgccaagtctcttgggcccctcacactccaggtgggcaaggcagcatgccagtggacacagcatcacctgctcagagggagtggttgtggaaagcacagaggcaggcggcctggtggccaaggtccacaccacatcctcccaggtgggcactgtcctgagtaggcttaaactggcattgtctgtccagtaagtccttttctaaggaaagcaggtatcaactaattagcaacatgcaagtgttttcattttaggaaaagagaagaactctggaattatggggcctggtaaaggttcatttaagcgtcaagatcaagttggctaaacccatagtgtggaagcactctttgcgtagggtgagccaggtggagcagctgtgtgacagatcttggaggcagtctaagggcaatgagcacctggagaacaaagagggaggggctgcccacctgaggaggaagggacatgtgcaactgtctcctagatggggccctgagaactgccgggagacatcacagggcagcccctctccccacctctggctacacagtctcctgcccttctctactcagtgaattctgaggtcaaaggctactgtgccaaactttcaagtagagtgaagcctcctccgtggtgaactataaacttggatggcatcatgtccatttttgtgttcttcacagcacccaacagcaggttcacagtcaacgttagtgagggaccgagattgtagaagcaaatatttctccagcatcaggggtgttgcctcactaggatctaccattgggatcccaacccaggatgatggtttgaaaccttccggtccagttctcccccatttgtcagtctttgtccttgacaattaatgctgtaaatgcatgtactaaatgcccactgagtgtgtgtaacacacaagccggtgatatcagagtggcaccggacagggagcaacacttctgcaaaggagcaggtattccaagtccttctcatctttcctgagcatctgtcatttgggtggacctcactgcacccttcagctattagcagtgactgtaaatggagaagaagttctcgagaaccagcagcaccctgaacactcattaactgagaaaaattggagactcaaggaggcccaataccctcttactgaatacccaccttccttgtgccagggaggtcatagggaggttgaaaaatcaagggttttgccatgtgtctgagtttgattcctccaaaagggcattaacttttcatattacctctgcagagtgggatttaaaatctgtgttagtgacacgatatttcatttcagatccacagggcccacatttaaaattaatattgcatgcttgtcagaatgaattccaaaccctctcacagcaggccccttgtgggacctagagaaggagtggccaattcattatcgtaacactgggatgagggttccatcccagcttttgactgacacctgcagagattttttttttctgagacattttaagtttttggtgtgccccatcttcccagacaagctgcacgtttctgtcactctgtgctgtttccaaagcccagtggtctgcagggtacctttgaggggcctcctctgatccagttaatcagttcctcattgacaacatagacagagcatctggcccaggccagagagggctttcggccgagtccctctggaggatcagtctgtagagggatgtgactaaggcagcagattccgccaggattctgttagacacagaggacacaaggtcacctggccaaaagtggaggtcaggaagactcaagatctgggtccacctgtttcattttctcttagcatctgccctggcctgctgtcgtaaatcatcatcaccgagcttaaaaccaccctgtcgttcaaaaaaaaaaaaaaaaaatgagctatttggtttttgaacactttccttacagtgcgtagcagtttgttagagaggtgggcaggcattaggattttgtttataaccttggaataaactaagccaacagactgtattcttgcagggttaatgtcccctgctttacagtatgggaatgcccaacgaagtttttattatagagggtggaatatggtgcagtattcagtggagacaattgccccgggagtgcagcgcagaaagccacagctgcatctccacttggtgtcggccgggagctgcctcacctggggctccagggtccctttgagaccgcagttccatagcccgtgggtactgtccttgtgtcatcatcctctctctctctctctccattccagtcattcactctctccccctctttttctctgactgcctccaggcactttctttagcacagagctctggtgatacctcccactggccttgggcacccttcttcaaggccactcaccctgcatggaggagaggaagggaaggagtggccaattcattttcgtaacaaacacccaattttgtttttctccgtggactatccagatgcatgcttcttttacagttcatgtctgcgatactttgtcccttagagaaaaaagctgtatacaaatgtgaaattattccaattatctaatctctgttgcattcctcagccctgcaaagagttaaatgatgtgtaaaatcacctgttagcccgcattagacagggctgtatttacacacccagaggtggcctgtgaattatttaaccgaagggactcttggctcagcatctggctagacactgttgagcccaagttccttaggaggtgcagcctgtggccccagagcttcctcttggctggggaaaccgtctgacagacacggtgggctgctgccagaaccaggtctccttgagaacaacttgaactaagctcctcccagctccagatggttcacaaactagagaggagttttgcagagtcctgaacgctttgccaaaaaagagcgttggccatcttccaggccaggcggtaggtttgcctgcatgctgtgaatgccaggattattgttggggttttagagagtccatttcataacacccccagttcccatctgaatttggaaccaatgagagaaaaagggaaagcagtgagatggatggagatcaaaacatcacttttgtcaccaactgacctctcagagaacagggggagagtgacactggatgtcccaactaggaaccccagagtagagacacacttccatgaccagtgctggaaacccatctgcctcatgccaggaggcaggatcttgggtccctgtaccctggtgcagggaacggaaaggagccataccttctgcaagcacccagctcctcacaggaagccagggccaattcttccacctctccttgtctcatctcacttttcaggtgagcttcctttctctcctaccaaggagagggtgggggctgtggcaagagatggaggcatctggggaaaagccttcctcggggaaaacagcattccatatatctcccagggagatgggacctgcatatatttggaggaagaagtcatagagattgcaagagctggagaggattttagaagccactggaatcctctcattttactgaaggaaacagaggcacacgggtgcagcgaaaccctcatggttatatagctagtcaggggcagggctgaatttgtgtggcagtctgcagtttaaagccggtccctcatggtatggagaacacagcagtgggcatttcacacgcataatctcaccacagggggccaggctgcctcttggtctatgggactccaccccactgtgggtttcagggcaggttcccactcctacctcatctatcccttcttgggaatgggagatgcttggaggatgcacagtaattgaaatgctattcctggcaaatgatcatttccgggggaaaatgtgaatatcatgatatcaagtcaaataaagctgttaggttgaggctttgtccttgagctttttagactctgaacaggcagttgggaaggcagtcagctcctgcctgagtcactgggcaggacagccagcccagggaaagatgagggaagtgggggacctgcgttggtatctcactgggaggatgctgtggcctccccattcgatggagatccttgtcaggcctgcttttgcaaatgctcagaactccaggcagctctctggccctcttctttctgtcctctccatgcagctcccactgctgtatttactcggttggcactttccgctgtcagaatcacatttctcccagccactcactgtgttgcagaatctgtgtattgtcttttcttcagctggtgttttgggcttaagccctgaaatgctttgttctgggccccactacagcacccatactgtgtgctagagaaaacaggaaagggccctcaccatcacacccatgaccttggggaggccagcacctttgttgtcatacttcccaaaaccctccatcccctccctgccagaggagctagcacaatctagatgcccactggctgaggtttatttccagcactgcaaggtaacaggtacacacatacgcacaccagatttccattcccattaaatctctgcatccccaaatgagctacctgttggcaaaagctttttatctgtcagaagttctcaagtggaagttgtctctctctctttgctgcacgtgtgttaccacaaatgcggattgtgccggcctttctccatctcacccacaacctccccttaaacctccatctccaacacccccgagtcttcaatgcctcaggagaattctgaagccagcatataattgctgtccagaaagaggccccgtgggaacggaaaggattttgtgtgtgctcacccctacatttaatggggccatccttccccataaggctcagtgctgcaaagccaggagcccacccccaaggctcatgccaaaccccaattatctggagggcaactggccctgggagctgggccaagcacagcccctcctagctgcggaaagagccttcctatatgtctcgtttgacgcctacaaaaacctggggaagctggcagggcagggggtggggaggttaagcccatagggtggacaagccacagggctctgctccctcccttccccctcatttcttcacccctcccccatgaaaccatcaatcaccttgatggcaggagggaggggtgcttggctgaattgacttgaaaacactcagaaacccaaattgcacccacagaggcactcagaattcagggagatgagggatgtccgcctgaaacacttttttgcagtaatgtgttccgtgatggaagtcatctaattcattcatgaggggactgagacctcagaggaaagtggtgtccctgaaactagcaagggtcagaactacttgcagagaagccactaggaaggctttccagatgagactctccccctactcccactaatattagagggactcccctccctccagcatctccccacagggtctggctgcctcaggcttcccttggctctcagagatgcccttccactcaactgctacccacatgcttctacctgctgcacacaccctttctgtctgcagcctctgatatggtttggctgtgtccacacccaaatctcatcttgaattgtacctcctataattcccttgtgtcgtgaaagggacccagtgggaggtaattgaatcatgggggggcaggtctttcctgtactgttctcatgatagtgaataagtcttaggaggtcttctgcacaagctctctcttgcctgccaccatgtgactttgctcctcgttcgccttcctccatgattgtgaggcttccccagccatatggaactgtgagtcaattaaacctctttcttttgtaaattatccagtctcaggtaggtctttcttagcagcgtgagaacagactaatacagcccctcccctaggctttccctccttagagttcatgttgcagaccacttttccttccttctccgctactgactgcccccatccctgtttgtccagggttctcctgttttctgggttccctgatgagagttagttccttttagggactaattcgtcctagggaggactagattaatagactaccaagtcccctttccaaactgacttgcattttaagatggaaaagtgactcccagggacagggcattggctcaacaggtgcttctacagcttggccgtgacagcctgtctctacatagaaagggccaggggctgcagtctttgcttggagctgtgtttgtagaacaagcacactgtttttaacgtggtttatggttttgtttaaatcaggagtgtcgaatcttttgtattccctgggccacaatggaagaagaagaattgtcttgggccacacataaaatatactaacactaatgacagctgatgagcttaatgttttaagaatgtttacaaacttgtattgggccacatgtggcctgtgggccactggctggacaagctcggtttaaattgataagatattcgggaagaagatctaatcactctcctgccagcctctaccctgctgctaaaatgctttcacaggatctaggtcactggctttgataatcaccacagcttgtggatgtcctcctaagtctagtgccggaagggaactcggtattcctcagtgtgaactggaagcagatgaaggaactccacctctcactcaggtcatcatgtttctgttaatgcatcctgagatcaaattcacctttttcttttgctgccatattatattacaatttttcagttgacttaattgcaaagtatcttctatttgggctactgagtcacttatctctcaaattgtgtgttgttctaactatatatctatgccataagtataagggtttacatttattccttactttatgtcatcttaaaacaaatgaaagactactctaatcatgccacttctcactcctgattctagaaaacagtgtctttcttgaccctcctagttttaaatctggactatgaatctggcattcattcttatcccctaacattagacagagtattggctttcagaaagctaagctttgaagtactatatgttgtgtggcttactggagatcagacaatatgcaagaagtcaaattagttagtttggctcatggaaagctgtctaatttggaaataattaggtgtcatctcctgagagagagagagagagagagagcgcgcatagggagaggcagtggggaagaggaagagagagaggacagaaagggaagatgagagaaaatagttttcattacatgttaagcagaaagagttggaaaaaaataatttctatgatctgcaaagtcatttcaggagtacattagcttgctagggctgccatagttaagtatcacaaagtgggtgggctaagtaacagacaattattaactacagttctggagaccagaagtctacgatcaagacagggttggttccttctcggggctgccaggaaaggatctgttcccagcctctctctctggcctgtagatgactttgccccctgtgtttcttcacagtatcttccctctgtgtgtgcctgtctgtgtctaaatttcccctttttataaggacatcagtcattttggattaagatccacactaacaacctcattttaactcgattacctctgtaaaggccctatttccaaatgagatcacattctgaggtactgaaagttaggacttcaatgtctcgatttggagtggggcacaattcagtccataacaaggggattcccaaagagttgtcataggaatatcacccatcaggcaaagctcctggaagcagatggagccaccattaggaaagtttcccatgagactgtggtgcttctgatgtggctcagctctggaactgactcccacccccatcacccatttcaacctctaacccccaccacctaaccaacaccccctcccctgtaaaagcctttcttcttaagtcaggggtaaactttccacattattatggtccgtgtttccaatgcagtggtttctcagatctgcatcgctcctctctacctcctggttccctgcaactccttaacccacaagcagaggaaggagaagagaaggaccctattgtttagagcagaggtgctgggttctccctctacttacaaccttgccctctctcatttctcctgatgaccaggtagggtagacagcaacatccccatccaaacatgagcagtgaggtgacctggccggttcgatgagtggtaggcagcacagccacaggccatctccctcctaaatggggctgggcccaggggttttcctaggccctgcctgactatgctgcaggctctgccttacacttgctcatcctcctgttgcagaagagctacagggagacaagctacaaaaaccttttaatctgtatgattaacagaagcaattggcaaatgaccctgctgctctcccaaggggaataaggggtttattttcagatgctggtatttatcccactgaatttcattgtgcagcctacagtccatcaaatgcttcccagagtcacccagggtttcttcttagattaaaatcagaattaaatcagatagatacatgctttatcaaatctcattttcttggggatgaaaaataagtttctctttcagtctgtgatttcaggaacaggaagcaaagaatttggaagtttaaaaacacctttgcctgagcctgcatagcttattttttctccaggcagatatgggcctccccttgacaaggtgctacctgtaggcaggaaagtcctgctgcttgtcctgccatgtaatggaacttgggccataaggtggataaagataaggctgctctgagaagctgtattagttttcacaatgctgataaagacatacccaagactgggtaatttataaagaaaaagaggtttaacagactcacggttccacgtggttggggaggcctcacaatcatggcagaaggcgaaaggcacatcttacatggtggcaggcaagagaaaatgagagccaagagagtgagagccaagcaaaagaggaaacccctttaaaataatcagatctcaggagacttattcactaccatgagaacagtaggggggaaacccatgattcaattatctctccactaggtcctcccgtaacatgtgggaattaagggagatacacttcaagataagatttgggtggggacacagccaaaccatatcagaagcacagaattagtgcagagttggttaatgaaataatcattttctacataggtaggggagttaaatgatcatattttgccttttaagagtatcatataggaactcttacaaacctatacaaactggggcttgttatgtgagaagtgacgttggtgatacctgcttggaaagcataggtctccaatcccagctgctgtcctctgggagctgcacaaaagaaggtctatcacatgcttctgaagggagctgtagaagcttctgtggttattcatttgctacagatagaagaagaaattaaaaccaattgtgaaggaaagggaaatgaacattattgaggagtgagtaactgtgtggcaggcactgccctgagagattttgcctgcatgctcacctaaattttagaaataggactagctttaaaaaaataaaaaataaatttgagaaataaactattatcctttagaattgataaaaagtagttcatggatattagagatattttggtaaatatcactgtaaagcataaagaaaagaataaaaagtacccatttgctatgatcagaatgttgtgtcccaccaaaattcatatgttgaaacccagcccccaatgtgatactgttaaggggtggggcccttggaggtgattaggtcattagtgttctacctccatgaatgagattagatttgaggaagcctgtttggctctgctggcttatcaggacacatggaaagtgccgtttaagaaagcagaacaagccctcaccagacaccaaatctgtcagtgacttgatcttgaacttaccagcctcctgaactgtgagtaataaatttctattgtttataagttaccccggcaaagatattttgctgatagtagtccaaaagaactaaagaactaaaatgccattgtaccttagcccattctgttgaatcctttggtggctggattgaagagctgggcagtggagagaccagccaatttagaaagactagggggtgcctggtcatgctgccttctatgtaaagagtgggaagtggggcaatgcagaggacattttttggtgcaggaacaccatgaggggaaggactccaagtcttcagatgagatgatggtctctgggcagtcagttacagagcaggaacagcactctgatgtcacttggaaaggcactcatgaaagcagcagagcctgagctggtgtgttcggaggcagcattaaaaatcagcaggaaaggcatgagacatgaaaccaaaaaagggatctttgctgctgggtctcaggcaacacaaggaagaggtttgtcctgggaccccctgtgaggttctaggacctcaggtgctgttgggatcaggcaggaatttcctgaagtcagccttgtggttgcacctccttctttgcggccctcctggggactgttcttcttttttagactcatttaaaatcctcaaggggcccctctgctataagaaagcaccaagggaagggccctgcctttccagtttcccagcacctagcatgcagtgagtgctcaaatataatttatatttggaatgagtgatgattctctctgcttcccctttgggactgaccttgatgctcatttctacctgattttgcttataaattgtgaggagagttctctacactacaatttatctcagtatccctccccagctggtggctctcatgtgctcactggagcagtctgggacatcaaacatgaacaatgacatagtgaaagaagaaaatgcctggggaagataatggcactatctggagcagggagcctgccatctaaggaaatggtaaaaagaaggaggctccttagggcaggtttcaaggggccagaggaagccccaaatgcgtagaatcacagccaggtgctcaggaggggcagcagaagcagccctcaggacgaagggtagtggtcatcgtgcaaggcagacaagggccctagggtgcaggcaggctgggaagatctccagagaatgaggtgggccatctgggggcatcactttgacctgtagacaaagtgaagggagaggggagggtctggtgatgacagcctcagatgcagactctttaagccttctcaaggctttccagtttttgcagctgctgaggaaacttcattctcacccttcttgttccatctgaaaatgcacttctctccagagctctgggagactgtgaaaggctctctcattgccctgaaatatttttttaaggaatgagtatgatcttttctattctctacttctgtcccatgcagagcagatgtagaggaccaggagtgattcagagatgagaactgaatcttccctccagaaagttatgttccagagggaaagaagcggaacttcagtaacagagaatatgaaattggtcctaagtagaggtatgtggctctcgtgactggagcagagggagaaagacttgattcaggttcttgcctcgcagccttggaatgggaaaaaggaataaaaaatatagaacatgggtattagttcattctcacactactataaagacatagctgggaatgtgttatttataaagaaaagaggtttaattgacttgcagttccacaggccgtacaggaagcatggctggggaggcctcaggaaacttacagtcatagtggaaggcaaagaggacgaagtcatgtcttacatatctgcagaaggaggaaaagagcacaaagatggaagtgctacacacttttaaacaaccagatttcatgaaaactgactcactttcatgagaacagcaaaggggaggtctgccttcatgattcactcacctcccacgaggcctctgctctaacactggggattacaattcaacatgagatttgggtggggacacagggccaaaccatagtaacatgtataatacatatgtatgcaagtactggaatatcaagtttcctggaggaagtagcttttgagcagggcctagaagcatgccaaggatttggatgtgtttgttgtgggtggatgaagtccatgaccagcaagcagactcaggagagttttgcagataagtgtgtccagaagcaaaacaggctgggaggagtggtggtgctggaaaggtggcagatgccgaatgatggaggaccttgaattccatagtagggaatttggcatttattttgtagctgtgggaagccatagcagtttttcaccaaagagataatttacatcaattattccaagccctcagattcactccagttgctagttcagttgtttggttcaaggaagcgtcagaaaggaaatgaaccagaaaggatgagtgatcctagagtccagggtgtccttggggtcagagggaggacaaggccttatgttccctgccttttccaggaggaagaaattgtagtaatattccaggacactggatggacttgtttttctttggaaacaaggttattgacctctctgccgcagtaagagaaaaatgatatatatgttagaacttgaatatttttgtagaaacttaatattaaaggccttatgttcaaatatgcagcatttcacagtgctggttgaattatttgggctaggttgccacatggtgttccatgtacaattctccttggtaggctgggttaaaaaatgtggctaggtaaaatgtgagatgagaaataaaaaaggatctttgttttttcatgcttgtgatacttaaataggctactgtgacccaattaagaagctcccagaggccaggtgtggtagcttatgcctgtaatcccagcactttgggaggccaaggcaggcagatcacttgagttcaggagtttgagaccagcctggccatcatggcgaaactccatatctcccaaaaatacaaaacttagtcgggcatggtggcacacacatgtaatcccagctacttggaaagctgaggcaggagaactgcttgaacccaggaggttgcagtgagccaagatcaggccactgtactctagcctgggtgacaaagtgagactgagactctgtcttaaaaaaaaaaaaaaactatccaggcgtggtggtggatgcctgtaatcccagctacttgggatgctgaggtgggagaattgcttgtacatgggaggtgaaagttgcagtgagccgaggtcaggccactgcactctagcctgtgcaacagaggctttgtctcaaaaaaaaaaaaaaaaaaaaaaaaagttcccagaaataacctctaagccacccatctaattggtcccagagagatcaaaaaaaatgcagcattgaaaatggcgtggaggcaatgacttagggtttatagacaggcatcttccctgtcgtcatccctgacatcttccccaagtgggctaccacaggtcctaggtgatgactggttaggccatgaagctgttcagagggacagagagctgcagagtttggggaaatccaccccctgcttccccagaaggagaagatgcatactaatctgttttggagacaatgcagaatactgattagccaaatatttgctggtgatggggatcactgtgtgtattcgttttctattgctgctataacaaattaccatacacttaatggtttagaacaacataaatccattcattatcttatagttctgaaggtcaggaatctgaaaagatctcactgggctaaaatcaagttgctagcaggactgtgtttctttctggaggctctaagggataatcttttttcttgccttttccagcttccaggagctgcctgcattccttggcttgtggccccttcctctattttcaaaatcagtaaagtcccatctatctgaccccttttccatcatcacatctgtctctaaccaactatagctgggaaaggtcttctgctttcaaggacccatgtgattcactgagcatacctggataaccagggtcatctcccatcttaagatccttagccttaatcacatctacaaagtcccttttgccatgtgaagtcacatattcacagattccagggattaggacatggatctcttttgggggaacatttttctgccttctatagtgtgtattaaactttgatgcttatggcatggccccgttttcgtatcttcttccactcagctaaagccttaggtgagcccgggccaccctggcagctgccctggccagctgatgtggtgatccatggagccagctctggttcatgccaataatctcatttatccagcagtctcacttggccttgaacaatttaccgttcccaaatatcagcatgtttttctgtaaaggagtgatggttcccaacaagaagaggttgacacactcaaattcaggtaatttgaggagattagaataaaaggattttaggtcttctgcggttgctagaatatttcattggccagtatctattgtcctcatccgcactgttgctggccatctgcggtcagagattcctcagtccagggcctgaccaaaaggacttgctccacttacattgcaaagcaaacaacagattcttaaacaagaaagatgatgccttctaaagcttggctattccagccaagctcaggggaaagacattttccctaaagtatcaacaagccatttgatctcagacttagaaggtcattcttgtctgcttttttctcccattagatgaaagaaaatgaaatgttttccgtaaaagtaatttatgaagcactccatatggcaatattaaaactgtaaaagtaagcctccaggggacaaaacaaataatgctgtgtcatccgtctgccctggtactgtccctgggtaatgtcaggcacagaacgttggggaactggctccccactcaactggtacttggatgcctttggagcttttccttgaacattgttgctaaggttcatgaaatcttcagatttttgttatggaatccattcgcaaagcaaaatgatcttaagtgtaaatactaaatttactgtaaattgcagacatcactacctccaagacccttttaatatattgagtcccactgaatgctggaatccaagataaagttctttaagaatatagcactcatgtcattcatgtattcattcgttcattgatgcagtcattcaagaaatatttactgagtacctattaggattcagtggtgagcaaaccactctaatgggtgatacaaatgcaaattagagcgatcgttgatatggagaaaagatagagggtttaataagagcttataacaggataagcactgggacaccatggacagattttaggtaggggagttaaatggtcatattttcccttttaagagtatcatataggctgcagtgtgggaaacagatcagagaggcttcagggcctgcccaaccatcctttacgagtgttgtttaacgcaaggtctcgtggtagacagtgttacatggttaaccccatttccattctcctcttgccctgcttccatgtggtatagaggctggaaaagttaaacaccttcttccccacctcctgtgcagctcagtgtagtcatgtgaccctgctctggcctgagacttgagcagtgatctgttgaggtcttctgggaaggaatatgcttttcctgataaaaggaatgagtgcagctgttccccctccccctccttcccacctttcacagagaagggatgactagagctgggcagccatcaggcaaccacaagggaaagaccaagatgttggtgttcatagaatagagcctctgcagcaatgtcagcaccacacacatatggactgcttgttatgtggaaaatatcagcccccatctttggagattggatttttttgttgtggttactttccatgaaaagcattctaaacagatacagtgattcaaacataggcttagccgaaaacaaattaataggcattttgatcattgtcatagttagcgggtggaatccccaaattccacttgtgccattgaaattgcagcctttgaatgggatgataaaagagggttggaaagaagaagggagccgtgatggttttcttccacaggcctgtggtggcattcctcagtgtttcacttccaacctccttggaacccatgcttatcttagcttcagcctccaacacagccttaactgtaagcctagttccctgagtcactctgaaatgtattagtccatgaggaaggagaacagattctgtcttctacctgttttcataactgtagaaatgaacacagtgcatggcacttggtaggtgctcagtgaatgtccactaagccagtacgtacacacaaatacatgcaaaagttgaaaatcgcaatgcattgtgtctttaaaaataaaaaagagaaatagcctgatcttttggaacacatatggggcagagcctgctcaatgaagcatgcacattttggattaagaaatatgattatcatttgtcagctctgatttctgcctctgggctgataagatggtgtccgaggagtcattttcactcctttgcagacaccaaaacagaaggggtctttgctgaaaggtagactctgacgtgacagtcattagtagctagaaacaggcaactgattgcaaagtcaagatgaagtgcttcagtaaaaagaaccttcatgcttgaggcatactctttgcttctttgttgaagttgtggtagatttttttaaaaaacaatcacaatatagtttgctatactttaagtttttaacatctccactggggaaaaattgaaggagctaagtaaattagctcattggatcatgaatttatagaaaaaaaattaatattgccctttgtcgtttctgttaggagtgtcacgggtcaaagcagagacaagaggcatggagaaggagcagtgtgagggcctctccgggtcatttctctgtctggcttctgatgctatctgcccaacacagtttctgaaaacatcagaaactccccagttttgcccaacatgcttcccctaccttgcacctcttagtgcagagacatgttctgtgagaatccacctggtaagacagacaacatggagaggaagatctcagagacctggcttcctttcctgcccttcccttgcagacagagttttactttgtgaagtctccagtttcagaatgagaaacctctgttaagcaaccaggcctatcactgtagggatgagaaaagtgaagtccagataggtgaagcaacttgtcccaggtcaacacagcatgtcagagaagctgaggccagccagtctcctgggttctcccccatgttcttcctactgcccctctgcggcttccatttgtaaagagaggattgcttctcctcactcctctcgcacactcttgaggctatttcagtgaattgtgtctatctttttatatttcccatttaaaagaaaacccactctatggcataatggtttccagtgtcctgctgtttggaagaatgttttacctgcctgtcagtgctgagctttgagctccttgaagaaggacattctcgtggctgtggcccatccaggcagaaccagcctagctggccaagtggtttctctgcatcgtttggctgtcagataagggccacctgcttattgattggcacagtgacgcttaagtccaaacatcctccctaatgacacagaacttcatattaaaggatgtcagggaattgattttgctcttctttaggaacaaaagatgtcagaagttagaaggaactgaacagtcaggaaaacgtaagtctctataccttcccatcaccccatccctgacccacaagccatgatcggccagtggaagataaatctaaccaatcccatgggacaaagggagagagccctgcacagcaagacagcagcagtcattgggcagaaataaatcatgagatggttgagaatctgattctctgggtcaatttctctgcatcctcctctgcccttttaggcctgtgctaaactttccctttgatgcaaatggtattaagtgccttgtgtctgaaaaggttgttggcaggctttggttgagaacataaagatgaatctttgttctcttgtctataaaatggggatataataatctacctcctgtgagaattcaataattttataagataaagctcttagagcagtgcctggcccagagtggatactcaactaatgttaactaagaaaatgaaaatgaaaatccaggaatagtctctgcctgcaaaatgttttgaatgtaaggagggagatgagacgctgtgtatatatgcctctgttctgtatttttaatcaactactaaggccatagagaacaaagagttacccctttttaaggtaaaataaattatactcattgtccagcaaggaagaaatgaattgaaaatcctagaggcagaaaagtgcagagtttggagactaccaggtggcactgagactaaaagctttatttgccatgttcagctcaagatttaatgggttgtatagtgtaaggggctaactccaggatctgctggaactcactctgggatccacagcaaacaaagcactaaccttggcatatggcgctgcgagaagtttcctaggatcagccaggctctgggccactcactgggttcatgcctctgaacattaccttccaggagctgcccccattactgaacctaatacgctactcagaagttttgtaaccaaggttttctaaaagtctgagaaatagaagatgaactttagatttgataaacagggctgtacactggagtcaggtagaggtgagtaggaatcctggccttgccacttactagctgtttgaccttggataaattgcttaacctttctaagcctcaatttcaatgtctttattaaataacttttatgaccgggaaatcaattaaataatttatttaaaatacttagggcagtattgatcatgaaatagatgttctgaaaatacttataatgattttgatcagttcctgagagcccacttgtaattttcattgggtctgtactcttgggacttctccagaaaccatgacaaggaattttagagagtattacccgatattgtagtggactgtgctcaagaatcaaatacaacaatgtcaaaaatttgtctgacacaacaaagaaatggactacctgaaatagtatatatagtccctaagagttttaaaatagatggtggatggtaataaattgaatttctgcgttcttagaaagggtgattcagagataccccaattctaagagtcactgacactgaatgtcaagtattttttgtggcttcagaaatttctgataaatgcattttttcagagtgttgttgtatcataactttgctgtagagcaaaccacttcaaacttagtgatctataaaaataaacatttatggccgggcgtggtggctcacgcctgtaatcccagcactttgggaggccaaggtgggcagatcacaaggtcaggagatcgagaccatcctggctaacatggtgaaaccctgtctctactaaaaatacaaaaaattagccaggcgtggtggcaggcgcctgtagtccccagctactcaggaagctgaggcaggagagtggcatgaacctgggaggtagagcttgcagtgagcctagatcacgccactgcactccagcctgggtgaagagtgagactccgtctcaaaaaatatatataaaataaaaaataaataaacttttattgcttgctcatgagtctataggccagcttaggtttggctgatctagcaatgggttcagtaccatttgctccagatgtctctcatcttccttgaaataacaactattctgaggcgtgttcttctcatggtaagagggcaagagaagggagtaactacagccatgcaggtacatagcaagtccctgttcatatcacattcaataacaccccagtagccaggcaaatcatatggccaaacccgaaagggaaaaggtagacactgctcactatgaggccaaggcaagtattcaggtgtatattaataccatgggggagtcaggaactggggggcaataattccttcttccacacctgtgatgttgcagactgttgctggagtgtagtcttctttctgttagttgaggggattgtttttttgatctagctgtaacccctgatgagtgatgtacctcttagtaaattgtgggcaaacataaggaaaaaggacctctttagtaaatgagccttctaagattcagtcgtgtggtgaaataactaaactgagtggaggacaaagaagtcacagaaccaatccttcaaatccagcccgcagcagcagaggtgtaaacagttactatctaatgtccactccggggtctacctgaattgaattgttggtttccttccaattctcaatgattttctggccattttcatagaaaccatcaatgtaactgatacttctggtttcaaataatatgctagatcaaaagcataaattaccttgaaaatgtgaccatttttctagctctccttggctatcaataaataatactcaaattgctctaaattgttggattgagtttaggagacaaaggccagcagtaactgagatgattaacatgaattgggataaaactccctcttcagttttcatctaacagaatgcaggtcttcagagaatgattgtcttttctagcataatactcatctacctcctgaagggctgggagcttagaattctttctcactctcagtacttcttagagaaacccagaagagtccagtgagaatggtttccctgtttggctgattttctgggaggcagaatggctcaggggttagatgccattctgggatctatggctggattcaaacttggctgcacacctgggtagctgtgtgaccctgcgaaagttgcaaaggttggttaacctctgcagttgtccctgatgttgatcacagatcttcagttcccctttcctcctgtcacccagaggactgagtccctggctcctttgtggttgggtggtgctatgtgaccagttctggccaaggattgtgagcaaacatgctctatgtaacttctggattacactatttaatacccagtgagaaactctccagaattctctcttgtccccctggcacattgaccagcaacatgcaaggtgatgtaactccaatgagtagggttcccttgttgacctacactagacatgtagcatgacagagaaataacctttgtgctaagccactgacatttggggggttatttgctgccataacttaatccaccctaccctgattgatgcacctcactatatctttgtttctttatgtgaaaaaatggagataatagtagaatctatttcatcaagtaattatgaggactaaacaggataatgtgtgtataatacttagaatagtacctagcacataataaatttttaatatattttagctatttatgatgatgatgatgatgttatgccgtgctctaactttgcctctaacaagttatctatttctatcaaacaagttattagtcatgtgtcttcaagaaaatcacttatcatcaagttgcaatcatagtatgttagaataagtgagctgtaagactaatttctagccttatgatgtgagcctctattaagaactcactcagagactccatcctggtgtttcaaagatatttctattggttaggaaaataaaacgtgataatactaaacattattttctccccttcagttgctctcccttccccaaacaaaaagatgtatccttattacagaattctttctgtatcctgttctgaagatttctgctcaggaaattactctggctcgtaaattattaactacaaattggttttccggtttaggcacctacaccctcatcagtccatccccattctctgttctgttttcaccagtaggatgtcaacagtccactatgatcttttttcctgatagcatggtcttaccaaaaggagaagttcctgtccttgaccaccttagtccaggctaaaatagctatccacataccaccactcatgaccactgagacctgttttccaacttcttcagatcagagctttccatatctggtttttctctcatgttactctagatgtatccttctctagtcccaaaggtagccctgtctgcaattcccaatagcagcatgttaatctatgttaacatattatattgaaccataagaaattgcctttgtggaaggggtgggggttgaatatagaaatttcatatggttcaacctatatgtaaacccaatttggaaaagaaggagactgtgatcacatacctattaaattacatgttggatcccatcaagaatcctaatgtatttcttcctccataccttgttgaactgggatcttgttccaggacatgacttatgctctgtatataaccttcagacctccctatacccagcacttggtagatagcagatactgatgctgtatttattgaccaactagatgggagctttttgtgatatctattgttgacatccatgtttatacatttgggctgtttaaaaaggtaccatttataattacattatgggagaaaataacacttcttttctttaacctctttcagattgaagacatcattacaaagatgcaagatgacaagacagggggtgtgcccatcagaacagtcaagagctttctctccaaaatccccagtgtcgtcacaggtaacaccctccttgcaaggtgttggtaacagtcagaactaccaaagagttataagtctagattgcggcctgaggggtgtctgaagatctgtgaatagtaaaaatgaaacattcagtgtgtttcttgactcaggtcccatcctagtcttagtttccaggaagaagctacttgttgcccatcattaagaatgaccttaccatgaccagcccttcaagtgcatgtagattgaggctgctgggaataaataaacccattaataaagtggcgcatcagcaactttgcctgtgggatacacacaagcacagaaatattaaagaaattaaacaggtttttaagaaagtgttatattcaaattctacaaaatgcttttattttcagttttttaactcagtgtacttgacctcctgaaagagaggttttaaactatttttcttcattccttatattgtgctttgtgtgctcatctttcttttaaaatattttattgtgaaatatattaaaacacatgggtagttcaaaaataataaaacacagtacatgtacctaccatcctgccttataaagaacattattatcaatatcttagagcccccttgggtacctactgtattgcatccacttccctaaacactatctgcttgtatactaatcaattcattgtttttcttcatagttttactacctaggtatgtatcttttgctatccaaacaagtaaccaaataaattaagataaaattttagatgattctcttaatctgcctatatgcttttcaaaattcgggaaccaaaggacttagttttcactatataccttttagaatggctaaaaataaaaatattgacagtaccaagtggtggtgagcatgtgaagcaactggaactctcacatattggtgatacgaatggaaaattgtgcagctactttgggaactagtttggcagtttcttacacagttaagcaatgcttaccatatgaaccagcaatcccactcctgggtattcacccaagagcaatgaaaacttgtgtttatacaaaaacttgtatgtaagggtttatagcaacttttattgaagtatactgaagaatatagcaactttattcatcatctccaaagactggaaacaacccaaatgtccttcagtgaacgggtaaatggataaacaaactgtagtctctccacaatcagcaacaaaaaccagggaactattgatactggtagcaacttggattaatctctaggtcatttttctgagtgaaagaagcagtctcaaaggttacatgctatgtgatttcaggtatacagcattgtatacatcacaaaaccgtagtgataaagattagatcagtggtttccagcaactggcatttgcagggcgagtgtgactgcaaaagacaacaggagggagttttatgagatgatgatgatgaacagatgaacagttctgtatactgattatggtgatggtaacatgactctatacataggccaaaattcatggaacaggccaggcatgatggctcatgcctgtaatcccagcactttaggaggctgaggtagggggatcacctgaggtcagggggttgagaccaccttggccaacatggcaaaaccccatctttactaaaaaatacaaaaattagccgggcgtagtggtgcgtgcctgtagtcccagctacttgggagactgaggcaggagaatcacttgaacctgggaggtagaggttgcagtgagctgagatcgtgccactgcactccagcctgggtaacagagcgagactctgtctcagcaacaacaacaacaacaacagaattcatggaacagcacacacacacacgcacacacagggtcaatattactgtatattaacctaaaaaataagtagacccagttgaagtaagtatcccagctcattattgagactgtcactctttgaactcaggtactgtcttactcagctcaggctgctagaacaaagcaccctacactgggtggcttataaagaacagaaattcatgtctcacagttctggaggctggaagtctgagatcaggtaccatcataggttctggtaagagcccattccaggttgtagactgctgacttcttcttgtatccttgtttggtggaaagaaagctagatagggggccgggtgccgtgactcatgcctataatcccagcactttgggaggctgaggtgggtggatcacctgaggtcaggagtttgagagcagcctggccaacatggcaaaaccctgtctctactaaaaatacaaaaaaaaaaaaaaaatagctgggtgtggtggcacgtgcttgtagtcccagctacttgggaggctgaggcaggaaaatcacttgaactgtggaggttgcagtgagcagaggtcacgccactgcactccagcatgggcaacagagtgagactccatctcaaaaaaaaaagtaagctaaatagctctctggcctctctgtaaagggtaataattccatttgtgaggggccctccttcataaactcccccaaaggactcctaatgccatcatgttggggattagatttcaatatatgaatttggaggagacacgttcagtccaaaatagagcccagatagatttgggtaatgaaggatacttgtattgttagtgttctctaattttaaaatttatgtaaatgaaattttactatatatattattcatgtataatatacagtataatatagactatgtatgtaattttactatattatttttcacattcctggattttgttcaataatgtttaagatgtttgtatctatttcacaggccacactgatctgttgtttttcttaccattgttgctggtttgggtatcaaatttatgctagcctcataaatgagccatgaagtatctctcttttcttgatatcctgcttttctttgaaaaataattgtccctttaatccaggttttaagtatgtaatttcaattattttttatttttaaaatttcctctggttctttttttttttttagacagagtcttgctcttgtcacccaggctggagtgcagtggcatgatctcagctcactgaaacccccacctcctgggttcaagcgattctcctgtctcagcctcctgagtagctgggattacaggcatccgccaccacacctggctaattttttgtatttttagtagagacagggtttcaccatgttgcccaggctggtctcgaactcttgaccttaggtgatccgcccaccttggcctcccaaagtactctggttctttttacaatatacttggtcattcatttttttaaatttattcatttagatatttattgagtgttcactattttctaagcattgttaaggacttgagattcagaagtaaatgaaacagataaaaagttctaccctcatggaatttatattctagtagaggaggaaataagtaaggaaaacttgcagaattttagattgtgataaaggccaaggagaaaaataaaatacacaaaaggatgggaagtgttggagtgttgcagctttggaataggtgctcaagaaagagctcctcgagaagatgacatttgagtaaagacggaaaggagatgagggattgaatcatatggatattgagggagagagcatgccagacagccagagctcagtgcccaaggcaagagagttcctggaacattgaggatctgtgaggaggagccagggcagctataatagagtcaagaaaataaggagagtggggatgaagccacgtgagaatggtgagcttgatcacttagcctcttatcactgcaggattttgcacatggcctgacatgctctgacttacctttcaatgagatcactctattatattcagaattccctgggggattgaggggttaggtgccagataggaggctattattaaaatggtgcctcagactaggtgatatggtttcactctgtgtccctacccaaatcgcatctcaaattataatccccacatggcaagggagggacctggtggtaggtgattagctcatggggaaggttctcccgtgctgttctcataatagcgagtgagttctcacaagatctgatggtttaaaagtgtggcacttccccctgctctctctctctcctgccgctatgtaagacatgccttttttcccctttaccttctgccaggattgtaagtttcctgaggcctccgcagccatgtaattaactgtgagtcaattaagcttctttcctttataaattacccagtctcagatcattctttataacagtgtgaaaatggactaatacactaagctatcagcactggagatgtgtgaagtagtcagattcggattcaagtctgaaggtagatgatatggtttggccaagtccccacccaaatctcatcttgaattgtataatagttcccataattcccacatatcatggaagggacctggtgggaggtaattgaatcatgggggcagttacctctatgctgttctcatgatggtgagtgagttctaatgagatctgatgatttcataaggggcttttccctgtctttgctctgcacttctccttgctgcttccatgtgaagacaatgtatttgcttcactttctgccatgattgtaagtttcctcagccgtgctgaactgtgagtcaattaaacatatgtcctttataaattacccaatcttgggtatgtctttattagcagcatgagaatggactaataccgtaaattgttactaggtagtggggcactgctgtaaagatacttgaaaatgtggaagcagccaggcgcggtggctcatgcctgtaatcccagcactttgggaggccatggcaggtggatcatttgaggtcgggagttcaagaccagcctggccaacatggtgaagccctgtctctactaaaagtacaaaaattagctcagtggtagtggcacgcacctgtaatcccagctacttgggaggctgaggcaggagaatcacttgagcccaggcagcagaggttgtggtgagctgagatcacaccactgcattccagtctgtgagaccctgtctcagaaaaaaaaaaaaaatagaaaatatggaagtgactttggaacatgggtgacaggcagaggaaggaacagtttgaagggctcagaagaagacaagaatatgggggaaagtttggaacttcctagagacttggagggcttagaagacaggaagatgtgggaaagtttagaacttcctagagacctgttgaatgactttgaccaaaatactgatagtgatatggacaataaagtccaggctgaggtagtctcagatggagatgagaaacttgttaggaactggagcaaagataaccctcgttatgctgtagcaaagtcaggtggcattttggccctgccctagagatttgtgaaactttgaacttgagagagatgatttaggatatctggcagaaaaacatttctaagtgcagagtgttcaagaggtgacatttgacatctctggacacaagagagcataaaagtttggaaaatttgcagcctgacgaaccagtagaaaagaaaaacacattttctggggagaaattcaagctggctgcagaaatttgcataagtaaggaggaaccaaatgttaattgccaagacagtggggaaaatgtctccagggcatgtcacagaccttcaaggcagcacctcccaccacaggcccagagacctaagaggaaaaaatgtttatttttcctcttaggtccagggccccactgctgtgtgcagcctagggacttaatgccctgtgtcccagctgctccagctatagttaaaaggggtcaaggtacagctcgggccatggcttcagagggtgcaagcctccagccttggcagcttccacatggtgtttgtcttctgggtgtgcagaagacaagaactgaggtttgggaacctccatcttgatttcaaaggatatatagaaacacctggatgtccaggcagaggtgtgctgcaggggcagagccctcatggagagcctctgctagaacagtgcagaagggaaatgtggggttggagtccccacacagagtccccactggggcactgcctagaggagctgtaagaagagggccactgtcctccagactccagaatggtaggtccacccccagcttgcactgtgcaactggaaaagctgcagacactaaacaccagctgtgcaagcagccaggaaggaggctgtaccctgcaaagctaccgggtcagagctgcccaagatagtgggagcccacctcttgcatcagcataacatgggtgtgagacatgaagtaaaaggagattatttcataactttaagatttaattagttacctattggatttcagacttgcatggggcctgtagcccctttgttttggtgaatttctcccatttagaacaggtatatttacccagtgcctgtacccacattgcatttaggaagtaactagcttgcttttgattttacaggctcataggtggaagggacttgcttagtctcagatgagattttggacttggacttttgggttaatgctggaatgaattaagattttgggggactgttgggaaggcatcattgtgttttgaaatgtgaggatatgagatttgggaggggctggggtagaatgatatggtttggacatgtccccacccaaatctcatcttgatttgtaattcccatagtccccatgagtcttgggaaggatgcagtgggaggtaattgaatcatgggttggttacctccatgctttcctcatgatagtgagtgagttctcatgagatctgatagttttataacgggcttttcctctacctcactcttcacatctccttgctgctgccatgtgaagaaggatgtgtttgctttcctttctgccatgattgtaagtttactgaggcctttccagccatgctgtactgtctgtcaattaaacctcttttctttatttcccagtttcatgtatgtctttattagcagcatgagaaccgactaatagagtagaacagatattattagcggatagatcagatatggaatgtgagaggaaaaaaaggaattagccatgatccacactttttggcttcagcaactggaaaaatggagttgctattaatttcaatgaggaatactataataggggtgccaggggttggggtggggggcagttgttagctgaagggtaagaaatcaaaacacaaattttaggtcaagttttagcgacctattagacattcagttggagatgacaagtaagtattccagtatgtggatttggattttaagggagtgtctgtgctgggttcataagccatcagcatgtagacagtatttagagccataggaataatgaggtcaccaagggagtgagtgtagatagaacacacagtccaattcctaaaacacagggtactccaatctatagatgtgagggagagaataagaaaacagcaaaagaaatagaacaagtggctggagacaaggaggaaaaatcaagaggatataatttcttggacaccaatttttctagaaagtgttttaaggaagagtagagtgacctactatagctatgctgagaagctaagggctgagaattgatcattgcctttagcaatgctgaattcattgctgaccttggtaagtgcacattctgtgaaacattgggagcaaaaatccttattgggtgtgtccaacctgagatgaggagagtgattcgaggtgctaagacagttaatcttggaaggagtttcccttgtaaaatgaagaaatgcagtcatatctagaggggtacgttaggtcagaacaggtagatttttaatttaataaaaagataatatgtttgtattatagaaatgactcagtgggggtgggggagatgatgtaggagaatgggaaaacttcaaggagttatatcaaagaataggtaagagaggattgaatttaacatgcatattggtgagtagtttcagctagaaacacatacaatttattcatagaaagaagaaaggaggcagccgggcacagtggctcaggcctctaatcccagcactttgggaggctgaggtaggcagatcacaaggtcaggaaatcaagaccatcctggctaacacggtgaaaccccgtctctactaaaaatacaaaaaaattagctgggtgtggtggcgggcacctgtagtcccagctactcgggaggctgaggcaggagaatggcatgaacccaggaggcagagcttgcagtgagccaagatcacgccactgcactccagcctgggtgacagagtgagactctgtctcaaacaaacaaacaaaacaaaacaaaaaaggaagaaaggaggcataatagatgcacagaggtacaaataagtgggcagatgtgatgggaggtggtggaagcttatagatcttctcattgtctctatgttcctagtaatctggaaaccaaaaatggtagagattttgcaagttcaaggagagatcataagttataaattagtcaactaggaaagtagagattgactggactagggaaatagaactttgattgtgactgatatggtttggctctgtgtccccactctgatttcatctcaaattgtaatccccataatccgcacatgtcgagggagatacctggtaagaggtgattggatcgtgggggtggtttcctccatgctattctcatgatagtgagcaagctctcacgaggtctgatggtttttataagtgtttgacagtttcttcttcacagactctcttgcctgctgccatttaagacatgcgtgcttcccttttcgccatgattgtaagtttcctgaggtctccctagccatacggaactgtgattcaatcaaacctctttttttttttttttttttcataaattacccagtcttgggtatatccttatagcagtgtgagaatgtactaatacagtgaccttcttaggatgattaatatttttgaatttaaagacaggtaatttttttccccatccacatttagctctgtggatttgggcatgcctcaggtagaaagtggacttaattgatgttatagcaagtttgaggttataatagatcaagacagaggcacagtaactaaaatgattgcccattacatttaattgagtaaggatgaaaacaagaacatgagatggatgaggaaccatgaagagtagtaattaccacaaattgtaagtcaagtggcaaagaaattttggagttttcagaggcaagagtaagagagctgaaaatatagtagatggtgattagatggtggcatgtttgaaattgagattctggaaagattgtgattattggcagggacaataatataagatataaccataggaacaaggcattgaaatgggataaagtgtaagatttttggaggagaggaggttaaggaactgagaggccatgatactggaagactgagctgtgtgaatattgaaatcactactgggggagtgttagagaaggtggttgtgagttaaaatctttatggaatgagaagcaaaggaccagggatcagcagatgactttcacaataagaggtacaggtggtttaatcagatggtatgggagtcaaagctgagtgtgttttagagaagagggaggggatgaaggtgatctgaaagcagcagttagtagcaggacagtcacttatctacctgtaaaccccatggtatataaagtgtgggagggaaaatagccaccacgtaagagggctgcagggaagcaggaccactggggaagaatgagaagatgaaaggaatattaactgattttatttatgattcatcatgagtccaagagggcaagtggaagggtttcaggaggagatggtgagtttatgacttgagtaataaatgcctgctgttgctatgtgccaggctctagagtagtcacagacgatataaagatgaacaaagacttgacccctgctcttaaaaagctattaatctagtgagagaaacagacacaggtagatcaatgatttatatgagctatgtgccataatagaagaatggacaaaatgctgtttgagtccaggagagagaatcatgaatttttattgggtatgtctagaatatttctctgagaaggtatatcagttatctatttctgtataacaaacccacaaactataattgcttacaactacagtgatttattgtttcttatgattatgattccatgaaccggcaatctgggcagttctgctggtctcagccatgaggccatagtcatctgatggctcaactgaggctggagggtctacagtggcctcactcatttgtttggccttggtgcttactcttaaactcttaactggggtctcagttcttctccatgtcaccttgtatctgccaataggttagattgggcttcttcacagcctcttggtcttagggttccaagcaggacaggataaaaactgcaagacctcttagggcctaggctccagaactcatacaatgtcaagtgtgccacgtcacgttcttcaaggcaaattacaaggcaaagtctggattgaagaggatggagaaaccaactccacctcctggtgtaggagtggcaacatcatgttgacattgggagacacgattcattggagggcattaccataacaatctaccacagacaataattgagaaccggaccttaaacataagtggaaacccaggaaaagtcattccacgtagagaaaatagaattttcatagcctcaaatacatgacaaacatgccaggtttcagtaagtataagcttgtttgtgtggttggagtttaaaacacatttatgtgtgtatgtatttgagaagaggagcatattggcagaacagccacaggaatgaaaaggatacaagaattacacctaataatatattataaaggaaagctgacttgtagactttgttccaaaggtggggctgcttttatctcaaaggtaacccatctaccctgctcagatggactgccgtcagaggttttaaatatgagggaattcacatccatgaagtggatggaagtttaagcaggaagaaatgaggagtgtggagactagttatggagtctagatgagggaatgtatgtgagaaataaggccatattaacgacaaccacagcatcaactgaaaccatggctgtacagccacgcatcattaaatacttataaaaaccccatgagatagaaaccgttattatctctaccaagtaatggaggaaactgctaattcaagagtaacttttccaaggtcacaccactagtaaatagcaggatctgttcctctgggccacccgtgtaaggatggtagcagtagggttcaaaagatcagaggaaacagtagaaggtatgattgacacaacctgctgacttgaaatagagcagagggtaactcatccaaaatggatacaccttaatatcatggattgaatacattcatttaactttttctcttctgaaaccccacaaaaattatagtaaaagatttttattttaaaagcatgatctaaaagttggaggcctctattacagtgatctaccatgggaaataaacatccttaaaaatcttgaaaagatagtccagtacaaagggcagtcagtgcctcactctcaagatgtgcagatgtgtgaaagactcatggagaatagtcttccaacacaggagacaatagccacaaaactcaagaatctgaaaaacaaatggatgagtggtaactgacaatagccctgaaacaatctaaccatcacttgtcagtggacaaggctaaaaaaaaaaaaaaaaaaaaaaaaaaactctatatttatatgatggagttctcaatgggctcagaaactggtaacatcagcagacttttctatctagttagaatacattttgccaacactctcacctacttaactactgcacagaccaatcactagctagtgtctattgtttagcaatatcagatcctgcacttggccagcacagctcaggctggtgttgaggtggttcctaagaccagtcaagccccaggacagaagacaaatctcatgcttacctctagttgctggcactagagtagagaattacatagagaaaaaacccaggtcactgagacccatgggtaccaaacttaaagttgaaacgcattaatacatggccaccctgttactgtggcaagagaagctgtatctacatgggacagtaatcagcccacacttcagcctttccaccagctcagcagcctccatcagactttctagccatttgagaaatagccagtttcccatcacaaaccagcagataccagcagatactccaacattggagcttccatttcaacagcaacagctgggggaataactttttctcttctctattgggaccccagttctttaataaaaattgaaagtaaagatgaaagaataatggacattataaggctggttaatcagcagtgtctttatttcttgcactgctacataacgtactgtccatacctacatgtgactttgctaaataaacagcaagtgatttcaatggaagaaggcaagaagatggagaccaatggcacgatgatgacagtctgctggtgaaagcttctttccaaagatgatattgatgaggaatgcatgagcatgtcccagtgcatccaagactctgtcactctcagaagctctgggaagctgcttgtcaccactttctcagcaacacagtgaaagtcagagaataatgttgataaaaagtagtatcttgctgcaaggcccgtctctacactgtcaagttaccacattgagttgaaaattttgccaacatatccagatcatcccaaaggcgaaaagagaagcaactgttaatgacctacaccaaataaatcaacaaacacatagcaatatgcggatgtgtacctttgtagtggatcaaatgagcctggacaagaaactctaaatggaaagttttagagcataaagagaacattctagaaaaagaatgtacttgccaaaaaagtcaaaactgagataaaggaaaaattgtagacctggggaatgtgaatttggaaaaataatttatgggtactgaggatagagataacaggggaggtatagctataagcagagcagaaaattgatatccagttttccagaattcacaggtgacatagaagggaaccattgtaccaagtgatacacaaagatcagagttgaagagatgtgatttcgtccacgagtccctttaaagctggctttgtggtgtgtttgtttacaaccttcctaaggtgtcgatgtctaccagttggaacagtgacacaagagatggtaggcatttcttgactttccatctcacaaattaaatttgtttggtgaattcctgaaggatccatacagagcctggactgaaagcacctgtttcgatcttatgtgctgaaagcaaaaccttttctcatcaaatgtttctcttctttgtctttctggctttcatatgtgtgatctaacttcattggttacatctttattaataataaatatctaataaaaatgttaataaatttaaataaatacattgaataaaaataacctatattcatctaacctgttttgggtaaaggaggttcctatacccaagataaggacttgaggaagttatgggtttgggagagaagacacaagatcagtcttgattatgctaagcttgaggttttgaagggttatttgggtagcactgtttaggagaaacttggaagtgaggagccaaagtcctggagaacattttatgtaagagatatgtatggatttgggagtcatcagagtctgagtgacccgggactccagggtcatgactgggaactataattttcacatcttcttctataagccatgtattagtctatctgctacccagccttgagataacatgctcacccaccccacatcttctatgattttgagtttgaaattttcccaccaatatgtaagggaaattatcttccctgctcagatcaggacaaactcataggtgaattcacaggtattgctgggatgaagagggagaaggaatgcctgttggttcacctgtgggttcgaaatgttgggattgggaaggttggcccagggagtaaatgcactgagttaggggatagatatgtttgggagaaggccaaacacaagagataaccattagaatataatctctgtcttagaaagtgaaaaattaagagctgtaaggggtgaggtttagcaaataaatatttctgagcaaaaatagagaattggagagagaaggaaatacggaagaaagaagaacccaacatcagatcaaagtccaaggctcattggctttttgcaggggaagtcacatacaaaccatctcatcttccagaagcttaagatttctgagcaaggtgcccacagaaagggtacttcagagccaccctaccaatcccttttcaggactacagaccaacctcctcagaccctctttgaatagtaagtaggtaacaaagatgatcactggagccaagatggtgagtcttcggagtttccaacctcagcgtgccagctctatccacgccccacctgccctgcaggtgatagacatatcctgggcagaatgcctgccagccccaggaaagcagccagattgtgcagctttgcccagctgtcatagacagtcattccaggataattctccatcacctgaatgtcatgaagaattttccagggactttggagatttatttcttccagaccaccctcagaaacacaaattcctagcatgtaagagccataagatgcatctagtctcacttattcttgcagtcaggaagattgagtaccagagacatgatgtaatgtcctcaaaaatcacagttaaggacagaaccaagactggaatctggattcctcactaccattgcaaactgttcccatgatctcatgcacaaaattatagactcttggattgcagcagtttcttaaaggtgtttgatgcgttctccctgaacatgagaatcacttgtgtaacttgttaaaaatagatttccaggacatccccatgggtctggactcgggatcctctattttcagcagcttctcatatttatctcctacagcctgtatgaatttgggaatgtgtaagacccctacagagtgctctctagcctctgttttaacaatctgcaatgatggatgtcatctctccttccatctttggacaactttgaccttgagaaacttttttttttgtaataaacctaccagcctcctcttgcttcactgcattagtcccaattctacctctgtatcacaaagaatagaggaatggatttgattaaaattatgcccacctagctcttccttatgaaattttcttgcacaaataattttcagaaaatatccaaggtatatacatgcatttttattttacttaacacatttttttatgaatacatttctgtcttttcattatccacaaatttatttttaatagctttatgtttacctaaacatttaaaagtattattcttacagtttcttggcaatacagtttggagtctaggctccaaacagcctatgtgacctgggttggtcactgtgtgaccttgagctagtcaccaacctctttgggcctcagttttctcacctgttaattgataggtttggattaaatgatatttgtagtccattctgactctgatcttctgagattcttcacaggatatgtataaaggcctgtctgaagttaattcttttcactttttctcacgatgttctaactgaatctacctctgagttaatttaggccaccagttttgtcttaagatgtgtgtctcagtctgtcttctgctgttgtaacagaatgccacagactgggcaaagaagagagaaatgtatttctcacagttttagggtctgggaagtccaaaagcatggtgccagcatctaatgagggatatcccatggcagtaggcagaaaatggaaggtgcatgtgtgtgaactggggatggggggtgcaaactcagcctttttattgggaacccactccttggatagctaacccactcctaggataactgcattaattcattctgtagttaatgcttctcactttttctcaagatgttctaactgaatctacctcatggaaccctcatgatctagtcattcattaatgatcccatctcttaatattgttactgtggtaattaaatttcaagatgagttttggaggggacatccaaaccattgcactgtggtacttccagattagaaaaccaaagaacaagaaacagcctctgttttaataacgtgcgatgatggatggcatcatcactcattccatctttggacaactttgacctttagaaactttttttataatgaacttccctgcctccctcttgcttcaattcattcatcccaattctatctctttctcacaaatagagaaatagatttcccaaattagtaattccctgagaattgcccaaagttaatcagtattcttagtctttgttactcttcttctgcttctgtatcactggaaggaagaactttaaaaatgcctcaaaatagagataatttgttggatgcatgtagagggctgaataatggccccccaaaatatcagcttctagttctttacatctgtaaacatttgttgataaagggtctttgaaggtatggttacattaagtatcttcatatgggtaggttattctagatcagggtgtctaatcttttgacttccctgggccacactggaagaagaattctcttgggccacacataaaatgcactaacactaacgatagctgatgaactagaaaaaaaaatcacacacacacacaaaaatctcataatgttttaagaaaattgactaatttgtgttaggctacattcaaagccatcctgagccacatgtggcccatgggccatgggttggacaagcttgtcctagattatctgggtgtgccctaaatacaatgacatgtatccttacaaatgagagtctgaggaaaatttagtatagaaagaagaggagaaggccatatggcctcagaggcagagattagaatgatgtggccagaagccaaggatgccagcagccaccagaagattccttagcacctccagagcaagtatggccctgccatcaccttgattgtggcctggtgaaaccaactgtggacttctggcctccagaactgtgagataataaatttctcttgttttaagccacaaagtttgtggtgatttgttgcagcagccatagaaaactaatacagtgccaaaattacactaagcacattatagtttaaagtagatgacacaatgattttttttagaaaaattgtgattcattaactgaaaaaagaaacaagcaaaaatttagttttcttccaaagttttatttgaaaaaatatagattataatattaattttgaaagcaaattatactaacatgaacttatgtagtagaattatttaataagcattcagcttaaattgcttaataaagttataaattgtatttgtccaggtctaatgtagtttaaaatatcttttggatatcataactaatcatattatttccacgttcgtgatggaattaaatcaattagttataaaataaaatttattcttaattagtatgccaaaatttatacatacataaaataatctcttaaaatattcacttcgaaaagtggtatatttatttcagtaatgcttccattgctttgattttttcagatttttttctccagtaagagcttttagaacttgtttaaatatcctcaacagaagcaaagccatgaattcataaccatatatacatttatataatcaaaattgatttggagattctgctttggagaatggtagactagcctactcagaccaactgtctgaatgagaacaattacaaaatctggtaaaaaaaaaaaaaattcacttgatgtcactggagagttaacaagagaataaagagttactgggccaagattcatgctaacataaacatccatagatatgatggtggccttgggtgctgtttttgccctggggacatttggtaatccaagagagcacctgtcagacgatgcctttattaaggcccatggacattatctcctatgccataggggttgtggatttgctagtttaaagaaaacacatgcaaagatgagagcttatttacctgactctggtattgactattaggttttaccatggtcagcagctgtgggctgtgtcaggtttgggtcagggagatgaggaacaaggaggctacatcttaaccgcacggggaggggacgttttaacaaggccaaaggtgatgaggtacatcagggtaaacatgtgttaggcctaaaaatggatgtcaaggcagcaactatattaaacaaatttatgatgggcagtgattactgtttacctctaaggggcagggagtatattgtgattgggacagtacctgcaagagactaccagagtgttgaaaaaaaaattttttaacatcaatcatggtaacatgattaaaataatgtaaactgttcccacagtatttcttcttagcacttttctgtttgtataatatttcacaataaaaatagctttccttttcctttttccttttgttttacaaaaagtaatttgaagtcagttcggtgaataaagtctgtaattaaagagggaaatgccaattgtggtttaaataaggtgtgactctgggtaaatgaagtcagttttcttgttgtccttaaaagctgtttcataagtttatttccaaagagcatttccaaaaacatttgtagcacagccaatactgatggaaggaagggtgtggcttttttagggccaactctgaaaatgacagtgcttaattaaatattgattatgctgtggttgccttaacaaatgtaacttcactgtaacatgttttatttaaatgtatgaatttttcttcttatgggattcactttagtaacaacctcttaaaatcctgtcaacttataactgtgaaagcaaaggcatatctctgatgctcctggcctttgtgtcattaaaatcttactctaaatgtcgcattaattcatcttttcaacatttttccttgtttgatttttttctcctggaagaaaaaatgctaagtggaatgaaggaaggaaaagacaggcagtttattaaaagtcaaaatataccatacaaacccctaattgtactctaaaatttctttttaaacgtttctattaaaaaattctgggccgggcatggtggctcatgcctataatcgcagcacttttggaggccaaggcgggcggatcacctgaggttgggagttcgagaccagcctgactaacatggagaaaccccgtctctactaaagatacaaaattagccagtcatggtggcgcatgcctgtaatcctagctgctcaggaggctgaagcaggagaattgcttgaacctgggaggcagaggttgcagtgagccgagatcgcaccattgcactccagcctgggcaacaagagtgaaactccatctcaaaagaaattaattaaataaaacattctgtttccaataagataaaatttgagaagagaatgaaatccagatttagtgtagctgacccgggatcactgactcttttttagagaaggaactgggaaactgcagtggacatcatgctctggagcaacagtgactatggatttcactgtatcatcggtcgcagcatggaattctatacactaaaatcgctggatgagatgctggtgggaagaccctaacaaaatcgtgtttctgacagaaagtgtatacacattatgagcaaggagaacattagttttcagcttagctccttgtgcagttgaatttgttactctgttctgaagacattggtgccagataaaagctttaaacacaaaacgttgttactgacatgttaatataattatgccacgtattatatatacaaaactttaaaagctaaatttagaagttattgctgtatcatttatataggctttgttctccttaaacacgttgactttaataaggcatgttttgtacaaataaagtctaattctaccatcagttgcagccacaggaaatttgaagtcatttttatataaaatttaaattccaacacttaattcaggttctatgacaccattttctagatccaagaaggaaatcattggctcaggattttctacagcgatctatcctgtatgttcctcagataatatgcccctagaatattattttttataagaattaatggcagaaacatttgagcttatcactgatggcatttgttgactatcaaaattgtctaaaacctcccacatttatccaggtataaaagtaaacttctaggttgggtgtagggtaggttgggagtcaaaagaggacactctatagagtcacagttcataggttttcctaaagaacactttctaaatctaaatttttcctcccactaagccaaatgaggagggctccagggaaatcactggtgatgattaggggtcctacaagaagcagggtgttaaccttctcactgattggattcttgctgagctgttgaacccatagctcatccttgcttctgctgccagagaggaaaatatggaaaagttcatgggccatttgccagagtttgtggatgtatatgaactgagactcttgaggctaagaggctgcatggggcagcccacaccaaaaggcaaatagggcccatattgtagtgtgatgcttaaggagaaatatatggaacactgacctccccacccccaggatccctgtgactcttggagggtcaagggagcatcatcatggagacagaagacagagaaagagaggaaaagaggaagccgagcccacccttttcctgtctaggtcctctagacaaagctgtgaagggaaaaaaaatagaagataaaatgggatttaaattttaaactggactaaattgcaagtgaccagaaagctaaagggtctgctcaagatgtcataagggaaaagtaaaattatttcccattggtacctcatcgagttcatattgttcaagaaactggatataatacctagtgacaaagagactaggacttctgttttgttcttgtcatacagccaaatattgttctggtcacacagccataacaatacccattggggcagaacactgaactggtaagaaagtaagggaaatttttagaggccttaaaatagaaagtgagaattcaggaaagtagactcgttttagattagtcttttctcagaggacatctgtccatcctgggtagtctagggcatgaattttaaaagcctatatgagtatcaagtaaaaaaattgagtagggtggcagtcagttcagagactcctgaagagcaatacgattattagatgagtagggggagaaggctttagagaaggagatgatggaaataatcgttttgtctttggctattaataggtgaaagacaggagaaaaagtctccctagaaaattcctaattccaaattctaagtctattcttgttggcgtgtctcactaaaccccatgtggcccaaaaattcaagcaaaaatttaaattgtctttttttttcccccactcagtaaagatttaatgatgaaaaaatgcaagttttataatacaaatatataaaattatgaaaacaatttttataacaatcatttgatagtctttttttaaaagactacagaaagtttaaaatataattttgtaattatagatataaacaatgaagttttataaaattaatcatttgatatttttaaaaaggctatccaaaggaatttaaaatcagaatgttgttgaaactgaacaccaactgtatctacatttatttctttttttaaaatactttaagttctagggtacatgtgcacaacatgcaggtttgttacatatgtatacatgtgccatgttggtgtgctgcacccattaactcgtcatttatattaggtatttctcctaatgctatccctcccccctccccccaccccacgacaggccgtggtgtgggatgttccccttcctgtgtccatgtgttctcattgttcaattcctacctatgagtgagaacatgtggtgtttggttttctgtccctgcaatagtttgctgagaatgatggtttccagcttcatccatgtccctacaaaggacggcattattcacaatagcaaagagttggagccaaccctaatgtccatcaatgatagactggattaagaaaatgtggcacatatacaccatggaatactatgcagccataaaaaatttaaactttctctatttcagtactgcccccagctaccaggaagaagcaaacacatctcctctctggagaagcacacattaaatacagaacaaaaaaatttccagataaaaacaaaagtcactggaaacataagaaaacaaaacaacataaggataagtcagcaaagagcacaaatggcagaatccaacacataaagattgcagacattgtaattatattcagattatagaataattattagatcatacgaaattgccatttttataggtcaaagctggtaactatctgcagttccatatgcttaacataatgtttttaaagaaataagagagtactggaagtatgttgaagaaaagaggattaaggattctcaaaaaggactagaagctttgataagtagccaaatggaatctctgcaaatgaaaaatataattgaaattagagacttaatagaaacattaaacagcagatttgacacagctaaacaaagagttgataaactagaagataaagcagataaaagtactcagaatgtatcacggaaaggcagaaacaaataatatgaaagagaggttaaaagacttgaagaagagagtgataaattctaacatctaaccaaattttgagaagtaaataacagagaaaatgggaagagcaattcttccccattgtctttattatttccttccaaatttaaagatctaatagttgacagtttttctgagtggattaaaagcatcgggttccaaaagccaaaaaaattccaagcaggataaaatgaaaacaaatctatatctagctacattgatgtcaaatttcagaacactaaacacaaaaagaatcttcaaaatgactagagagggccagctgaggagacttcacctgtgttccaagcctgagaaacagcaccatgggccacccctggcagacacgtccctaggctggctgagcagctgtgcacccatgtcctgggcctgagaaagagccccacagactgctcctggcaagcatgcccccaggccagctgagaaaccatgtgcccctagacagagtaacagccctgtggtcccaaccccagtgagccagaccccaagaaagctgacccactgtgtgcagacatatgcctccaatctgagcaacagctcagcaagcccacctctggaaaagttgcaccgctaccagcacaaactgtctaagcctaggccactgagacattcataaatatcgctagtatggattacagcttaagaaactactggagactatactactgtgtctacccagaagcaaagccaatgcactgcattgagcccacaccccaacacccacataaatgaataaatcttttcctattaaacctactccataaaattggaagaggtgactgtttcatcagatgtgtagaaatcaatgtagggacacaataaacatgaaaaagcaaggaaacagacctccaaaggaacacaataattccctagtaataaaccccaatcataaggaaataaatgaaatgacagaaaaagaattcaaaataataattctaaacaaattcagtgaaatataagaaaatatattcaatgaaatcatgaaaacaataagtcattattttaatgagaaattcaacagagatagatatcatttaaaatgaaccaaattctatggctgaagaactcaatgagtgaaataaaaaatacaattgagaacttcaacaccagactagaccaagcagaatttgttcttacttgaagacaggtattttgaaataatacaggcaaacaaatagatgaaattaaataaataataaaaaggaattaagtcaaaggatttatgggatatcattaagtgaacaaatatttgcattgtggacattctggaagaagagaagggaaaaggtgcagaaaacatatttaatgaaataatacgtgaaaactttccaagtcttgggagaaagatccaggaagctcaaagaaccccaaatagatataatccccacaggtcctctctgaggcacattttagtcaaattgtcaaaagtcaaagacaaacagcaaaagaaaagcttcaagtcacatataaggtaatctccatcagattgatagcagatttctcatcagaaaccatgtaggccaggaaagaatagaatgataaagtcaaagtagtgaaagaaaaaaaataaaacttgccattcaatattatgcccagcaaagccattctttagaaatgaaggagaaataaaaattttcgcagacaagcaaaaattaagaaaattcatcaccactagaccaaccttacaagaaacgcttaagagagtcttacatctagaagcgaaaagacaataaccactgtcatgaaagcatgcagaactataaaacttattgatggagccaatacacaaaggagaaagaaaaagaatcagaccatatcactacagaaaaacacccaactgcaaaaataagagaggaagtaaggaacaaaggatatacaaaacaagtaaaaagaaatcgataggatgataaaagtcctcaccgatcaataataaccttgaatgtaaatagattaaaatctccatttagatgtagactgactgaacagattaaaaatacaagatacaatatacagcccacaagaaactcatctcacctataaagacacaaatagactgaaagtgaagtgatggaaaaagatactccatgcaaacagaaaccaaaagcaagcagagtagctgtacttatatcagacaaaacacacttcaagacaaaagctacaaaaagagacaagggcattatatgatgacgaagagattaattcagcaagagaatataacaattgtaaacatatacacttaacactagggcacctagatatataaagcaaatattattagatctaaagggagagatagactacaatacaataatagttggggactttaacaccccactctcagccttcgacagatcatctacacagaaaatcaacaaagaaacatcagatttaaactgcactatagaccaaataatataaacctaacgacatttacagaatatttcacccaatagctgcagaatatgcattttttttcatcagcacgtggaacattctccaggcttgaccgtatattaggacacaaaacaaatctcaaaaagcttttcaaaatcaaaattatggccaggcatggtgtaatcccagcactataatcccagcactttgggaagacaatgcaggaggattgtttgagcccaagagtttgagaccagcctggacaacatagtgaggctttgtctctacaaaagattaaaaaattaaccacccgtggtgctgcacacctgtggtcccagctactcaggcggctgaggtgggaggctctcttgagcccaagagggttgcagtaaggatgcagtgagccatgatcatgcctctgcactccatcctgggcaatagagtgagactctatctccaaaaaaatattgaaattttatcaagtatttaatctgaccgcaatggaataaaactggatatcagtaacaagagggacatttgaaactatacaaatacacaaaaagtaacctgctcctgagtgaccagtgagtgaaggaaaaaatttaaagtgaaatttaaaaattccttgaaacaaatgtaaatagaaacacaacataccaaaacgtacgggacacagcaaaagctatattacaggcaagtttatagcaataaattcctaggttgaaaaactaaaaagatttcaaatcatcaacttgagatgcatctccagaaaccagaaaactgagaacaaaccaatccaaagttagtaggaaagaaatgataaagatcagagcagaaatgaacaatattgaaactgaaggaaaaaatacaaaagatcaatgaaataaaaagttggttttggaaaagaaaaacaaaattttaaaaacctttagctacacaatgaaaaaaagagaagactcaaataaatcagaaatgaaaaaggaaacatcacaatgaataccacagaaatacaaaggatcgttagagactataatgaacaactccatgccagtaaatttaaaaacctagaggaaataaattcctgaacacatacaacctatcaagattgaaccaagaagaaatagaaaacctgaataggtcaataacaagtaataagattaaatcagtaataaaaagtttcccaaaaaagaaaagcccagaattggatggcttcactgctgaaatctaccaaacccttgaagaaaattaatgctaatttttcttaaactattccaaaaatttgaagtagaggaaatttttcctaactcattctatgagaccagtgtaactaactagataaggatgcaaccaaaaaatgaaaaaggttatacaggttaatatccttaatgaacatagacacaaaaatcctcaacaaaatacaaaccaaatccaacaacacatcaaaaagataatacaccatgatcaagtaggatttatctcatgaatgcaaggatgattcaacatatgcaaatcaataaatataatacatcacatccatagaatgaaacacaaaagttatgtgattgtctccaaagatggagaaaaagcattcaatacaattcaacatcccatcatgataaaaactctcaattaagatggtatagaaggaaagtaccttaacataataaaggccacatatgataaacccacagctaacatggtactgaatggggaaatctttaaagctttttcactaagaactggaaaaagacaaggatgcccactcttaccattcttattcaacatagtaatggaagccctagccagagcaattggcaaaaaaataaataaagggcatccaaattggaaaggaggaaatcaaattgtctctgtttgcaggcacatgaacttatatgtagaaaaacctaaaggctatatcaaaaaactcttagaactgataagtgaattcagtaaagttgcaggttacaaaatcaacatacaaagatcagtagtgtttctgtacttgaacaatgaactaatgaaaaagaaatcaaaaaggcaatcctacttacaatagttacatttaaaaaaaacctaggaataaacttaaccacagaaatgaaagacctttgtaaggaaaactacaaaacactgatgaaagaagttgaagaggatacaaatggaaagacatctcatgctcatggataagaagaattaacattgttaaaatgaccatactacccaaaacaaactatggattcaatgcaatctctaccaaaataatgatattcttcacagaaatagaaagaatcataaaaatgtacatggaaccacaaaagaccatgaatagccaaggcaatcctcagcgaaaagaacatagttagaggtatcacactgctagacttcaaaatatactacaaagctgtagtaaccaaaacagcatggtactgttataagaatagacacagagaccaatagagcagaagagaacccagaaattaatccacatatctatagccaactgatttttgacaaagatgtgaagaacactcactgaggcaaaacaaaacagtatcttaaataaatggtccccaaaaaatcagatatccatatacagaagaatgaaactagacgctcatctctcatcctatactaaagccaactcaaaatggatcaaagacctaaatgcaaaatctgaaaatataaaactagtacaagaaaacataggagaaatgcttcaggacattggcctgggaaaagattttatgaataagaccccactggcacagactacaaaagcaaaaataaacaaatgggattatatcaaactaaaaagcttctgtacagtaaaggaaacaagaatgagaagacatcttacagaatgagagaaaatatattcaaacttttcatctgacaggaggtcaatatccagaatatgcaaggaactcaaatatcttgacagcaaaaaaaaaaaaccgaacaatccaattttaaaatgggcaaataatctaaacaggcatttctcaaaagaagacatacaagtgaccaaaaaatacatgaaacaagtgttcaacatcatgaatcatcagggaaatgccaatcaaaaccacaatgaggtatcattttaccccagtcaggatggctattatcataaagacaaaaataacaaatgctggcaagaatgcagagaaaagggaacttatgcactgttgatggggatgtaaactagtagagccactatggagaacagtatggaggttcctcaaaacactaaaaatagaactactatagcatccagcaattccactactggacatttatgcaaagggaaggaaatcagtatatcaaagggacatctacacccccatgcttattgcagcactattatatagccaagatatggaatcaacctagggtgtccaacaatagatggatgaacaaagaaaatgtggtatgaatatataggtatatgtgacggaatactattaggctaaggaaaagaataaaatcctgtcatttgtggcaacatggatggaactggaggatattatgctaagtgaaataaggcagataccacatgttgtcactcatatgtggaagctaaaaaatattgatctcatagaagtagaaagtagagcagaggatactagaggttgagaagggtagagagggggagagagttgttaaaggatacaaaattacagatagaagtaagttctagtgctctatagcactgtagaataactctaattaacaataatatatagtttcaaatagctagatggagaatattgaatgttttcaacacaaaaaaagataaatgtttgagatgatagactatgctaattactccaatctgatcactatgcattatatgtatcaaaacatcactatgtaccccataaatatgtacaatttttacatcaattttttaaataaaataaaacaactagaaataaaagacagattgcctatcaaaaaacgactgacagctaacttctatgtaaaaatggacgctacaaggcagtagaagaccatctttcatgtgctctgataaaataacaattagaattctacatgtaatgaaactatctttcaacaagagcaaaattatcatgcaaaagaagtgaaaggaatgtatcactaccctatctttaccaaagaaatgtctacaaaatatattttaggaagaagaaaaattatctcaggatgaaagtttgagatatcaaaaggaatgataaatactgtggtaagtggggcttaatctaaacaatcatggactgtataaagaaaaagcaataatatccactatgaggagttaataagaacccaagtgacttctaactactggaaaataagagcatgcaaattgggaaaggatataaacgtcctctattgttcggaaaaatggtaaagctacttagtagttttagactggtaagaacactcactggggcaaaaaaacagtgtcttaaaataaatgttgctgggaaaactggatatccagatgcagaagaatggcttcttaaaaagccattcttctgcatagctttttaagttgaaattaattaaagtcatgtagaatattaaaatttagtcacctgcattaataaaatttaaaacttatgctcatcaaaagatctattaaagtaaaaagaagccacaattggaagaagatatttgcagcacacaccaacaaagcattagaatcatgaatatataaaagacttctaaaaattgagaaaacaacaaacaatgccatagaaaaatgagcaaaaccatgaacaaacatttcatagaagagaaaatatacatgaccaataagcatacaacagttgctcaatgtcattaataatcatgaaaatgcaaattaattaaaactacagtgagatatcattttaattcactaaactggaaaaaattagactctgaccatgccaggtatgcacaagtgtgtggaacaaagggaatgctaatcgaatgctggtggaagtgtgcattcgcaaaccacattggaaaacgttgtggtgatgcctatggaagttgaactcttacatatttatgacttggcatctccactccaaggaatatattatagactagagaaacaattgtgcaagtgattgaagacactcatcttagcagcattgttcgtagcagcaaaattctggaataatccaggcatgacgtttggctctagaatggaaagagaaagcacattatagtcatatggtagaattatacaaatgaattagctataggctttaacaaggatacaattcaaaaacaatattcctgagaataagcacaggatatctcatgatcccaattatgtaaagtttaaaatcaggcaaaagtaagcattgtattatttagtgattcatgcatatttggttaaatggtaaaaatacatacttgaaaaggaggactaacttttgtggggaaagtagacaacaagaaatgtttaggtgtggaggtactcggtatcaatctcaaagtatactcataatgttttcttctttttactgggtggtgggtacctttattattttagaatacatctttatacttttacatatatgcttatgttgcattttgcaattaaaattttttcaagagtttacagttatataaacatatatactatatttacagccatgaaaaaattgtacatatatatatatatatatatatatatatatatatatacacacaaacacactagtatgtgtgtggatgggagagggagaaagattgattttaaaggaatataaaataaaggtgtatcacgaggtgggactaaatgaacacatttacttgcagaagatgaatttgactttactgtgcttttttggattgtgccgactcataaatctaactgggcttttagtagacaggagacgattgaacattattccatcttatgtattttcaaacagactgtattattttgggtgttgtgtgtctcacccacactgtcaagattctgtaaacctgcaacgtgatccattcggctgcgctctagttattatccaattatcatccattctgcttattaacaggcataaacagacagtatttctgcatggagctgataccctccattatgggtcaccggtcccgttcttaagtaggattgtgaaggaaaaaagcagagaacttcatcttcagtactaatttctctcacttaattccttctgttttactctttctcaagaatgggcatttatcctctactggtgaagaaagggcagagttgtaggagccatctacggtaaatgcaggctttcaaagggtggggggggacggtagagattttaaacgtaataataaaactgaacaaaatttgatctgctgtatgttatcactatgcaattctaaacagtgttagcatgaaaatattcctcccctagaaattattttgttgatctaagagtactgaattgctacagttacttttgcattgtaataatatatctgtaagcttcaaatcagcatattatattctacatggacgttaactcagagaaccaagagttgcacagggactgccagcacactcagtgacacacacacgttttgatcgtataataagtgcctaacagggtggaactgggcacagggcatgtctcagacctgtatggtacttttaaaaaaataagttaaaataaacactggggcatggtgatggaaaagatgaaaaaacagaacgtaagttatttcaatgttgtcactcggtgtggccacttggagtttatatttgcattttactgttgcatttgaaaattgttaaagtgaaagtgacaagtgcaagacacactctttttgtttggtaaatatacatttcagtccacacatgagaatagttattgaatgttagaagtatcttttaaaatgaaatgtatgttttttcctatcttttggttttaaaagtgaaagaaaaagaaattttagaaaatttaaccttatgttacttactagtataatttagtggttgcctaaattgtactgtttgcatacgtttcagttttattaaagatcacttattggctgttgtcagtaaagagaggatgttaaaaatgatgtgttctgagtgtcaaatccataggtgtactctgtgatcctcttttccgatcagttccccgagtgtcagtaggaaatctaaacagctaaggaccaagcacaggaggagatataaccaatggacttttaactgaggggacacggtttgcatattttttttatttttattttttattttttgagacagagtctcactctgtcacccaggctggagtgcagtggtgcaatcttgtctcactgcaatctccgcctcccggattcaagtaattctcctgcctcagcctcctgactagctgggattacaggcttccgccaccacacccagctaatttttgtattttttagtagagatggggtttcaccatcttggccaggctggtctcgaactcctgacctcctgatccacccatctcagcctcccaaagtgctgggattacaggcgtgagccatggtgcctggccggtttgcatatttgtaacggtgtctttagcacctgcccgtcatctttcctaaacttggtctgcttgagaacacaccttgcttgccatgtcgtttataggataattttccatgaatggaattatttgaatctcaaagattttgtcaaaaaatatattcaaagcttgggtgtaatagacattacacctgaaattacatcctttgcggttatctcaatgtactttaaaatgtttagacattatgctaaaaatatgttaaaagggggcgtcattttttcaatttctcttagggatcacacaaggaagaaaagtttttcaagactgctgatgtaaaatagtgttatcagacagtgttcacatttggagggattgttggtagccaagtctccttggtgtttcttgtgaaagaattcttgagaaagaaatatcaggcaattggggtatattccttaaacatatagtagggaatggggctggtgaatcagttctgaatgcctgttttcttctttaaaattccagccaatgatatgaagcccaggtatgtgggggccttttgatgacagtgagggtgagactaaggaagctgacctgccctgcccagggacacaaggctggctagcaacagagccaggacattagtcagtgtgtctggctctgaagcccccatgggggacactgtctcccatctcctttctcctgtgtttagccttgactttcaccttcaatgtcatgccagacaaagagttgctatggggcaagtgggaaaggcaaaactttttctgaactgctctttaatttgtcaatatagcccaaatctagttgcaatctggtacacttttagtcatgaacgagggtggaagaaagctaatatcacatgttgacctttcattttgccaccaagaagctctccttgaatattctgaaggagaacacgttcttgctgggggctggataaaccttaaaaatttcatgcccctgaatgagcatttcccctcatcacggacttgtccctggggctttcttaggcatgggcaggatgtggattgaaggaagaaacccagtgtcatgggcagcaaaggttgaatgtcttctgtgtctagtcctaacactgacttggagcccattcctcatcattttatcttactttctcccatctgaaaatatttacaaaatcatgtttgatgtcaaaatactaaatactatttggggggccgggtgtggtggctcacatctgtaatcctagcaatttgggaggctgaggcgggcagactgccagagctcaggagttcgagaccagcctggacaacacggtgaaaccctctctctactaaaatacaaaaaattagccaggcatggttttgcatgcttgtagtcccagttactcaggaggctgaggcaggagaatcacttgaaccctgaaggcggatgttgcagtgagccaagattgtgccactgcactccagcctgagcgacagagcgagactccatctcaaaataataataatagtatttggaggattttcccagagcatttgggaagcatttgtacacaaatgagtctgtgagcaaagggccaaggcaaggggcaggagctcagatgcaggctgtgttgatggggctcaaatccagagccccatgatccctatcccgtgctccactgcaccatcctattatcctattttgcattttatttttacattcctataaataaaaagtgcaatcaaataacttgaaatatggtattgcttttgtgcttaaaaataatctcagaaatacagcaaacatgccattcacttgaaattctaaaaaagggcaaaactatgttgacagaaaacagatcaatgatttcctggggtgctgggggtagcagtgggtaggaagagaattagctgtgaaagggcacttggaaactttttcagatgagagaactgctgtatcctgatggtgagggtggtttacacagctgtatacggttaccaacactcatcaaactgtgtgcttaaaacactgactatgcaatacctttatgcttatgtctttttataatttaaatagggagaaaaaatatgtattttgtaatatacatattaatacacattataagatatatataaatatcaataaataataccttatttggaaatagggtttttgcagatgtatataattaggcccaccctaaatccaatggctggtttccttataaaaaaaagggagagggggctgggcgcggtggctggcgcgcctaatcccagcactttgggaggccaaggtgggcggatcaccaggtcaggagatggagaccatcctggctaacacagcaaaaccccatctctactaaaaatacaaaaaattagccaggtatggtggcgggcgcctgtagtcccagctacctgggaggctgaggcaggagaatggcgtgaacccaggaggcagagcttgcagtgagccgagatcgcaccactggactccagcctgggtgacagagcgagactccatctcaaacaaaaaaaaaaaaggagagggatatttgagatacacagacacagagttatatattgtacattttacaaagaaaaaaatgtacatatatatgtatacctatatacgtatgacatccctttctattctgtcttccacaaatgtgagtataagtcttcacagtgggaagtaggaatgatcagagatggagtattagtttgccagcactgccgtaacaaggtcccacagaccagatggtttaaacaacaggaatttattatctcacagttctggaggctcagaatccaagatcatggtgggggcagggttggtttcttcggagacttctctccttggcttgtagatggccgccttctcactgagtctccacatcctcttccttctgtgtgtgtctgcatccaaacttcctcttcttgtggggacaccagtcatactggattcaggcataccctgatgacctcattttaacttattttcttctttgaggaccctatctctaaatccagtcacattctgaggtacatgggattaggactccacatatgaatttttggggggacacaattccacccataacagatggagaatagtgcttgaggtctttactaatttactcaccttggctctatttgaggttttctgccaggagcaggtattttataatttaaagtatacatatgggaaaacacacacacatacacatatatatatacacatatacacatatatatacacatatgtgtgtgcatatttcaaacaaggcagagatcatctgtgacccaaatatgtgctgatgagatcaatggactgtgctacttattggtcccataacatatcacttgtaacctctatctatgaccttccacgtcagtgcaataactaatacagccatcatacacagctgtgcaagagttaacattttattcttctgtgactgaacttctgtttcgagtcccccttttctcagagttgcatctcagttggtggggctgggggtgtctgtggtctcaggcagggaaggcaggcagctcttctggacctggccagagtacatggtcatttctccaggatggtctcccttagacagcctcattccctacctggccactcacatgtgttattgctgcaccctctgtcctgaccctcaggcttcttaagtttgactctgaagccgcactctctgggtttgaatcccagctctactcactatgggctctgtaccttggccacttcactttactttacttctttgtgctttgattacctcatctataaattagagctattcataatagtatctacttcatgtggctgttgggaggattaaatgagttagtatgtgaaaacatttgaaagcgtgtctgccccatagtaaaagctgtatactgtaagtgattcccattattagtagtagtagtagtattgttactgtgatgtcacatgcctcattggtgttttattttggggagcacataaagtactccatttgcctctcttagctgcaagagagaaattctcctgggttgtctcgggtccatgtgctggacccatatttctgctcctgcatcatgctgggaatacagattgtggagctggggtgcagggaggtgtatgactttgccagcttcctgtatttcccttgagaagtggagcggtgctaattgtccctgtcccggatgttccatcaactgtgtggtcccataccaacccctcaggggtgtctgcccaacccccaccccagctttctttccttctttacttagcatctactcctcaggagactgctttgcccagtatgccctaagataataaatgaccttctgagagtcaaatgccaggactcactcttggtctgtttgtcctcacccggctgctcccttgggggtaggccaggacacacactgggtgagaagcgtggtggaggaaaattatctgagttaatttatcaaaatacattattccccagtgacactagggaaaccttacagaggccccgccagcatcaaagagcaaggttctgtttcccatgttccgttacccgatccccagggcctgaaacagagtccagggaatatttggaaactaatcgtcatgagtggtagcatcctaagcagtaccattgtttacctcctaagatcccccaataattgtggttggctatttgttttctagtcatttagacacacacacaaaaattgtttttcaaatgagaaggggaatccacaacaaaaaactgtggctagcttattttcgagtttgaatgctttgtgtaaattaataaagttgaagtctatcccatgtgtataaaaatcttggagttatgttcattaatgagtctattgaattagttttcataaattcttctgattcaattgcatattcttaaattaacaacaaaagtccaacttgtatcattaaagactcaaaacagatggtgggaacagtaaagtgtaggaaagtgggaaaaatccttaaaaaataaacggttctttaaaataaatgaataccaaataaaacagaaaagtataaagagctatagttctttttttttttttttttttttaactgagacagagtctcgctctgtcacccaggatggagtgcagtggtgcgatctcagctcactgcaacctccgcttcccgggttgaagcgattttcctgtctcagcctcctgagtagctgggattacagatgcatgccaccacgcccagttaatttttgtatttttagtagagacggggttttgccatgttggccaggctggtcttgaactcctgacctcaggtgatctgcccacctcggcctcccaaagtgctgggattacaggcatgagccactgcacccggccgggagccatagttcttggtggaaagcaaagcttttcacatcagctagtgtagtgtctgaaaaagtcctcattatagatgggacaaaaagatttagtgggaagaagaaagagaacattgagacagttatgaaaagttttaattgtaaattttaattctcatgtgaaatgaaaattttgggatactttcacacacacacacacaaatgttatcctcagattaaaatatttatgtgggaaatgtttagaggtaaaatgtttagaggggaaaaaaccacttaccatgattgctgccagaaagggtaaaccttagaatcataatactgcagaatttaatgatcctttgtgagcttctggttcaacactcgttttacaagcaaagaaatggaggctcagagagattggttaggtgagccctgcaaggactcatggctaaatagtggtgaaatcagaagctaaagccaggttttctggcttttattccaggactgagatgtagtgacctgactctcgtaagtttctggcttcttccttttggagccacaggtaagcaccagtctagaaccttccactcagacttcatgctccagggttgtgaccagagcttacaagggtgttgtcctgggctggaagcagagactgtgaaactcaaatatacttaggcaaatgcaagcatatgaataaatcaccgaaatcaggacaaacagcttttcttagataaattgcccttggaaagaaaggtgaaaactaagccataatgcatgaatgtgttaattgtttttctcttctacagacactaatttattctgaagggaatgcttcatttccaaattctccttctactttaaagaaattcaaacttcaagaaaaaaattcaacaccatattgtgattgcttcaatagttaagaatttcggctgtcacgactgaaaaaaatcattagcaaaaactggccgtggaaaagggaagtctgtctagttcatgacaagcatccatcatcgtatgtgagttagtaatttctcacctctcatttgagagaggcaaggtacctgtgtgccattggggtgggctttccccgcagtgacagatccggatagatcaccagcctggctaagctccaagccttaaattcctttacttctcacccctgggccatttccgccacttttcctccatctcctttatccatttaacatctgttacatatatgtatatacacacacactttaagttctagggtacacatgcacaacgtgcaggtttgttacataggtttatatgtgccatgttggtttgctgcacccatcaactcgtcatttacattagttatttctcttaatactatctctcccctaggcctccaccccctgacaggccctggtgtgtgatgttcccctctctgtgtccttctgttctcattgttcaactcccacttatgagtgagaacatgcggtgtttcgttttctgtccttgtgatagtttgctgagaatgttagtttccagcttcatccatgtccctgcaaagggaatgaactcatccttttttatggctgcatagtattccatggtgtatatgtgccacattttctttatccagtctattattgacgtttaacatcttttatttatttttatgttttactttttgagacagggtctctgtcacccagactggagtacagtggtgcaatctcggctcactgtagcctctgtctcctaggttcaagtgattcttgtgcctcagcctctccagaggagactttgacaaatatatatatacacatacatacacaaatatatatatatatatttgtcacaaggatttgaccttatgcaattatgtttgctggttaagcagcctctgtgaggctgttgtctttacatctgaccatgagatgttggagcttgaagtccaagaggcaggtggtcagcagaggaagatggatatgaagtcgggagagcagggatgggctgggacccacaggcacacacagaacccatgaagacccaccggaactcaggtcagttatcgctgcctctctgggtgctatagttgtcctacaggatatgccggctcccatcatcacagacatacacacgcacctggcccaagagtcacagaagctgaaggaaaattcagggaaggtagagcagttgtgacttggctactgccccacccagcaacatgagccacagataaaacaggtgtgagctacagaatggctgccgcttccctgcctcctctgaatctcacatgtaagcatctcttgtggcccactctaacaagaaacattcaggaaaggagatctgggggagggggagcctctccaagctgacactttgcaagccacccagtctacaatgtggagaatggttgcaaagccttccacacttcttcctgccaatcctcaccctggtctccagggtcaagtgtgcactttctggggatgcagcctctccaccccacacacaagttgtaccgggaaaaactgagatttccagcaggcagagattgagaagcagcagctaataacattacaaggccatttggcagcagcgcaaaccttcaccattacaattagagcaagtggaggtaaaagagactctcttaatggccaaatcaaataaaaagtgacaggcttctgaagattatgttgaaccctgtatggcatgttaatgaaacaaagggtcagataccatttcatctgtggcttatctgcttagatagaagggatgtttttctgcctagtcctacctgaggatttccaagccacccctatgcatgaagatctgacacatttttgtccgcacttttctcagagtgttggggaaccaggactgagccagcagcgaaatattctgtgatgtaaggtggaatttagaataaaggtattttggtgatcaagcagctcaatggtccttaaccttgactgtaaccttgactgaatcacatgcaaagctttatagcctttctgatgtccaagctgcccagagatttttagggtgcacccaaggcatcaccagttagtaacgcatcccaggtgattccaaggtacaaccagagtctagaaccagggatctagtctaatccttttttcagataatgaagctaagtcatagagaagttaggtgtgttggccagtagtaaatacaaacagtagaacccaagtctcccaactcttaaacttatcaccttccactatatgccctgccatatctgctattgagaagagtgagaaacacacattaaaactgcatactctactgtgttccaagaatgggatgactttgaaatgcatgctatttgtagaatataggtagtgagactgatgcctggtcattcgcctacagccttaacacctcctggaagtctgattctttcagtttaccttgcccatagtgtgagacagagaaggaaaatagacgagtctcagaatgcattgttcagtggaatgcattttggaatgatcctacaaattacaggaaagctttaatcgccaataattaggtgtcttaaaaatggagttgtcttctggcgtatgctgacattatcagtccaagatagacttgagccaggagcctctgtgacagtatgctttagaaagagtgagagagggagcatgtgtaagctaagaaaacctttgtaaataagcaaagtcttattcaacctacagtctgtcctcagagctatcatttatcaggggaacccacccctgataattcaacatgagtccttttctattttccgtaagcgtcggccggtctgagaaacaaagggaaagagtacaaagagataaatttttaaagctgggtgtccgggggagacatcacatgtcggcaggttctgtgatgccccctaagccacaaaaccagcaggtttttactagtgattttcaaaaggggagggagtgtacaaatatggtgtgggtcacagagatcacatgcttcacaaggtaataaaatatgacaaggcaaatggaggtggggcgagatcacaggcccggggcgaaattaaaattgctaatgaagtttcaggcacgctttgtcattgataacatcttatcaaccgtaaaagacagacattcctagagcggccattttagagacctcccactaagaatgcactctctttctcagggatgttccttgctgagaaaaagacttcagcaatatttctcctatttgctcttgaaagaagagaaagatggctctgttccgcctggctctcaggctaccagacctaatggttatctcccttgttccttgaacattgctgttatcctgttcttttttcaaggtgcccagatttcctattgtttaaacaatttgtgcagttaacgcaatcattacagggtcctgaggtgacatacatcctcagcttacgaagatgacaggattaagagattaaagtaaagacaggcgtaagaaatcacaagaatattgattggggaagtgataagtgtccatgaaatcttcacagtttatgttcagagattgcagtaaagacaggcataagaaattataaaagtattaatttggggaactaattagcgtccatgaaatcttcacaatttatgttctgccatggcttcaaccggtccctccgtttggggtccctgacttcctgcaacaataattatttattttaaaagaaacaaaatcaaattattagacatttcaatctgtggtagtaacatgatattctggcatctactttcattatcacctttattaaaataaatttaaagaaaaatggcagtatgtttctgtgaagaccacgagtactcattttaaaggactcaagagttgcagaaaagtaaaaagaaaagagtaaaatcattttctaaatctcaccttccagaaataacgatgttgagcattaagtggacttcatttcatactctttcaaagattatgtaggcatatatatgtgtgtgtatatacatatatatggatacatccttagagaagttggctggctagatagacacactataaaaatggaatcatactctaatgccatttttaatttaaaaaatacatattcagatccactgtacttatatacagaagtaaatgaaactaaagtaacacgagaggaattctgaccctcatataattttttttactatccaacataattattttttttattatactttaagttttagggtacatgtgcacaacatgcaggtttgttacatatgtatacatgtgccatgttggtgtgctgcacccattaactcgtcatttaacattaggtatatctcctaatgctatccctccccttccccccaccccacaacaggccccggtgtgtgatgttccccgtcctgtgtccatgtgttctcattgttcaattcccacctatgagtgagaacatgtggtgtttggtttttttcccttgcgatagtttgctgagaatgatggtttccagcttcatccatgtccctacaaaggacatgaactcatccttttttatggctgcatagtattccatggtgtatatgtgccacattttcttaatccagtctatcattgttggacatttggcttggttccaagtctttgctattgtgaatagtgccgcaataaacatacgtgagcatgtgtctttatggcagcatgatttataatcctttgggtatatacccagtaatgggatggctgggtcaaatgatatttccagttctagatccctgaggaatcgccacaccaacttccacaatggttgaactagtttacagtcccaccaacagtgtaaaagcattcctatttctccacatcctctccagcacctgttgtttcctgactttttaatgattttcattctaactggtgtgagatggatggtatctcattgtggttttgatttgcatttctctgatggccagtgatgatgagcatttttcccatgtgttttttggctgcataaatgtcttcttttgagaagtgtctgttcatatccttcacccactttttgatggggttgtttgtttttttcctgtaaatttgttggagttcattgtagattctggatattagccctagccctttgtcagatgagtaggttgcaaaaattttcttccattctgtaggttgcctgttcactctgatggtggtttcttttgctgtgcagaagctctttagtctgattagatcccatttgtcaattttggcttttgttgccattgcttttggtgttttagacatgaagtccttgcccacgcctatgtcctgaatggtattgcctaggttttcttgtagggtttttatggttttaggtctaacatgtaagtctttaatccatcttgaattaatttttgtataaggtgtaaggaagggatccagtttcagctttctacatatgtctagccagttttcccaacaccatttattaaatagggaatcctttccccatttcttctttttgtcaggtttgtcaaagatcagatagttgtagatgtgcggcattatttctaagagctctgtccttttccattggtctatatctctgttttggtaccagtaccatgctgttttggttactgtggccttgtagtatagttagaagtcaggtagcatgatgcctccagctttgttcttttggcttaggattgacttggcaatgcgggctctttttttggttccatatgaaccttaaagtagttttttccaattctgtgaagaaagtcattggtagcttgatggggatggcattgaatctataaattaccttgggcataaattaccttggccattttcacgatatcgattcttcctagccttgagcatggaatgttcttccatttgtatcctcttttatttcatttagtagtggtttgtagttctccttggagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgagacgatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgcccgtttccaaagggaatgcttccagtttttgtccattcagtatgatattggctgtgggtttgtcatacatagctcttattattttgagatacatcccatcaatacctaatttattgagagttttttagcatgaagcgttgttgaattttgtcaaaggccttttctacatcttttgagataatcatgtggtttttgtctttggttctgtttatatgctggattacgtttattgattttcgtatgttgaaccagccttgcatcccagggatgaagcccacttgattatggtggataagctttttgatgtgctgctggattcggtttgccagtattttaccgagaatttttgcatcggtgttcatcaaggatattggtctaatattctctttttatgtggtgtctctgccaggctttggtatcaggatgacgctggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgcctcaatttgagagcctgttattggtctattcagagattcaacttcttcctggtttagtcttgggagagtgtatgtgttgaggaatttatccatttcttcttgattttctagtttatttgcatagaggtgtttatagtattctctgatggtagtttgtatttctgtgggatcagtggtgatatcccctttatcattttttattacatctatttgattcttctctcttttcttctttattagtcttgctagtggtctatcaattttgttgatcttttcaaaaaaccagctcctggattcattgattttttgaagagttttttgtgtctctatttccttcagttctgttctgatcttagtcatttcttgccttctgctagcttttgaatgtgtttgctcttgcttctctagttcttttaattgtgatgttagggtgtcaattttagacctttcatgctttctcttgtgggcatttagtgctataaatttccctctacacactgctttgaatgtgtcccagagattctggtatgttgtgtttttgttcttgttggtttcaaaaaacatctttatttctcccttcatttcgttatgtacccagtagccattcagcagcaggttgttcagtttccatgtagttgagcggttttgagtgaatttcttaatcctgagttctagtttgattgcactgtggtgtgagagacagtttgttataatttctattcttttacatttgctgaggagtgctttacttccaactatgtggtcaattttggaataggtgtggtgtggtgctgaaaagaatgtatattctgttgatttggggtggagagttctgtagatgtctattaggtccgcttggtgcagacctgagttcaattcctggatatccttgttaactttctgtctcgttgatctgtctaatgttgacagtggggtgttaaagtctcccaagtctctttgtaggtcactaagggcttgctttatgaatctgggtgctcctgtattgggtgcatatatatttaggatagttagttcttcttgttgtattgatcccctttaccattatgtaatggccttctttgtctcttttgatctttgttgatttaaagtctgttttatctgagactaggattgcaacccctgcctttttttgttttccatttgcttggtagatcttcctccatccctttattttgagcctatgtgtgtctctgcacgtgagatgggtttcctgaatacagcacactgctgggtcttgactctatccaatttgccagtctgtgtcttttaattagagcatttggcccatttacatttaaggttagtattgttatgtgtgaatttgatcctgtccttatgatgttagctggttattttgctcgttagttgatgcagtttcttcctagcatcaatggtctttacaatttggcatgtttttgcagtggctggtaccagttgttcctttccatgtttagtgcttccttcaggagctcttttagggcaggcctggtggtgacaaaatctctcagcatttgcttgtctgtaaagtattttatttctccttcacttatgaagcttagtttgaaatgaatgaaatgaagcatgaagagaagtttagagaaaaaagaataaaaagaaacaaacaaagcctccaagaaatatgggactatgtgtaaagcccaaatctacatctaattgatgtacctgaaagtgactgggagaatggaaccaagttggaaaacactctgcaggatattatccaagagaacttccccaatctagcaaggcaggccaacattcaaattcaggcaatacagagaatgccacaaagatactcctcaagaagagcaactccaagacacatcattgtctgattcaccgaagttgaaatgaaggaaaaaatgttaaggcagccagagagaaaggtcgggttacccacaaagggaagcccatcagactaacagctgatctcttggcagaaactctctaagccagaagagagtgggggccaatattcaacattcttaaagaaaagaattttcaacatactgattttttacagatgccttatcaaaagagattatgaaagctattggaattgtaatacttttattaattaatggttcacttttatatagtatcagtgaacttcgagcaatgaaagaagatgattttaatgcttccttcatttctctatcacccacctcctgatttttatagatcattatcattcattcattcaaccagtgtttatttagagaatactttgtgtaaggcaccttcaaggtgctgagcctagagctataagctatcgatggaacagacaagattctcacacataatggggcttgcattttaatagaaagaaaaaataaatcactattttgacattgcgctgattctgttcagtaaccataagcctcataattgttcagtattgtttctatatttgaattctttctatgcatatacataagtagaagtctggcagactagagagatagccagactcacttttataaaaatgggatgatactataaattcacttccgtcgctgacagcccatcctccacctaccttcttatctctgatcctccctagcagccctatccaggtttccctggttagaaggagaagctcggtcttttccagattcacagggaaaggttcccaagcaggaggagtgaggaggagccaggtggcagggccaggccaggccaagcctttctccactgcttctctgcagaatttccttggctgctggttttggaagtgtgtgacattaggttatgtccatttccttggttggtggctgctgataaaaattttgactggtttcactattttgatgctataattcttcatttttttttaggcattgctaagttagataaatcttatgttcagtcttttctatcttatctttaccccaagtctacctccttaaaatacttttatgagcacaaatccctgatgtaaaatcaagccataatgtgtttcctggagtaggggcggacaaatatgttaactaaattctttttgcgtgcttcatgttggatcaattcttaaggaataattttgactgagcctcttttaagcttttccaggcctggcttgttttcctgaaaagcttcaaagcagagaggagaatctttgtcagttagctgggtgagtggttcacaagcctcactgttgtgacacactccgtcatttgtgagggcatcacagccattttgttaatagaaatacagagccaaaagtcaaacatgattttatatgtgtgagatgttgcccgagggaaagggcaaagaatgagaagagctggactgggcaactctcatgtgaccccaggtccctttcaaagttgagtttctctagcaagtttgggatttccaaatgtttctactgagaaaaaaaaaaaaaggaaacgtgcaattaaattagaaaactacacagctcttactgaagagctgaaattttaaaaagatgcttaaaataaagcaaggaagataaggagaaagaaacataaagcatccaaacctgaaagaataacattcagataggctaacactcagaaaagattggagtcttgccaaacatcctgaggtcagccgccaccacagcaaaaagactgtttgatttggagtgacaagaaagatgatgtgatctcagaggaaacagatggctcactaaagatatttgaggatattttaataaaaagaagattttaaaaggtgtgagtaggatacagggaaagtgacaaaagatggagcaagttggaacctgatgggagtaatctggggggaaggaacccatagcagaagtggtggctctcaatggtggagcccagccaatccgtgggatcgggcaggaagggagctgacccactgtctgctccacgacctcctggtgctgcctccccttggctgaacccagccagaaggcaaagagagacccattggtccattccgtccaagatctctctcagggctcagagcagcgtacagaaaggtagtgtttctggaggaacaaatagaagatatccagcagtaagggcaaggaggcacagaagtacttcctgcttcaaggggttgagtggctatggtagttgatgttgagaaggcagatgaagtaaaagcaacttcgcatatatctttcctatcaaagacaatggtctaactggaaagaaaacaataaacagggttgtgactaaaaactgggcaaatgatctaaacagacatttctcaaaagtaaacatacaaatggccaagaggtatatgaaaaaaatgttcaacatcaccatcatcagggaaatgcaaataaaaaccacagtgagatattatctcaccccagttagaacggctatgatcaaaaagacaaaaaataacaaatgctgacaaggatgcaaaaaaaacccacttatactgtgttggtaggaacgtaagttagtacagccactatggagaatagtatggcggttcctccaaaaaactaaaatagaactaccatacaacccagcaatcctactactaggtttctgtattgttttgttttatattttttgtttttttggttttttttttttttttttttttttgagaaggagtcttgctctgttgcctagtctagagtgcaatggcatgatcttggctcactgcaacctccatctcctgggttcaagtgattctcctgcctcaacctccccagtagctgggattacaggtgtgtgccaccacacccagctaatctttttagttgagatggggtttcgccatgttagccaggctggtcttgaacccctgatctcaagtcatctgcccactttggcctcccaaagtgctaggattacagataagagctaccatgcccagccccattactaggcatttatccaaaggaaaggaaaccagcatatcagaggaatacctgcaccccatgtttatcacagcactattcacaatcgctaagatattgaatcaacctaagtgtccatcgacagatgaatggataaagaaagtgtggtatatttatacaatggaatactattcagccatttaaaaataaaactctgtcattcatggcaacatggatgagcctggaggacattacgttaagtgaagtaacccaggcacagaaagacaaataccatatgatctcattcacatacagaagctgaaaaacagttgatctcatagaagtagagagtacaattgtagttattagaaactgagaagggtaggaggggaggagatggagaggttggttcaaggttacaaaattatagccagatcagaggaatatgttctagtgttctatagcactgttgggtgactacagttaaaaatttttgtatattttcaaatagctagaatagaagattttgaatgttcccaacgtaaagaattgaaaactctttgaggtgatggatgtgttaattaccgtgatttatcattacacattgtatctatcaaaataccactctataccctataaagatgtataattattatgttcaattaaaaataatgtaaggaataaacaatattgaaagcaaaagaaaaaatcccaaagtggtcaaagcaataagccaatacttaactcctttaagcccatctgcaggcctaaatgaatcttacctgagagtgctgaaagaaaattatgtttaatttccagaaagggtcaaaagagtacattattgaacctgtaataaagttactgaaattaaaaggaatgttaaagatctcaggtttcttgatttcaggaagctatttgatggagcctttcaaagtttggttggtaatgaatatgctggagaaacaccggccatacaagaaggtttccctgacctgggatggacagtcatgcacagtgtttactagtgttgctcgcatggcatgaggaggaaagggcacaggacccttctttttgacccactcctattcaagtttctatgaaggtcttgaatgaagataggaggtgtaggtcaaagtcgtggttatgactgtttcaaagtcagaaaggagaatcggttctgtggatcttacaagctcctttaagatgcctcaggctatgaagctgtgggagagctggaaattctggatggatgggataatatttcctgaagcttgagggaaggtgtttgctgaagtttgtccaatgtgctctgtatgaagccagaacccaatgtcccatctgccttgttccagcactgcctcggattccagatcctgagaaccaccctttaccccagggaaacccctgatgccaccttctctgctgccaaccattatgtggtgtgagctgtccccaggttgcaagtctctgccagcagccctgcatgcttcaagactctctgtgtggccccacagggcaagcacaacaaagaggtcaaatgacagaatttcaaaagatttcaactgatgaaccaaattaaaggacatgttaggtattggaattttccaatttacagagctagtttgtcctagcattggccagaatgaaggctgaaagagtggcagggctgccaccatggttactgcagcaggtggaattcgagtgcctgaattgagggaagtgggggtcctcctgcatcccgagatagcgagagcacctcagaagtgctggcttaggtggtggcacccactgtaagagaacgatgacaaatctcagtttctccctaggagagtgcccagcagggtgatgagccaggaagatctgtcaggatgaagagtagtgagaggaagggggaaccctggagaagagaagaacttaaagggattcacaagaagttgaggagggcagagctgaatgagacaaggttgcagggaaacagactttttaagatcagtgtaagggaaaaaaaaatccttgacaatcagaattgtttcaaaacagagtcagcagcttcttgagactgggtcgctgtgctaagaacgtaaagggggagctgggtggcaccagcaaagtggcaggaatgtgtccctgcagggtctttgctgccttccgaatcctctcctttgtgatcctgtaatttgtgagagagcctggagggtagcatggaaaagagagaggagaggacctgacagcagtatttccatcttgtcccctaacaattgcctaggcagtctcctctcagcagggaagcaaactggtcaccaaataataataattatccccctacatttccttaattatttaaacttctgaaaggacatcaaacacagcaaagagtcaatgacttgctttcagaagtgattcagactgtagctccacccataacagtgtcaccttgagcagtcacatatgccttaacatccttctttctaaagcaattccatcttcccaggttgattgttgagcgtttagacatgatgacatatataatctttatatatgtatatttacaagtatatgtttatggataaattttgactgcctgtaacccatgtggccttgtgtcatcacacataagttcactgaagctcccaacaaccagacttttggggaagtacaaacctccacattagcactaggtctccttgcctgcccctctgctggaagaatccctggcaggggccttctttggtgatgggattgaattttctatttcctgaaatgtaatcagctttcagtttcaatggtggtcacccccttgtaccttcttttaaagattggaacgctgtattggtttctcagggctgctgtggtcttcatagaagatgacccgcgtatttccaaggtttcctccaggattgctggggctgtctgcgtccagatgttaaggttactgtagacaataaatgggagagggtgaaggaaggaggatgtttagagaaaattatccagtcacctggaggaaaggctcttagctgcaaaagaggaaataagggccaggcacagtggctcatgcctgtaatcccagcactttgggaggccgaggcaggcagatcatgaggtcaggagatcaagaccatcctggccaacatagtgaaacccatctctactaaaaatacaaaaatcagccgggcgcagtggcacacgcctgtagtcccagctacttgggaggctgaggcaggagaattgcttgaacccgggaggcagaggttgcagtgagatgagatcgtgccactgcactgcagcctggtgacagagtgagactccatctcaaaaaaaaaaataagaaactgctatttagcacaacatcaaataagcagtttgttgcttatgtctgaacacttctgtgaaaacaggcaaaggcagtcgtgtgtaggttctggtgaccaggaactggagctgcacagaggtgtagaggctcccaaagctcgtcaattgtttatgaagggagtaaaggctggaagtcagggggtgggtgtcagtttctgccactagctaccagatttctcctaaagatgggaaagctccctttatagagctggagtgcaattttgtgttttctttgtgtttggcaatgtctgttactgacttgcaatagatatgcaacagtataggtatgttcatcttagtattttggggacaaaactcccaaaccagccaccacacaaatgtatttataggtaccagtaggcacctttggactcggagggaagtcagcctccttaaagccgtattcagtaaggagaatgaagggtaggcatggctgcagcttgggttgtgcccaccatgtggatatccagccatgatctcaatagtcaggttggtccacattgtccagatatctccatgtaacattaactcagactttatgaaaataaccggtgagaataaccaaagccacattgggtaatgaaaactgtatgtacaattttctttagttacattgatgttgttacatactgttcataattaattacattggtttgtaatgtatcatgtcctattgtattgtaggttctaataccaagaccctaggtgttcctctcttaaaagctggtgaccacctttaactcatgtggtaaaagaatgatagttctgggaggatctgcattctctctgtgtccatgcagcattgccccacactgcctgtgctgagctgcatgatcctcatagctacatcatagtctttgcttgtaggcttgtcgtttggagaaccgtcttggagtctttattggttgatgtcaatggaaagctctgcttccctctggatgtcctatggtattgctgttcctaatgtctttctaatgagtgctacgtgtctgtatgtgtgtataaagagatttatgtaaagaattggctcatgtgattacggaggctgagaaaccccaagatctgcatttgccactaagtactcagatatttggtcaaacatgattgtgagtgctgttgagtgctgtattttttaactgccacgtaatcccctcaaggtccgtgttattctagacagtaaaccgggagaggcttctaaagccccctttgtcaggaaatgttactttagaatctgaccttgtgtgaaacacagatgacagaacctctctagtgcaatgacattaaaatcctcccccagtacttgaagtgcaagggaaatagctcattgctattatggctggatcatctcatggcctctcaacagatcaagagcaccattactactgttgctttcttgacttgtgttttacttttattctaacatttgttgcagtctgtgttaaatagggaggtagaccaaactatgagaaggagccctatattggaaactgtatagccaactatgaaacctccaggcttactttgctttctcattacaggcggccttcccctctgctccactggagagagtcagagtaattggctcttgctttatatgaaggatatgctcccaaaaaagttgtatttaaatcaagttttaacaaaccgactcatgcttgtttatccacttataacacttactatttaaaggaaatgataaagagtccttttctgttgttacagcgtagttggcaaagctgtatcttctgaagactgacttgcactcagcagttttagatcaactcgagtctgtttatactaagatccacagacccctggtggttctcagatgacttgcaaattctactagtttttccaattgtgtgttttttgatgataacttaaaaattttttatgataatcttttcattgtttagtataataatgtacagataaaccctagatgatcaccttataactgagtgctgtcatgagatttcagtgcctttgttctcagtcctgtaggtaaccaagacttcatctaaaatcacatcacttgactttaaatgtttgcaagacacatctgactgtcattgggttgataaaatctgtcttgtcctcattttgtgttgtgtgggactctatcatcaggtacaaaagcaaaactcctttgccatgagcgttcacagttgaatgacttttttatagaccaagagtttagtttcttagagtatatattgaatcaatttggcatcatggaaatggcatagtacattagaggcacatactatgttaactgtcacaatctaatgataaagaacagaaaaggacatattacataatcggtgcatttctgttaaagtcatggcaagcttattgaactagttttatagcaatttggcaggataaaaatgatgggaggatggagtcatcatagggtgcctgccctgtagcatggacacctgggacacaccttgctggatgatgtcttctttgggttccatcttaatacatgacaactggaaataattctgtagcagaaagtagagtgtaaaatagaaaatgactcttattctgatgaatcaaagtttttaagccatatatgtcggagtacacttgaattacttctgtaaaaactagcacattatataaaaatcataataaaaacagagattccagtgaggggtccctcttgttcagagtcgaaagattcaagtcaacaaaaatggaacctgtaagttagtctttttgccactgttaaaagaaaaacactggacacaatacttttaacagagtttatgtgagcattagaggattcatgaattgggcagcacccagaaccagaaaaggttcagagagctctacccagcagcatgggtagtgagctttaataggcggaacgtggaagtaagacaaagaaaacatatttgatttgttagagtagaaagtccctagttagaggttagttggaggtttctgatggtaacttctctagtttcattttactgttcacattgggctttggtttgcttacctaggaacttaaagtgctgggaatgcttcggcttaatgacctcccaattaaaatttttttaacatcacttttatttatgatctacaaagtggcaactgcctatttttttttaattttattattattatactttaagttttagggtacatgtgcacaatgtgcaggtttgttacatatgtatacatggccatgttggtgtgctgcacccattaactcatcatttagcattaggtatatctctcagtgctatccctcccctctcccccaaccccacaacagtcctcggtgtgtgatgttccccttcctgtgtccatgtgttctcattgttcagttcccacctgtgagtgagaacatgcagcgtttggttttttgttcttgcaatagtttgctgagaatgatggtttccagcttcatccatgtccctacaaagcacatgaactcatccttttttatggctgcatagtattccatgttgtatatgtgccacattttcttaatccagtctatcattgttggacatttggcttggttccaagtctttgctattgtgaatagtgccgcaataaacatacatgtgcatgtgtctttatagcagcatgatttataatcctttgagtatatacccagtaatgggatggctgggtcaaatggtatttctagttctacatccctgaggaatcgccacaccaacttccacaatggttgaactagtttacagtcccaccaacagtgtaaaagtgttcctatttctccacatcctctccagcacctgttgtttcctgactttttaatgattgccattctaactggtgtgggatggatggtatctcattgtggttttgatttgcatttctctgatggccagtgatgatgagcattttttcatgtgttctttggctgcataaatgtcttcttttgagaagtgtctgttcatatcctttgcccacttgttgatggggttgtttgtttttttcttgtaaatttgttggagttcattgtagattctggatattagccctttgtcagatgaataggttgcaaacattttctcccattctgtaggttgcctgttcactctgatggtggtttcttttgctgtgcagaagctctttagtttaattagatcccatttgtcaattttggcttttgttgccattgcttttggtgttttagacatgaagtccttgcccacgcctatgtcctgaatggtattgcctaggttttcttgtagggtttttatggttttaggtctaacatgtaagtctttaatccatcttgaattaatttttgtataaggtgtaaaggagggatccagtttcagctttctacatatggctagccagttttcccagcaccatttattaaatagggaatcctttccccatttcttctttttgtcaggtttgtcaaagatcagatagttgtagatatgcagcattatttctgagggctctgttctgttccattggtctatatctctgttttggtaccagtaccatgctgttttggttactgtagccttgtagtatagtttgaagtcaggtagcgtgatgcctccagctttgttcttttggcttaggattgacttggtaatgcgggctcttttttggttccatatgaactttaaagtagtttttttccaattctgtgaagaaagtcattggtagcttgatggggttggcattgaatctataaatcaccttgggcggtatggccattttcacgatattgattcttcctacccatgagcatggaatgttcttgcatttgtttgtatcctcttttatttcattgagtagtggtttgtagttctccttgaagaggtcattcatatcccttgtcagttggattcctaggtattttattctctttgaagcaattgtgaatgggagttcactcatgatttggctgtttgtctgttattggtgtataagaatgcttgtgatttttgcacattgagtttgtatcctgagactttgctgaagttgcttatcagcttaaggagatttggagctgagatgatggggttttctagatatacaatcatgtcatctgcaaacagggacaatttgacttcctcttttcctaaatgaataccctttatttccttctcctgcctgattgccctggccagaacttccaacactatgttgaataggagtggtgagagagggcatccctgtcttgtgccagttttcaaaggtaatgcttccagtttttgtccattcagtatgatattggctgtgggtttgtcatagatagctcttattattttgagatacatcccatcaatacctaatttattgaaagtttttagcatgaagcgttgttgaattttgtcaaaggccttttctgcatctattgagattatcatgcggtttttgtctttggttctgtttatatgctggattacgtttattgattttcgtatgttgaaccagccttgcctcccagggatgaagcccacctgatcatggtggataagctttttgatgtgttgctggattcggtttgccagtattttaccgagaatttttgcatcagtgttcatcaaggatattggtctaaaattctctttttatgtggtgtctctgccaggctttggtatcaggatgacgctggcctcataaaatgagttaggaaggattccgtctttttctattgactggaatggtttcagaaggaatggtaccagctcctccttgtacctctggtagaattcggctgtgaatccatctggtcctggactttttttggttggtaagctattaattattgcctcaatttgagagcctgttattggtctattcagagattcaacttcttcctggtttagtcttgggagggtgtatgtgtccaggaatttatccatttcttctagattttctatttatttgcatagaggcgtttatagtattctctgatggtagtttgtatttctgtgggatcagtggtgatatcccctttgtcattttttattgcgtctatttgattcttctctcttttcttctttattagtcttggtagcagtctatccattttgttgatcttttcaaaaaaccagctcctggattcatttatttttttgaagggttttttgtgtctctatctccttcagttctcctctgatcttagttatttcttgccttctgctagcttttgaatgtgtttgctcttgcttctctagttcttttaattgtgatgttagggtgtcaattttagacctttcgtgctttctcttgtgggcatttagtgctataaatttccctctacacactgctttgaatgtgtcccagagattctggtatgttgtgtctttgttctctttggtttcaaagaacatctttatgtctgccttcattttgttatgtacccagtagtcattcaggagcaggttgttcagtttccatgtagttgagcagttttgagtgagtttcttaatcctgagttctagtttgattgcactgtggtgtgagagacagtttgttataatttctattcttttacatttgctgaggagtgctttacttccaactatgtggtcaattttgaaataggtgtggtgtggtgctgaaaagaatgtatattctgttgatttggggtggagagttctgtagatgtctattaggtccgcttggtgcagacctgagttcaattcctggatatccttgttaactttctgtctcgttgatctgtctaatgttgacagtggggtgttaaagtctcccattattattgtgtgggagtctaagtctctttgtaggtcactaagggcttgctttatgaatctgggtgctcctgtattaggtgcatatatatttaggatagttagttcttcttgttgaattgatccctttagcattatgtaatagccttctttgtctcttttgatctttgttggtttaaagtctgttttatcagagactaggattgcaacccctgcctttttttgttttccatttgcttggtagatcttcctccatccctttattttgagcctatgtgtgtctctgcacgtgagatgggtttcctgaatacagcacactgctgggtcttgactctatccaatttgccagtctgtgtcttttaattggagcatttagcccatttacatttaaggttaatattgttatgtgtgaatttgatcctgttattatgatgttagctggttgttttgctcattggttgatgcagtttcttcctagccttgatggtctttacaatttggcatgtttttgcagtggctggtactgcggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctggattgaaaattcttttctttaagaatgttgaatattggtccccactctcttctggcttgtagagtttctgctgagagatcagctgttagtctgatgggctttcctttgtgggtaacccgacctttctctctggctgctcttaacattttttccttcatttcaactttggtgaatctgacaattatgtgtcttggagttgctcttctcaaggagtatctttgtggcgttctctgtatttcctgaatttgaatgttggcctgccttgctagattggggaagttctcctggataatatcctgcagagtgttttccaacttggttccattctccctgtcactttcaggtacaccaatcagacgtagatttgggcttttcacatactcccgtatttcttggagactttgtttgtttttattcttttttctctaaacttctcttctcgcttcatttcattcatttcgtctttcattgatgatatcctttcttccagttgatcacatcgactactgaggcttgtgcattcgtcacatagttctcgtgccgtggttttcagctccatcaggtcctttaaggacttctctgcattggttattctagttagtcattcttttaatttcttttcaaggtttttaacttctttgccattggttcgaacttcctcctttagctggtagtttgatcttctgaagcctccttctctcaactcgtcaaagtcattctccgtccagctgtgttccgttgctggtgaggagctgcattcctttggaggaggagaggtgctctgatttttagagtttccattttttctgctctttttttcccccatctttgtggttttatctacctttggtctttgatgatggtgatgtttttggtgtggatgtcctttctgtttgttagtttttcttctatcagtcaggaccctcagctgcaggtctgttggagtttgctggaggtccactccagagcctgtttacctgcgtatcagcagtggtggctgcagaacagcagatattggtgaaccgcaagtgctgctgcctgatcgttcctctggaagttttgtctcaggggagtacctggttgtgtgaggtgtcagtctgcccctactgggggggtgcctcccagttaggctactcgggggtcagggacccacttgaggaggcagtctgcccagactgcgtgctgagagaaccactgctctcttcaaagctgtcagacagggacatttaagtctgcagaggttactgctgccttttgtttgtctgtgccctgcccgcagaggtggaggctgcagaggcaggcaggcctccttgagctgtggtgggttccacccagtttgagcttcctggccactttgtttacctcctaaagcctgggcaatggcgggtgcccctcctccagcctcactgccgccttgcagtttgatctcagactgctgtgctagcaatgagcgaagctccgtgggcataggactctccaagccaggtgcaggatataatctcctggtgtgccatttgttaagcccgttggaaaagggcagtattagggtggaagtgacccaattttctgggttccgtctgtcacccctttctttgactaggaagggaatttcctgaccccttgcgcttcctggatgaggcgatgcctcgccctgctttggctcacgcacggtgcgctgcacccactgtcctgcacccactgtccagcactacccagtgagatgaacccggtacctcagttggaaatgcacaaatcacccatcttctgcgctggtcatgctgggagctgtagactggagctgttcctattcggccatcttggctccacccccccggcaactgcctattgttttacctgatatgcacaacattggccattagtgttaccaaagcaacatccatcacaagaattaatgcttcttgatttgaattttactcctctctgtctctgtttatgtgcattcatttgattgtacacttgtataagaactaaaagcataaaaagtttattcctacatctggcacagctcacgtctgtaatcccagcacttcgggaggccaaggcgggcagatcatgaggtcaggagttcaagaccagcctgaccaacgtggtgaaaccccaactctactaaaaatacaaaaattagccaggtggggtgttgcgtgcctgtaatcccagcttctcaggaggctgaggcaagagaattgcttgaacccgggaggcggaggttgcagtgagccaagatcgcactgcaccccagcctgggtgacagaatgagactctgtctcaaaaaaaaaaaaaaaaaagtttattcctagttttacatttgtagcattgaaattaaaagaatctaaataaataacagagcactgtgagaatttgttgtttaacagagctctatatgcattacacaatttcaaggaacattgatctgaatgttcctatccctcatggaccttgagccctgacaaaagttaataaagatgggtctccttttcttcttgtcccctgctttcagctctgaatgagaaaagttttgcaaatatgtcggtactttgtattaagcctaaaacttataaagtatcagatttgtaagttgactgtattaactttaatttctcaaagtgttctcagttaattaggttaacctaaaactaaaactataaagtgattcctcccctaccaagaaaaaaaaaattaagctgaaatcctctgtttagagtttcaggcctttgggctggactccacaacccttctcaggaagtagcagtagacacctgaccttaggctgtagtgctaatataacctgtgtcagtagctgccccattgcaaacaaggaaatgatcctctgaagtcaaactcaggaaggaacaagaacctgtctctctgagctctctaaagagtgtggttaagagtatgagcattgacaacagactgcctaggttcagataccacctctgatgccagttatgtgattttgggccagtttcttaatctctcaatgtctcaacaacatgagtctaataatagcatatatacccctataaccatggcatgaggattagacaggttgattggtgtgtataaaacacttggaacagggcctggcacagggtatgccttagtagatgttagcactgcatcacgactgctactatgattaccgtccctgtcactgttgctgctgccaccacaggcaggtcagtggaacgtcacccttcagggatttatcagcgccactccctaagcatgccacctgcatgaagggcagacatgaaattgtgccgccagcgttctggtttcttcagcgctccctgccagctgagctgtgtgaaaagcactcagctatgaaaaaatgagaaagattgattgaaatgttggtgaggtcattgtcaaatattctctgtcaactgaatgactgcaaatagggagatgactgcccccccaccaagtcagcctaggagggttcagtccttcatttattcattcacacatcactccttcactgtgccagccagccatgacaattaagtgcatttgggaggaggtggcagctgagctggaaagggggtttggcattatgctgggaaggtgtaaaaagccaggctgaagatttgggccgtctttttttttcccccagatagtggggagctggatttggagacaagaaacctttgtagaccctctggcactctctattgacagatcactgctaggaggcagtgtgactcggagaaccgcatgggctccgccaccagctctgggttccgcactcattagccagatgaccttgggctcattatttagcaagcctgcacttctgtttcctcacctacaaaatatgcataaaatagcagtacatacctcacggagttgttctggggcttaaatgagttcatctgtgcaaacatttagacgaagtgcttgacataatcagagctatgtaggtgctgttaattcttctttgccccactggtccccaggttccatatctgtaacaagaagcaactggaccacataatttcacatccttttatacccaagtttttgatcaagagagctcaggctgtactttaagcttaatgtgacagtgatttatagcatagcttgggggcgatctgaacacttgggggcagaaaaacaagttaggctttccctgtttccatcattctcccacctttcctccatctgcctgtccccacctggacatacatgccaaaagccacggcccattttactagatctaggtagtatgggaaaagaccatgaagcggacacatcatctgtactgccagtgtctctcttcaaaataaactttttttttttttgagcctgaatctcactctgttgcccaggttggagtacaatggcatgatctcaactcactgcaacctccacctcccgggttcaagcaattctcctgcctcagcttcccaagtagctgggataacaggcacctgccactacagccggctaatttttgtatttttagtagagatggggtttcaccatgctagccagactggtctcaaactcctgacctcaagcaatccacttaccttggcctcccaaagtgctaggattacaggcatgagccaccgcgcccggcccgcttcaaaataaacttctttaccaggaaataggattaagaggaggtagaaggaaattagagtaggatcagaaagatagaaaaaggagttttctctgaaacaataggacagccagatacaggctgagcaggcccaatgatggatagagaggcacatccactgctgagctctaacctagagagagaatgtctcaaaactccttgcatggaaggtgcctggaaatgtatttattctcctgttgtttattctcacctctcttcattcctttttctttcttctgtccttgaatcgcagcagataaaaagacaaatctgctgagaggatgcatgtcacaagtggtcagatgaattacagccatagcaccatatagataagaggcaaggctggcgcctgggcaggtctgagagggtccaggaggacacacaccatatcaaattgtgcaatttagcaaatggctggtggcagactgaaatgatagttaatctgttttccatgcactaaaggcttttgccaaactaagatttgctgtgaagacccaaagctggagcccacccagggagcgggctgccttggatgcgtttcccagccttctacagtggatgccagtaaaactaactagagacatgaatgggcaccaggataaacacaaggggatattttgttcttaccattagagaaggatactgctaactggcaagaagtcccatggttgttatcttttgattagtagtagtaaaaatactatttaaagctagtagcattttttgagagcttgctttacactgggtactttttcaagtgtcttacaagtattcgctcattttatctgcacggcagctgtatgaagagaatactgtcattatcttcactgcataggtgagcaatggaggcacagagaagttcagcaacttgtccaagctctcatagctgggaagtggcagagccaggctttgaactcaggcagtctgactcagagtccaagactgccggcctgaattgtaggagagagacagtgcgggtataccaggaaccaaatcctatcggctgaacatcagtgtttaagtcgagcccagatgctctgcacaaaatacaatgtgtctgtgcacatgtgactgttaatcagccatttccttggttcctgctttgtgctggccactgagctggaccctgtgggatggataaatcaatgtcagtcatgcccctggagacctggctgttgcaaaaaggctcctgaaatcatcataacccaaaagagaaaagggcaggtgctgaagagaagtataggtaaagagcagcaaaatcataaaggaggggagactctttgcctctgtggtatcagggaatgcttctcagagcgggtggcgtttgccctgagacttgaagtaggaatttaaaaacatagaaatgcagtggaacgggaagaaggacattctaggtggagagaagtagagcaaaatggtccaatctgcccccctaagggtgtgagacagagaagtggatgggaaggccaggaaggctgtcgccatgtgggccgaacatggggagggaggtgtttgtcagaatcagaatggactcagagggaagctgagctaaaagcttcaatttacagatgaaagaagaaagaatttggatatgtgactcactcagtgtaccaagttcgtggcagaagtaagtctcaaaccccaggcttgcctccaattttctttgcactgatctcctggcataaacatgtggctaacaagggtctcacaatgccaggagggtgttacgtttttataacctgttctatttgagggtctccaaaattacatatttgaagttaatattagccagatgctaactgtctgcaggcaagaataagcacccactttacattgggagaagctagagatttgggaatcaggatttgctgcagatactttgaggaatctaggcctctaatccacagtctcctaaattctggaacttctggcttaattacactttttaataaccagtcatcattgctgcataatttgtgaggtctggtatagtatgattcctgttcccttcagctaaccctgcccccacccccatcctttaataaacgtaaaacttttctttcctgtgaattcatttttttcccttttatcttttggacctttgcaattaacatattaatatttaattcatattacctgaaggtccaagaacacttttaaactcatgaaaaaccttcactagtaatttagctgctaccaaggtatccctgagccctcattatttgcctctggaaaatgccgtaaacgacatctaacaggcttcagctctgtacctctacaaataagaaattaagcagtattcagaacgccattgattattaatttaaaagaaatcaaaaatcaatatcacattcctgtaacctggcagtttttcttaactgaaggcagttgcctgcagaagccttgtggctttccagagcaacggcgccccttcgtggtgataatgtgaactgcaccccaggcgtgattgaaaataaggcagaaaggaatgccggcctcgagcaaggacaccggttcatgcccaaatcacttctgctttcagccaacagactgtttctgccaaaagatggacgcagctagattttttttttttttgtaccgataatctgtcttaaaacttggagaggatctcttttcccctgtgaagtcaggaaaatgacagcaagcagcatggattggttcgaataattttcaccagaaatgtggggtgaggggaagggatgggactggagtcagagcagtgatctggcgggatggggtgatgagccatacggagatgaggtgtggcgccacgggctgggagtcagggattatagagtgagggtggggtaggatcttcctggtcatcaaaactatgagaaatgtaattatttacattttaaactaagccaaagactgtattgaaatgtcttacacccagaacagagaagtggtatcaccaaagttcagaattcccagctctaacgtgatgcctttggggactgcctccccaccccaggctgacctaacacacccctttgagaaaagaggatttagtttctcctgactgtgaattgaatatgtgggatgtgcccctccaggagcttctaaaatcacctctgctttgaccttgaggggccgtggtagaggggagacagcaccggcttagaaaccccacggctcggctctagtcccagcatcagtggagcaccaaggggagaaagtattcatcactgaggtattttatgatatgtatattgttcctgggcagttgcaccccttatcgcctgcaccctgtgtacagctccccattcctcctcccttggaggccactgtgctatgtaacttgctgtgggctgcaagaaagactgggctcccgtttcctcttctgaaaggcaggaatcatgctcccggctgacctcacagaatcattccacagattaaatggcgatatggcttgtctgtgttcacactcaaatccacatgttgtgggagggacctggtgggtggtaattgaatcatgcgggcaggtctttcccatgctgttcttgtgatacagaacaaacctcatgagatatgatggtatcataatggggggaggttcccctgcacaagctctccctttgcctgctgccatctatgtaagacatgacttgcacctccttgccttctgccatgattgtgaggcctccccagccacgtggaactgtaagtccattaaacctctttcttttgtaaattgcccagtcttaggtatgtctttatcagcagcatgaaaatggactaatacaaatgggatgtaaaaataaaattcttatatacttagaacggcaatatgagctttacatctgagttatgctataatatcaatcaacatatataataatataaagtagtatatttattataagttataataacagagtgagatagcttagtaatttcttgttagtatctgcaatcttggggaaaacaaatctagagaaataagtccaaactggagctgcagagtcaagtgggcgagagaaagaagtctcgctttttttgttttccaggaaagctcaggtccagttcagcaggccagcccaagagactgggagagccctatgtactcaggagagcagcctcacccctcgtccttgtccaagattggggagtgggtgcccacagcttgtatgtgtccccatgagagtgggtgtcattatgaggagcatcaaagggccaagcacagtggtgacagatgtgggggaatttgccattctgagggcagaggaggtcaaacacaagtggactcgcttattaagcccagaaagagaactgggagaggaaggccaagtgaggatggaggcggagatccagggcccatctgcaagtcaaggagcaccgaggatgctcagcagcagagccaggagagggcatggagcggactcgcttgcagagcctgtagaaagaaccaactctgccgacactttgatttttaacttctggccttcagaactgggagagaataaatttccattgttttaacccacaaaggaagaaaaagactatcaagagtagaagggcctgacaggtggccacacggcaggtgagtcagagagttgagtcacgtgggaggtagtttagaaaaggatttgtgaagagggccatcccctagcagcgtgttgaatatagtgaggaatatgagatggaaaagaatctttttagagaacatgggtgccagacatagccacagacaaagtcgtgaaatagacagaaatttgtcccatttatggagactgtggttttccacccatatgtccccccaccccatgtcatgtttacctggccctcaggctcacgctgatggccctgggctgcttttttcccctcaaaagctgatgtctggtctctaattataagatacaagatgagatggaaataattgttaacaatgtattcattcaacaatggattgtgtaaaaaaaaatgtggtacacatacaccatggaatactacacagccatgaaaaggataaagtcgtattcttcacagcaacaggaatggagctggaggccattatcctaagcaaattaaagcagaggcacaaaactcaatactatgtgttctcacttataagtgggagctaaacattgggtcctcatggacacgaagataatagtaactgacactgaagactactagagggggtagggtgggagggggacgaggggtgaaaaacaaccagcaggtcctttgctcagtacttgagtgacgggatcatttgtctatcaaacctcagcgacatgcaatttatacatataacaaacctgcacatgtacccccgagcctaaaataaaagtcaaaacaaaatattcattcccaaatcatttactacatacaaatcgttaagtcaggatccctgctgtgacactagggattatagaagtgttgaaagcttcattctcatccagtcattcattcagtgcctggctggggttgtgataagcaaaagcaaacccatccctctccacatgtagcttccagtctcgtggtggcatttcctcagaggatgaagccatccaggtagcatagcaggcatgaggtggttccagtaaatggaggtgggacagtctccttgggctgccaccctgcttggggctattcctggtagggcctggagctctgcctagagaagcccacatgccctctcctggagtcacaagggcaggccaagtattctgtcctattccagtctttgctagaatgtgtcaagtgctgtgggcttgagtccttggcaatttttgcatgggacttagtttgggggtaagttttctggaaacttgaaatgtttcacttaaaaagaaaaatgcaggattcaaagaagtaaagagtaacaaataaatagaggcttttttagttcaggggtcagcaaactgagggcattgcagctgttctggaattaatgcgtgtccgggcaagggtcagtaattctgagatgccgttctgttgctttcaggccttttttggtgaaaactcttaaaggaggtataattcttcccttgctgggagtctttgtttcagaggggttgtaaaaaaagattcccagaggataaatcatatctgtattaacttcctaatgaaatgaaaaattatatcattgctgattattcctccttggctgatatggaaaaaaatactattaatactttttagtgtgattttaatcctttgcattcacggatatttgcattagtattttctggacatcatcttgtttatatggattttattcattgtaagatgccatcagatccaggcatctgagttctgggggggcaatgctataatccctgcccagaaccaaaactttccctgtgcagatggtctttcaatagagtggaatgtgtttggggtttctgcatatttcagtttacaaacccttcagtgatggttgtcttcatcctgagtttggctccatgcttcagaagatgcaacagtgctgagaacggtgcctgacatgcaggaaacattcagtaagtgtttgctgaatgaatgaataaattaattcaacaacagctaatgaaagcacatcccttaaaaagtctcggcaatattgcgagcataataccaaaggcagaaaccataaaagaaagaattgatggattggaaggggaaaatctttttttttgagacagagtctcactgtgtcacccaggctagagtgtagtggtacaatcttgactcactgcaacctccacctcccgagttcaggcaattctcatgcctcagcctcccaagtagctgggactacagatacacattgccacacccagctaatttttgtaattttagtagagacggggtttcaccatgttgcccaggctggtctcaaattcctgacctcaaatgacccacccacctcagcctcccaaagtgctgggattataggcgtgagccaccgcagccggccagaaggggaaaatcttataacatgaatttcagataaactgttacatccttaatacttaacgaattcctgttaatcagtatacaaatattagtacccaaatagaataaataccgatggccaataaatgtattagaaacatttgaatctcacttataaaaacatagttattttcctaaatggggtatcattttttcccaatcagattggcaaaaataaacaagaatacaaatccagcctagcacatgtacgtactttcaaagggaggataatttggttcaacatgttttgaaagctggttgtatggtatgttttgaaaccttgaaaatgacccagaaattttccttctagagatttatcttaaggaaattataggaggcataaaaagtttcacctgcttattgctttgtggcttatcattgcaaaaagaaaatggaaaactacttcttcagctaaaggaagtgatacgctatcgtactagaatattaaaaatgaagaaggtagggaaaagagaaagagaatctaagcggtaaaattgtttgacctttattttcttctttttgcttagctatattttctaaagtttttgttaaaataaactcttttaacaaaaaaattctaaaaactcatagctgcttagatgataatataattataatatttatgttaatttttgttgcgaacgtatgtttatgttgaacttaccaagtgatctaagctatattactaagttcttttcataagcctctgagttcatgtatattaagcccttaacataattcttagagttaagcagagcaggtggcgttattcttccatgaccgcactgagactcagaaaagttacatgacttattcaatatcacataattaataaagagtaagactggccacaaagtccaggatgccacacacatagctgagtgcttcttcctctatcatagaaacaaaaatctggatgaccattaggccgttgttggcctgcaaaggtgtagagcaaactattttatggtattgagagcacttatcttggcattactccatctgattgtttgtgtcaagtaggaaagatacatttattattcccattttgtagatggagaagctgaggctcagagaggttgagtgacattcccaaggttgtacacagtaagtggtaaagttaggatttaaacagttttagtccgaatcccttgctctgtctacttcagtttggcataataaattcttaacttccttaacagtttgtcccatcatattcctaaagttttatgatttgatgaagtctctcttaagctccttttccacatgggtggcatgggttagcaagattttgagggctgatcttgtgtgacagattgtatttccaaagatgtctggaataatatcttgtgtcccacatactgttgtggaactatcacctctccatcccaaaaggtggaacagaagcaacactatgaaactgccaaggctaaatcataaacattcaatgcacttctgccttgctctcttgggatgtttgtgcttagaatccagctgccctgctgtgaggaagcccaagcaactctgtggaaaggaccacatggaaaggaacagaagtgcccagctcacatccctggctgagctcctggccatcagcctaatttgctggccatgtgagtcatcttgaaagtactgtaggttcaaggtttactttctgaggtttcagttatccatggtcaaccgtggcccaaaaataggtgaatatagcacaataagatattgtaagagagagactatataacttttatttacataacttttcttacagtatattgctatgatttttctcttattagttgttgttaatctcttatgactaagttataaataaaactttatcataggtatgtatgtatagaaaaaacatagtatatgtaggattcagtactatccgctgttgtaggtatccactgggagtcttggaacatatcccttgtggataaacagagactactgtagatcctcctgctcctaattagcctaccctaactgatgttgcattgagcaaagtgaggtgagccgaccaacctctgcccaaattgcagatttctgtgtaagataagtgattattctgttgggggtagtttgttatactcattttccctcctaaccccaaattaggtggcagggatggaggagtcttgcttatcatctctctatttttgttaactcctcctcgttcagggtagactttggcacctggatcacaaccttattctccaccccaaacctgccattatccttggtgacaccattatccatgaaggggacccatttgatatgttagcttctcagttccctgtcttctaccccaaagtccttcaaattcaaagtatcttactctttttgttttaaaattgcttggagtagtagagaggactctagtggaatatacaagccaaaataatcaggaatttttacatgagagaaaggaggaatgtcgtgaagggcatcaaaaagcaagaaagatgctcattttcccttccaaccccaatttaggtggcagaggtgggagcaggtgaaaagaacaaagggcattggaaaagaccacctggaagtcagtgaagaccaagcggtaaagggatccttagcttaggcaaaggctagatggggacttatctcaccaatggagccagagaacagatgttccagatgtgtgtgtggaagtgggaagaggactgattaaggaaagaagaagctcaaagcaatatagagatgagacagagaaataacaggattccagaggcacttggattttactcaccaaggatgagggggaattagttggtctcaacatttctaacggcaaagttacaggtcacctaatacatatttatgtattagttggatcagaggatggatggatggatgagtgggtgggtggatggtagatggcagtggatgaacagatgaatgaatggacagatgtgaggatttctctgtgggagattcagttcgcccaggagtgatggtgtttctgagagagccctagcagcatttgttatctcctaggctctctctgaatgttcgaagcagtgagtggcaaagaggaggctcagccctctctggattgatctgttactggggtgtacaggcattcagtgcagagttctcttcatcaatggtcaaataacttctgttacccacttgtgatggctcctgtagcctctggttcgactccatgtaacaactgaagagcagccttgctgcaacagataggaagcaggtcttatctctgatttgagaatagaaggcccggtgggtacaacctgtagcactttcaatcctgtagaaatatagatagtgatgctgttggtaaaaaggaatccaccctttccaaactttttcctaagtcagtggttgtcaactggatgaggtcttgctcaagcacaagtgtctggacccctcctctagaaggagtgattctgcaaggctgagcaagcctgagaatgtgcatttctcacctgtaatcctagcactttgggaggccaaggcgggtggattgtctgagctcaggagttcaagaccagcctaggcaacatggtgaaaccctgtctctactaaaatacaaaaaaagtttccaggtgtagtggcacacacttatagtcccagctactcaggaggctgaggcacaagaattgcttgaacccaggaggcagaggttgtagtgagccaagatcatgccactgcactcaagcctgggtggcagagcaagactctgtctcagataaaaaaagggatgtgcatttctaataaattcccaagtgatattgatactgctctaggaccacactttgggaatcacttccatcctgcatggctaggtttaaattaggcattcttaacttcatatgtggcagggtgagtggatgttgagggccccaggtatattcttgaaaaacaaaaagaagtcagtgatcagttaattcattctagtctcctgctgagactgttgtctggcttatgaaggccaggatttttgccacctgaggcatttggagaagcctatgaaggagagtagaggagaggttggggacaacagaatgaagccagccagaaaaagagactgggcatagggggaatgggaatttgaggagaaacatatcattcatcagaacttaaatctgcatttttagagaagatattataatgtgcttacgtggcctccagatgtgcacaggtgccataggatagaagtagcccagggaagccttgtcatagatgggctacataaataggaaggcttgcagcagtgttaaaagacagctgatatgattaggctttgtgtccccacccaaatctcatcttggcttataatccctgtaatcccgttgtgacaagggagagaccaggaggtaactgaatcatgggagcggtttcctccatgctgttctcatgatagtgagttctcatgagatctgatggttttacaaagggctcttccccactttgctctgcacttctccttcctgccgccttgtgaagaaggtaccttgcttctctttcaccttctgccacgattgtaagtttcctgaggcctccgcagccatgctgaactgtgagtcaattaaacctttttcctttataaattaaccagtctctggcagttctttacagcagtatgaaaatggactaatacaacaccctccatgcaacctggagaaaatgcaaagtacatatagctctcaaacttcaggaaggggatccatatatgcagacagccattctttaaaataacctttccattctcccatccacttcgctcacacgtgatagatagtctgtattatctcttctctaacatctccacccaaaactaaacaaaacattaaaaccctccagtcattatttaacttgcctctttcttcacctcacttccagtttctccccgattcacattcacaaaagcccaagaatgttatggctgatcaaggactctcctttgagggtgggaagaaactgcaggggtcaggccagaattctcttctgcagacagaggagggggaaagacaggaaataagcatgcacaacgttcacctttgttggctgcacaacagcttgggatgtgcacccagccctaggtctccagctgagatgtcctcagttgtactcagcaaaattgccaccttttctgagttatgaaagccttctctcctagagccccagtatgttcctggcacctgcaggcttttgggttttggttttggggtttttttctgtgtggtgttgttgttgtgtttcttcaccagggcatgagtagacagatcctatgcaggcactttctttgtgatcttcaggatcatttgttttatcttgcctcccaaatgctgatcacccatgggcatgcttcttgagggttgcaaccatggctttaaaacccagaacagctggtgtctgtggtctgcagggcccagaaaatattatttaatccaggaaacattcctttgttctgctctgcttcattcagacctctcctgggtcttttccttcccctgctggctatcgatttccatccaactgaaggggtgaagttcagaagcccaggagacagcctgaataatgggtatgcaagtgttgcatcacacatgcagcaaacatttattaagcatgtatactatacagggctgcaaaagtccatatgtactaggatcttacagtacacttggaaacaacaaggaatctgggtatgaggattctttaggtggaccagatgcctgctctgtgtagcagcagaactcttcaatatggactgtaaccacctgctccaaaatcaccctggggaattgtgaataaaatgcagacttcaaggctcatcctatacttgatgagatagggccctgaaatctgctatcttaacaagcacccagttggtttggctcttcatttttctttttgagacagagtctcattccattgtccaggctggaatgcagtggtgcgatcttggctcactgcaacctctgcctcctatattcaagtgattctcatgcctcagcctcccaagtagctgggattacatgcatgcaccaccacactttattttgttttatttattttattttattttattttattttattttattttagtagacacgggatttcaccatgtttcccaggctggtctcatctcttggcctcaagtgaagtgcccacctcagggacatatattgtatggtactgtagagtgctttatacttatctttctcctaaccagatgttagctcttagaatctcatcctcctactttccaaggtccctgcacccatcaccaggcccccaagggatatggacagggagagccctctggccaaattctcgctggatctcccagtggccgttcagcttggaccgccttttctcctcttattccagtgatagtccaggatatctttttgccttttttcccttaagacttccctggtcttggtatttgggattttctcattttgaatctgggggtgaagaggggaatttaggggatattggtcacttgtcttctgtgtccaaatgtgagtgtcttgctttggattaggaaacccctaactaatgaatgttgttaggggctaagaccactccaacagtagaagctagaaatcttagatactaccttgcccatctctgggtgcagccaggacactgaatgtgattcaggctctgctgattagatgtgtccctgttagacattgacatagaccccaggagccagggttataagggacaggagtcctttgtcctctggcaagggtaatttcctcctcagaaccagtcctgggctatgttgatgggcgtggcccagttgccttgtaccaagtcagttttctagtcctgactagaaattgttagttctggcagctaacaattctacatgatccaaaaaagtgagggatatcatttaaggagggagggagacagcctctgccttggtgtctcaccttccaggagtaaagacgtgtcccaagtaatgggtagctccatgcacaagagaagagacagtggagaagataagacatgcaagaggaaggatcatggaagagagacccagaacatttgcttaaccagatctatttataagttttagtccttaatcagaaagcaatgtatctttcttagaacagtaacctcataatgcattcctgaggagcccagttagtccttgctcctgtccatcccacctccttcaggcggtagaacagaagaagggtcttcatctcaccccagctaaagcatctctgcttccagaaagtgtggatgagtgggagccataaacctgggaaataagccacatgctacccttttggttgttgtttattttaacaaaattctatgaccccaggaccatgtttctaagagtagccacttgaagcagaaggaaatatttagtcaaattctacaatcacagccaaatacagtctaatggcagccagcagacactgtggaaagagagtgtcacacaccattctaatgtggggagtaaggatgatgaagaatcagtcataggtccgtgttgtagctccgtctggggagtggaactcatagggtataagtgattatttcctattcatttccttagccctgaaccgtccaatgaccacacgcaacttgactggcaagaggtgtttagaatgttgagacacggtcagaaatgattggtggtttcatgtgatgcaaagaatttcccatactccgcctgttttctggatcacctgtccccagaaattgcctgaaaacaaatcacaggttgaaactagaaataacttccctctcctaggcagcttggagactggccaccctgtttcttggtttggtaagaatgttccagacacaaggaggggagcaacacacactggggcctgtcgggggttggggtatggggagggagagcattaggaaaaataactaatgcatgctgggcttaatacctaggtgatgggttgataggtgcagcaaaccaccatggcacacatttacctaagtaacgaaactgcacatcctgcacatgttaccccagaacttaaaatgaaaataaaaattaaaaaaaaaagaataatccagaaagtcaagaaaagcctaactaaaaaagtctttttaggcaagagagcatcgtaagtaggatgtagaggaagctcccctgcttaaaacctgttaatggtcttctgtagctttcaaattctagctcctcttgcctccacgactcaactccccagccctccttccgagtgtacaagatgactcaccctgagtccagagccaaactctcggtttgcatcccagctctttgccacttactacagaccatgtgaccttgggcaagtcacctaacctctctctgcctcactttcttaatctgaaaagggggggatgatgaccacccgtttcatcaggttgctgtgcatacaaatgggcgaatatgtgtaaactgctgagaacagtgcctagcaaatagtaagccctatgtaaatgtttgctgatgttgtgttccatgattccgtggctttgaagatgctgctctctcatcctgcaatgccaccttaccttacctagcaaattccaacgtgtccgttaacattcagctcaaggctgggcacagtgactgacatctgtcatccccaaactttgggaaactgaggcaggaggatctcttgagcccaggagtttgagatcagcctgggcaaggtagcaagctctcatctccacaaaaaaattaaaaaattatccagaggtggtggcatgcacctatagtctcagctactccaaacactgaggcaggaggatcgcttgacaccaggaatttgaggctacggtgagctctgctctcacctctgcactacagcctgggtgacagagcgagaccctgtctctaaaaagttttcatttttaattttttaaaaaatgtttttaatgtatctcaagccctacctccttcagcaaagtgttctgagcacccaggtctgatgtagggccttgtccatgcttcctgaaaatatatcttctgtagcattcaatgcactggaatgcctatgttagctgaaagttactgatcacaattccggtggcctggaggattggtgagcccagctgtgaagtttagaggcttgctatcttgcccaggctgatctcaacaagtaaacattagtttattcatctgtcttctccctggtttcaagcccctggagtgtagggccacatcttacttggcattgtatccagcagtcaacatagtcctagaatatagaaggccctcatgttgaatgaatagtaaaaccctcctgaaatccattaaattcatatgtttatttactcactcattctcttcctttgttcaaaaaacatctcttgagcctctgtgatgtaaaccaagtgctttttaaccagcagcttctctctgatgatctatctgcaatctctgtgtcagtcctcacatttaactaggacaaaaagagaacatagattcttagtagctttgctcatgacctgactttaacaagaaaaattttagagaccaaaagtctgactgatagctgagtgagttctttctttcaaactcaaagccctgtttgagcctctaaacttcacagctgggcttgcaaatcctccaggccaccgcatttgtgatcagtatctttcagctaacataggcattccagaagatgttctgccctaaacgtaattggaatcctttttgaatcagttgccacagtacttctgaagttttttatgctaacttcttgggtatatttcctcaagatggattcaagatgtggccagttctcttgtgagaagaatacatttctgttgtcctaagtgtagagaccctctagttcatgtaatagccctgcaaagcaatctgctattaccagtcccagcatccatttctccttccttccttagtaataaaaccctgctttggctgagcaccttgttgcccagaattaaacactgttttaccagcttccctgatgggtgtggtcaggttactaagatctggccaaagatgtgtgtatgagttttctatgctgctgcaaattactacaaacttagtggcttaaaacaacacacatttatcttataggtctggaggccagaaatctgagatggatcttagagactaaaatccaggtattggcaacagaggtgtattcctcctggaagttattgctttttctagcttctcgaggtcgcctgcatttcttgtctcgtggccctttcctctgtcttcaaagccagcagctctctggcatgtttgtgcttctcattctcattctctctctctctcccaccccgcccccgcccctgctgtgttatcacatctcctctctctgatccttctacctctctttcataagaacccttttgattagatagaacccacatggataatctctccatcttgaggtccttaatcacatctgtaaagtcccttttgccatgtaaggtatcatattcacagttctggggatcaggacatggacatcggggggacattattctattgtcatgtataagtagagtaagtaagtagagtatggcattttcagaaatgtgctcaaagggaggtgtctcaactgggaaggaccctctttgacccttctgcctttcctttctaaagctgagatatgatggctgatgctttagcagccattgtgaaccatgaggtggccttgcggatggaagtcaagcactaggatggtagaagagaaacattaagatataaattcctgatgatgccatggagccaccttttaccaaatacacttctatcttgtttaagctactgccatcttatttgtttttttttttctggaacatacagctggacctaatctcaatcccttaaaactatacatgactctcttcttaataaactgcaaggctggttctctcagcctactaccctgcctaaggaacagataggtagtaagcatggatatgaccattgctcagaaaatgtgttccaaaaacagacagtatgtttatcatttattgatcagttcagcctctggctctgcctatacactgagccatacaacctcaatattaatctgggctgttaacattcttccagagctttgatcatggtctacatcttactccccggagaatcaggtgggcagaaatgggctactgacctatcaatttctagtcctgattagctcaaaatgtggtcatttcctcttaacataaatgtatttaacaacctgaaatagcaaatagcaaggtaactttccactgacctgtcttactattaatatcagaagtcagaggtggacctaaaaagtaaccaaacaatcaaaaccaatgtctgtaaggaaaaccagcatcgttattagtgacaccaagattcaaatcattgatttagcaacactccttagtgtattcatcagatgtttattggaaatctatggtgtggcctctgcagtgagtcagagtgcagagttgaagagatgagggtccctcaccttaagaaccctcactgcattaatggagagacagaccaagaaatgcctttgtggtttcaagaagtgcctttgttctgtttcatttttttattgtcaacaatcatggccaggcatggtggctcatgcctgtaatcccagcactttgggaggccaaggtggggggaatcacctgaggtcaggagttccagaccagcttggccatcatggtgaaaccccgtctttactaaaaatacaaaaaaaaaaaaaaaaaaaaaaaattagccaggcatggtggcgggtgcctgtaatcccatctactcgggaggctgagacaggagaatcgcttgaacccaggaggcgggggttgcagtgagccgagatcatgccactgcactccagcctggactacagagtgagactccatctcaaaaaaaaaaaaaaaaaaaaaaggaaaaaaaaaatcacaacctagattctgtaagcacctacagcagctatcctttgctggggtttcctcattcagctctctcctcattcattatctgggtcctattgtattccctttattagttttagcaatgtttaaaattatttgctgcttgaaatctaatccattttgcaagtaaccagcacctgggggcaggggtagtgatgagaaaacagggctaaaaggaataaattcacaatgagttttatatttacaccatccttttcccattcacagggttttcccatttgggaacattcttagcgtgttctctgaacagaagaccgtttctcttggtctgaagttgatcaatgtgagaggaagatggcacattagaaagatgcctggctctgatgacattccaccccgcagtcttccagcacactgggatctggggcttgaagtcacttgtctggctgtgtgactgtatccacttggaagcagcgtcccctgctcctaagttgcacaagatacttcagggagtctgctgtgatttagtgatagacaagtcagaaaacaagtttaaacttgttattaatcagaagagaacacagacatttttagctgtctatctgacttggtcatagggcagagccatcagatgccatcagtggtggtcggtgtagatttttttgtgaatcaagacaggagcaggaaaaaggggggtggaaataacagacaggttccaggagggcctggtggagggttcagctgttggagctcatttttcttgctttttcccgagagaggggaatggactgccattgtcacaggttaagtcacagaagagtgaagctcaggtgacaggagacattccaaattgagaacagacatgccaggggtccctgttgccacctgctcacaagccaaggccttggttccgagcccctcttctctctctgcattttctccttgggtgacctcatccagcctcgctgcctgaagtgcattcctacacaccagtgactctcaaatactatctccagccagctctctccccacaaatccagattcaacagccactccatgtccctactcagatggctcctacagacctcaggcgaaacatggctagcacgcaagcccaggtgtcctccccatcctgttttctcatctcagttgatgtaagctccaccgtgcacccaactagttaagctagaaacctggagtcactcgagactcctctttttctcatgggcaagccccatccatcagagaggaccaggagccttgcctccaaacccatttgcttctcttgatttcaccatatcacctgtgcccaaccagccttccatttctctaacccagtggacacagttccaaactggtctccttgcttctactcctctccctttacaatccattctgcactcagcagctaacatcttttaaaaacataaactggaccccttaccacttgaagccttccaggactttctatttcttttaaaacctgacacagcccctgccttcctggtctcctctccactgtgttctgtgtggccaacctccaggcgtacgagcctgcctcttgccctctggacagatcaagcttgcttcctgccttggagatctggccttggctgttcctctgatggggaggctcttcctccaaagagtcacacgaccatctccttcttgttcctgagttctttattctcaatgaatgaagtttattgcactcccctccccaatctcagtagtccccagtgatcctctctcccaactcccattctagcttcattattgcgctgtttttccttggtttcatgcagtttccttgttcattgactcctccattacagagtaagcttagagaggtcagggaccacatctgtttctgtctcattccccacttcagcacagagaacgatatggggcacagtaggagctcgataaatgctttagtgaatgcataaacaaagtaagaaaccatgaggtgacccaaacctcggtttcttcagttataaaatgggcacatgggtgcaaaggctcaggtgtattgtaagggtgaaacgagaggtgatgcgtgtgaggcctttgtgagctctagatctctttgtagatgcaaagtatcagtgtagattgcagtaaccaggacatcagaagaaaaccctgctctttggaagcaaagtgtgccaaataacaaagcttagctctacaaggctatcgctaagcctatgcaataaatactttctctcctccacatctgagctggacattctccacttgtccctccagagccactctccacccttcttacctgcctctgtgcctcacgggctgtcactacagctgcctcagtaagctcccttgccctctgggtacaaggcttcaactgatgggtgacaccaacaggagatcagaggggaggagagggagaccaggtaacttattccctggcagaccttcatcagagagtagctgtgttctgctgaaggctgtggcttctgtctgtccaccttctcctagaaagaccacatcctgtgggttcctgtaactgttcctccttgctaccccattcgacctgaggttggaaacttcctctagttgttgctctagccgcaggctgctccacaatccctaacccacccaaacctttgtctaaagcaccttccttacaccctccccagctgtggcatttcggggccctgttagcatccacgtgatgctgctttctacaaatgtgtctatttgtggtgacagcacttgcgctttgctttcttccctttcttatcctacctgatatcccagccttctgcccctcagctacaagaccactccataaccatagaggaccaaaatcacctaggagcttgagagagaaaatgtatttgacatcttgaaaataatgcagtttgctcaggggatttatttctccctcccctgggctctgcgctcagaccctctttgcttctgtccgactactgcaagcaggcagttaagattatttctagcaaatggacttagagaagctgagcatatgagtgatgttgaaatttgacctacacttcttttttttttttttttttgagatggagtctcgctctgttgcccaggttggagtgcagtggcatgatctcggctcactgcagtctgcctcccgggttcaagcgattctcctgcctcagcctcccatgtagctgggattacaggtacatgccaccatgcccggctaatttttgtatttttagtatagacggggtttcaccatgttggccaggctggtctcaaactcctgacctcaggtgatctgcctgcctcggcctcccaaagtgctgggattataaacgtgaaccaccgcgcctggtgagctatgcttattacttagatttctagcagataacatatagttatttcctaaaactctgttcttaacctgagctgtttttgtcatttttcagggttttagggggtgggaacatattacaggagctattaggtgcatgagtgtgagttgcgggcatatgtgagggttgtgtgtcttgtgtctatgcacatgcgcaggtgtgtaagtgggtgtgaatatgtgtgagcgttgcatgcatgcatgagttgtatgtgtgttgcatctgtgcgtgtgtgcaggtgggtatgagttagtgtgagtgttgcctgcatgcgagttgggtgtctgttgcatctatgcatgtgtgcaggtatgtatgactgtgtgagtgtgtgcaggtacagcttctgtattaataagagacgggcaatcactgtgcactgatattgaggggtagggattagagggcaccttgtctatttgggaggtgaaggagggctggaatgagaggctgaaggggtacagaagaggaaggcagacccctgcaggcctcagggacctagcctccctcccttcagtgtcccttcctctccctgcaggaaccagaaaaagtgtggaggtctgaattgcagtctctaaaatctctcctcagtctcacatgactggcttcagttttctcaccagtcctgcaaagccaggccttgaccccttatctaaatatccaaagaaaaaaatggaattagggatcttagaaggaaagagtggggcaggaaatgcaccaccagggcagtgcagcttggtcactgccagctcccctcatgggcagagggctggcctcttgcagccgaccaggcactgagcgccatcccagggccctcgccagccctcagcagggccaggacacacaagcctttgacttcctcctgtcactgctgctgccattcctgttttgtggtcatcactccttccctgtcctcagactgcccagcactcaaggatgtcctgtggtggcatcagaccagaggcccctgaagaggagtgagttgggtgttttttgccgcgcccaaagcagctggctgtcccctgaaagatggcaagtggggaatgatgatggtgcaccatcgttctgcacaccaagcccttctggataggaggcccccagcagtggagggatgggggctgccaactggcattgcccagaggcccagctcctggtcacatagactgacctagcagtgcaccagctacccgaggcagcctgcaggaaaggtgcactcatagcgatgctggaatgccatgaggcccagccatggggttgagaactggaatggagggaaatgtttgcatcctgatgctgggaaacaggagatcagtcctcaccaacgctgagatgatttccctctggttcttaagctcggttctctttctgcttgatgcttgaatctctggtgtctggcagagagtctggtgtctggcatagtgctttgtatgtaggtcatgccagagcatgctggtgactttgcccttctaggactcttttccatttcatagggacttgctgtgaaaccccgtttgacctggatataaatgttagatgtcatggagtcctgttagcatggtgagctgcaggctgttctgcatgagtcctccttgagcctgcatctaatacccactgctcaatcaatctcttttcactgtttcccattgatcccaagtgtgtcctctgtgagccttttcttgacactgggtcacccagaattactcccctgtctgtgtccccatagcaccccacaaatagttcaatcatagcccttgtaacattctggtgcaccagtttaaggacagagccctgtcttattcatcattgctggtggatgaataaaaatgttcaagtcgtaataacggcaatgacaacaatgataaactcaccacttactgaccattggctgtgtgccacaggacataggactgaacatcttacaggtgttatcctcatgtccactctctcagactgcacttctatcgtattctacagaaactgaaggatggaaggtcacagagctggtgggaggggagcctggattcatacccaagccgtgtgcctcctggccactcctatgggtgaaggaaagcaaagggcttagctgtagctgggatggagaaagaggaatctcaggcttctcgtcatattttgcctcaagaactggaaattgatctgggagtagatcccacactgagggagaaggccccagaccaagaaaggatgggctcatctatttgattgaaaacagagaagcttggaagacccaaggtagggcaattcctgaaccgtccagggctggaaaacctgtagcaaaggcctggggagatggggcagaaaggctaaattataacttaggaatctccaccaggagatcagctccaagacagcttccagtttcggcagatggaagggatacttgatggaaaaggagggagggtaagtgtcagagactgctaaatgtctttacctacatttcctcatttcaaactctcacagaacagagtctgaggtagactctagggctggccccattttgcagatgggtaaactgaggttcagagcactatacccgtaagatctttgctcaagaacttgtatgtcccagaccatgcttgaaacctggtttactcacacaccctgctgtgcagacctcctccgttccaaagtggtggcagacttcagtgtgctttgcagactttcaatctcagcacatgctgtggaagtgctagcagtgttgctgtgctaaccctgtggttaggctgatcacagtcctggtgagtaactatggcctgcagccctggcatctgaaagatgaccccttgcctctcctgctgtcctcaagaaagccttagccccctagattattttcaatataaaatgttcatacactacttttcagattcaaatttgcacaaatgaagtgaccgttagacaccactggaaggtaataaaacccccaagcctgccagccatcaggtccctcccagccatcccagaaatatgctcagctgccctcgaaacatctgtcatgctctctggtgggtgctactgggcacctgacattagatcacttctctcccaaagctgcagctctgcttattcgattcttatttctgcctttggattgagtggaaggcagtcatcagtgacagccaccctcggggaacagaaacgatgtccacagtggcaacgatcctccatcttcctgcactgaggcctaatcaatgtagcccatacccagcctccatttaataagctgattgttgagctaaatcccgcacactctccccttgccctggacgcttttgattgacaaaactaatctctcctccacccccacgtctgctgctgcccacatcctcttgcaaatcatgtactcggctgctgacaattagatataagacttgggattcggatgtgggagggttatgaggttatgaatcaattgtgggggctcaggtgagataacaaaccaggggaacccatttcagacacctcgccacagccctcagagcctcctggttgatttatgagttggtaataacctcgctgggtctcctggcccctattatttttcataatgcacaggaaagctttaaatatcagagaatggggaagtgcacagtctgagtgggagggaggtgaggggggatggggcttgggggagaacagtggccaagggcttccccgcagctgattgtctctcctgccccatctccccaggccttcgctgcaggtcttctagtcctggacgtttcaggaattgctttatcttggctttttcaagcttctctgtttcattcaaatagatgagcccatcctttctcggtctggggtcttctccctcagcgtgggatctactcccagatcagtttccagttcttgaggcaaaatatcaggagaaacctgagattcctccttctccatcccagctacagctaagtccttcgctttccttctgtgggtcaccacggggtgccgttgtcatatacccatggaggccagcaagctgatctggccaacctgggagaagaccccaggttgatgacccctggtttaggagtgcatatggcaggatgcttgagggatcactgggcccaaaatcgtatttgctgtgtctggatgtaatgcctcccacctgttcaagaccacgtcagaatgactcagagacctgcctgttaagaagggaaaattatccgctggacaaaagccagtcaaaaagcaggctcaccctgcagtctggaagccagttgagcagcgaggacaggccaaaaaggtgggagggggccagtgagtgtctctcagcctggaggtaaagagctgaagactttacctttccttctgcctgctgtcctcttcccagtgacagccagtttttaataaggaaaaggaggaggctttgaattgctacctaatatttgtttaagtagtaatttgttgagatttctctgttttgttttgttttgttttgttttttgagacggagtctcatgctgtcgcccaggctggagtgtagtggtgcagtcggcttactacaacctccgcctcccaggttcaagcacttctcctgccttagtcatccaagtagctgggactacaggcacctgccaccatgcccagctaatttttgtatttttagtaaagacagggtttcaccatgttggccaggctggtctcgaactcctgacctcaggcaatccacctgccttggcctcccaaagtgctgggattacaggcaaaaagatgtgattttttttttttttttaacagtatcagtgggtgaaagaccctgaacctttcctctaaggcagtgtttgtaaactgcctatatgatgtctggtactagattgtgatgatgttttcaagggccacaaaacaattgaggaaaaatttaaaacatactgaatatacatgtgtgggtgtttatgtattatgatgtgtatttgaatacaactatcaacgaataagcattcattagaccccaactctgtaccagatgtttgtttactccatgccagggacagaactaacagggtccctgctctcttggagctacagtttagtgggcattatgggttgaattatgttctctcaaaaattcatatattgaagttctaaacactagaactccaaaatgtgaccttatttggaaatagagtcattgcagatgtaattagttaaggtgagataattagggtgggccctaatctggtatgactggtagtcttattaaagggaaatttgggccagtcatcgtggttcacacctgtaatcccagcactttgggaggccaaggcaggaggatcacttcagcccagaagttagagaccagcctgagtaacataaggagaccctgtctctacaaaaaatttaaaaattagccagcatggtggtacatgcctgtggtcccagccacttgggaagatcgggagaggcctgggacagattctccctcacagccctcaggaagaaccaacccgttcgacacctggatcttagctgtctggcctccagaaccatagacaataaattgctgttgtctaagccacccagtttgtgataccttgtcatggaagtcatagcaaactaatatagaagaggaaacagacatcgatcaaataattacattgtggctaattccaaactgagataaatgcttcaaggagaaagaaccttgttctcttgacgttgaaagccaaaggaccttgagccagtctggagggcaatgaaggccttcccgagggagttagggctgaaggatgtgtcagagtcagctagagctgtgttccccagcctttttggcaccagggaccagtttcatggaagacagtttttccacggaccagggttgtgggggatggtttcaggatgattcaagtgcattacatttattgtgtactttatttctattattacattataacatataaggaaataattatacaactcaccacaatgtagaattagtgggagccctgagcttgttttcctgtaactagacagtcgcacctggggggtgatgggagacaggaacagaacatcaggcattagattctcataaggagcgtgcaacctacctggcatgcacagttcacaatagggttcatgctcctgtgagaatctaatgccactgctgatctgacaggaggcagagctcaggcagtaatgtgagtgatggggaggggctgtaaatacagatgaagcttcacttgctcacccgccactcacctcctgttgtgaggcctggttcctaacaggccagggaccattacctgttgggaggctgaggacccctgagctagaggaagaggtgggaggaggaagggaaggcacgacaggcccagggagtagcagatgcaaagatcctgtggtgcaatggagactgttgcattctgggaagggaaaggcagtcccaaggcaggagaggtgggggaagaagaagagggtgttgggatggatgcaaccagagcaccccaaaccagaaagatgtttactccattaccttcaactgaattacagtggggtgagggcacctattttgctttctgccctcacttccgggaaatgcgcatcctggatcacagaaaagctgctgggcagaggtcccagtctctcagtgaggcctcaccagactagtagagttgtccagccacaatgccctcctcatttccccttctgtccaacaagctgtctatcggaagatcccagtctaaaagcaccagaagacattttgagtttctctaaggcctaaaatttaaaagctgataagtaacacaaggattccaagttactgctgtctctcccagccacgcagatgactgggttagacacttggctggtatgaggtccctgaaacatgggctctgtgagtagccaatgtgtattaatattaatgcttatgatatgtcaggcactctgcatgggttcattacccctcacagtcaagatgatgggtcccattattactgtcctgttttctttatttttgagacggagtttcgctcttgtttcccaggctgcagtgcagtggcacgatctcggctcactacaacctccacctcgcgggttgaagcaattctccctgcctcagcctcccaagtagctgggattacaagtgcccgccaccacaccaagctaatttttgtgtttttagtagagtcagggtttcaccatgttggccaggctggtctcaaaatcatgacctcaggtgatccacccacctcggcctcccgcagtgtactgttctcttttcatatgaggaaataaacgcacagggccagcagatgacttgctaacaaccagatcatttcagcaaaaccatgaaccaggcattgtgaagagagttttgtatacctggccttattcttaactagacagcacttcaccctagttgacgtatgaagaaatggagatcagggcaggtggtgggtaagggacctgcccaggttcccaccgtttgtaagtgatgtaccatgagttgctctcaagtgtgtctgactttataaatgctgcaccttatcatttcctatgcttggtaagcaagtgagtgtgaaatttgccacgcttttccttggaaaaactcaagcccattgaccaaacaatactacttgaaaatgacactgaacttttcatcactgtgtttctccacctgtgttcccttctgtcttactgccacctactcattgtgctcaccctccaaagcccagtttaacatttcctcttagttaagctttctctgctagctgatcattgcattttttttcaattaaggcataaaagaaaaaaaaaagacggtaaagattgtcctacttagaatatccttccattcatttgcaaaatggagataataatatgctatttacaacataggattagtatagcaggattattccagagcctggaatatagaaagtactcagtaaattattagttcaacagctaataatagtaccaattattattatcactaaattaatgcctctgtttcaggaaaaaaactgaatacatacagaatatcggttttctaattgttttttctttatactacttggaaagttatacagagttaagagacacagaatagtatagtggaaataatatttggcatgaaattgcctggattccatcagtagtagcctgtggtcttgagcctctctgggcctaatctttaaaatggatataataattatcatattggacacaattattgtcaagataacatgcgataacagggtcaagtgcccagctctggcctggtacaccatgggcactcaggaaatgtcactccgccttcataagcattggcctgtgcatgacatctatgtgataaggtggcctgaagctgtcctccccacccagaggtgcagcagaggcctggcaggaatgtgaaaatccaatggatcaagtcataaccttgactgaagagtatggtgagttcactcatggcaggaaccatctgatcattcatacggctccagaaacattttactcaaaagaaagtgtctttccccaacagtcaagattgataattagtttatgaattgcttcatttatcagtactatgatgtactgtataatccaccaggtttcaagttactggaattttgcaggtgatgggaaccagtctttttatcaactttgcataatctgatctgggctcagattgatagaatgctttgggaagaatcaggggagtgttttatactaggatctcctgcggttctgatgcgttaatgggaggaagctatccctgtcaaattctacaattttggaggagcttaaaacacctgaagacaaagccctgaattttatgagtgtctgcctgaaaccagaaacagaaaccccttacagcttactcaacagcgttaattcagcatggaaaggcaccaggaaaagatcactgcgtcttactcccaccaagtaaacaagctaacaaacacagaggagaggtgcaggttggcacccttaggccggactctgggtggacagccctgtcagagtctataaagggtcgctctgaggctccaggagtggcagatggccagagagtggccaactggaggcacactattgagcctcgggattgagcctcccactgtttacccctcaggaaaaagagagctttgagtctcctggccctttccccagagagcaggaaatggccagggcttgaggatagccagaggccgtccaaagttacccataccatctccactttggcctcagaggccagctctttcttctctctgtgctttttaaaataaaaacttatttttctagtgtaaaagtattatatgaatgttctatgaacttcaaataatacagaaatgtaaagaatagaaatttcccattatttgatgcctcccgctccccaaaataacctaaagttaacaatttaaatatatatccagaatttttcctctccatatttatatatatctatacatatataattaatagaacataaatattttacagtaaccctgttctcaagatgcttttccactgtagatgtttaataaatatttattgcatgaatgagccataatttatttattcagtcctctattagaggcctttggtttgttcccagtcatctaataaacatgattttagatataaaagacataattgaaatacatataacacatacagaaacataacccataactgcatatcataaatatatccttaaatatactaataaaacacgcatgcaatggagaggtgttttgggtgccgtctggtgtatatcctggatatccctggaatatatattgataaatcagcctcaaaaagaatgctttcagacagtgttttaggatctgtgggaacaaagggtggccatcctgcatttgttatgttgtttcaacatagcatttgttatgttgttttattaactttaagtccttggcaaagcagcttgactaagataagatccagaaaccagtcgtggtaacaaggcaacaattaatcttagatagaacagaaaaggaatccgcttcaaattctctttagaacaggaaggaaagggtgatcgtgggttagcaggaaggaaggaaagaggcaagaaaggaaagtgaaaaaagaatggaaatgctttctcctgctggtgatttggatgtttggactactcttgtcagatgctacagcgtaatcactgtaaatgttttaaaggacgcgatattatgacagatttccctttctgacttgttcctggggctgcacacacaatgatttactccctgccacgggctggaggcttggccactcctgggttggtccaaggaagcctggaatacccaatgcctgtgagagtgagcacgtccccctgtctctaggtgttgttgcttgtgctgaaatggagtctaccaagcattgccatggcatggaagggatggtggcggagtagatgccactgcagattgagtgcagtgtcccaggcagccaggggcagccgctcagcccttgcctggacctgaggactgttgcatcagtctccagatgagacagcagctgtcatggtggctgaaccagggaaaagaaactccactctgtggtctccatggggctagggaaaaaaggaaatgggtttttgtgattttcccttctttagaaacaaaagtgcttaaatgtgattctttagctctgtaaatgcaaaccacggcctggtggactggggagaacaattaggccaaaggctgagcacaggaagccaaaagcgggtggaaacccagacaacggtgctgagccgggggttggggtggttggggggagcggatatgatagcaaggaaggagtttcaatgtgaatgaatactaattagtgacatggatattaatgatgacagtaattaacaggggaaaggaagggctgtcattgtcccagggtgagtaatcaatcttggcaggtgataaataatggttcagcaagctcagcagaaagataatccgcaggcctgggggagaactcagctaatgcaggaaacctcacagtttctaggcaacccacagaaaagaactattttttttttcttttttgagacagcgtctcactctgtggccaggctggagtgtagtggcgcgatctcggctcactgcaacctccacctcccgtgttcaagcaattcccctgcctgagcctcccgagtagctgggactcaggcatgtggcaccacgcctggctaatgttttgtattttaatagagacggggtttcaccatgttggccaggatggtctcaaactcctgacctcgtgatccaccctcctcggtctccaaaagtgttgggattataggcatgagccactgcgcctggccagaactatttttcttttgaggaaaaaacagattagagtatctctcccacccccagcttgggactacagttcttatttgatttctgctttgttcttcatttcctgggacaaatgttgaacttgtataacttggaggaaagggacacacaggcacatgtacacacacacatattcattctctctctctctctctctctctctctctccaagaatacgaatgaatacgagtgtttttgatctaaagtttgactcacagatgctgtccaggagtagcaagagtgaggagaagcctagaagtgctgcctttgaggttggcgcggggaaactgcaaaattgcaaggctgtgtcggcagaactggggcacacaggaggatgaggatggccctgggggtcccactgtgcagggttacttcacctgccatggacccagagagaaacaaaatgtctaggctttctgtcctgtaccagtcccacttctggccaccagtcacatatctaagaaaactgatttctgggaagagggcaatcctcatgaagcccctctgctggatccccaggccttcagccaggaatccagcccaggagagttcttggcacatcccctccctctcaccaaagcctcagacccacggtaggactctgatatctaaaatgtctccccttgcaggctgtgttccatcaaacaatttagaggtgacaaagccacaccttcaatggtctgcactggtttaaagtgagatctttgggtggcaaaggtagattgaccagaaattcagaaccttccagaaaactgaactcctctactgccatgtacacagtgctgctctcagaacattgtttgcgggtcacattttcaaagagaggcagacagaagggaacttattcagaggattgggaacatatggtgaggaactccaggccacaccctgcaaggaagcagctgagggacccaggcctgttgcacttggagggaggacgtcgctggtatgccgcaggactgtctgaatagctgaagggctgtcgcacagagtggttaggttggggtttgtttttctatcatcaaatggcaaaactgaggccaaagggaggaagtcagagaggggcaagtttctgttcagataaatcaaggctgatttaactgggtcaggctgggtaggggggagtttgtgagtttccaggtactagggattctaaacacaggttacagcacctcttgtccagggtgttgtgaatgggacatgtattggctggggttggagtagacaagctttaaaagttccttcagggccgggcgcggtggctcatgcctgtaatcccagcactttgggaggccgaggcgggcggatcacgaggtcaggagatcgagaccatcccggctaaaacggtgaaaccccgtctctactaaaaatacaaaaaaattagccgggcgtagtggcaggcgcctgtagtcccagctacttgggaggctgaggcaggagaatggcgtgaacccgggaggcagagcttgcagtgagccgagatcccgccactgcactccagcctgggcgacagagcgagactccgtctcaaaaaaaaaaaaaaaaaaaaaaaaagttccttcagactcttaagatttatattcgttaaggtaatactagataccaaaacagctaagtcccaaatttcaggggcttaacacaacaaagttcagtcctttcagtcctcaatcaagtcagagccccacatgggcgtaatgtccatggttggaaccgtggctccctgcctattgtggctctgcattcccccaggtctttggagtcccccacatccagccagtagatgggattgaaaggggcagagctaaggagagccatgtaggagtttttatggtccaggtctggaagtggcatatgccatttctacccatattctattggcagaactcagtccatatctaagtgcaggggaggctggaaatgtaatctagctatggcacagtgaggagaggaaagaggtcttggtgaatacatagacgtttctgccacaaatgcagggacacattcattcaggataggcctgtgccggaagagatgagagttttgcaagaacctatgaggtcacctgtgttggtcagcccttgtaattgatggtagggagctgatgaggcctccttcttcaagaaatggtctgggggccaggcatgataaagcttcacctagcacgtctcagggaagtcctctatagacacttcctagaaacatgaatataagctcatcctgcatcatcagaagtgagtgttttttggacaagaatggaattgtaactatggaagtgtactgaagaatggaaagggttggttaggacaaaaaaaagtgcccatattatcctgctctacagtgtggactgtttggaattaggattctcttaggtaaacatgtttcttctgccacagtgttaaacacccaggaggtcttcagctgaaattgctttatcgttgcaggtactgacattgtgcagtggcttatgaagaacctttccattgaggacccaggtacttgacctttgaccccacccttatctcccctggtatcagtaaacatcccataaccaagttccaaactagattcccctgccctcctgagaactggtcttgtaaatgtgaattccaagacgtggaatcactctatttacaaataaaattaatttattttctccactgaatatttgtctttaaatttaaatcatgctttgaggaaatgagcaactttttagaatgccaaagagcccaatacaataatgtgtgaaatgagttgaattctcattagctgcagcaattaaagataagttgtagcactgtcactgaacagccttctagagccagctcttaaaattagattgcctgatccacaattaagatgtttaattatttgctaagactccctctgttttctgcttctgcaagaagtgaaggaatgattttttttcaactttaattgcgcatttcaattaggaagaccttaccaggaaaacaacaacagaaccctggccaataaaacaatttcccagtctgttctcccaccagaaaataggcagtaaaatttattttcacagtgtaattaggaaatggggggggtgttccagaaaaataaaaattcaagataagtaaagcttattcccatgtgctgtcagttaatacttttccgaatttattacatactcctttgccttgattaactgagtattcttgatgcctgaaggtcacatttataaagatccactaatacactctgatgttcttaatggacattggcgtgattagacttacctgccccaaattaaatggccctgaaccacaatgctttttgaagatttttttgaagtgcccattctgcatccgtgaccttcagctgtgagtccctgctggaatcggtgtgtcagcttggcactcctgtattttaacccaacatttctaatctgttgactgcaaaacaatacagtttctatgcagttcaattatatacagttgttagaactctgagtgccagaaaagcagatcattcatagaagtggcccgagtcttttcacccccttgattagtggctactctcacaactagtgaaaattcttaattctagtcaagttcttgattcacagggaaaaaactataaatgctaaccctttgtaaaggatagaacccaaagcaactcactatgtgttgtccctgatgcagcctgtacttctgagtgtccgcttggaaagcctggactgaatcagcatctacctgtttagttacatttatctaaagtcagtatttcttgtgattataatgctaaactaaggaacgtgtttcctcatggccaccttttctcttccaagagcactggtttctttgcctcctaaaataatcgttgtatttctgacatatattttattattactattatgagaaccctaaattggcgagcagtatgtgagaatgagcttcaggaatcctccagccctggcgtgagaagcttctgtgaagggtcctgaatgatgagagttatttctatgaaaatctgttatactctgatgcccttgggaagacatcatggtataggggcctgtttgggcttctgagaagtggctgaggagaagctaagaaccatttgtcagctgggaatagtctaaggggggagatgaggcaaaccgaggccttgggaaacagtcagatccagcatctgcccctctctcccttctttttcccatcagtcgatttcctgtggttattttttggtttttgaggcaaggtctcactctgtcacccaggctagagtgcagtggcacgagcatagctcactgcagccttgacctccctggcccaagccatcttccacctcagtctcccgagtagctgggactataggctcctagcaccacatccagctaattttttgttttattttttgtagagatggggatctcactgtgttatccaggctggtcttgaactcctgacctcaaacaattcttctgctttggcctcccacagtgcttggattacaggtgtgagacactgcacctggccccattggccaacgtctaagcaaaaacatttttgctcagagaatgaagttagagtcttagctccaagactggtggcatgaaagtcaccttcctacaggattttgttctttcttctctggggaaggagcaactgctgatgatgaaacttctgttctagctggactcatggttcttgaagcatatggactttaaaaagcaaaccggccagacatggtagctcatgcctgtaatcgcagctctttgggaggctcagctgggaggactgcttgagcccaggagttcaagaccagcctgagcaagatggcaaaaccctacctctaccaaaaaaaataaaaaaaaaattagacagacgtggtggcatgtgcctgtggttccagctacttgggaggctggggcagaagtatcacttgagcccaggagttcaagtctgcaatgagctgtgatcatgccactgcactccagcctgggtgacaagagtcagacctgtctctaaaaaaaaaaaaaaaaaaaaaaaaatagcaaattggtcatcactaagcaagtaaaataaaactctattcattccaattccaccagttacatgtatgtttctttcaaaggagaataggtggttcttgatacgcaaaacattgcattgtattcaacttcttgaaaagtttgcaagtaaagccaaaacaaactactttaaaaagtcagagctcgtgaaattaataattgctagaggctccctgagcacattaacaatttccatgtccaaaaattagttttaacctgtaacagtacttttggatttgtgaaagattgtgtgtggtagaagcattgaggtttgttattttttcttagctctgctcaggataaatctaaattcttaacttttttttttttaattgagacagggtctcgctgtgttgctcaggcttgtctcaaactcctgagctcaagcaatccgcctgcctctggattacaggcgtgagccaccatgcccgacctatattctcaactttctatgtgcatctatttatggctggtgccaaaggaacgaaggaacagattgactgtggcaaaaatataagtatttctatcaggttagcctctctctgtcactgcccacttcagtgtccttcctctaattttcaaaggaagtgaggttttcctctctgtccataagagaagggtgacacccttctcattcctgatgggactgtcatattggggaacgcactgggagtcctacgtctctatgggcagcgaggctgcattcttactgctggggatgatgaaactggtatgaatcagagctgctagcacttacggagtatttgacctgtaccagacaatcacttcatgtgaaatatctcacttagttaaatacaggttcttctatgccagaacttatgcccttgaccctgaagccagactttcttctgaaggtcagggtgaggaggggttaagccatgtcagactctcagaggtgggattcagacaagtcccagacacatagttgccctttccagccattggcatctcccctcctcacccccacactgagcaagggcaattgtatcatcaacacagacatctgggggtgatgacagttgacttctggtctcccagcttaattttcagccaaataacctgctttctaattccttctctctctatgcactgttcttacagttgaagcaatacacttggggagccttatcgctgcccagggctacatctttccaatctcagaccatgttctcaccatgaaggatgatggcaccttttatcgtttccaggtaagcctgctggctcctcctcctgaagaaccttttcttcacaacatcatctgatcttaggttagaactacaaagaaaacctagggatatctgagggagtagccctcactcctcatcagcactgggaaagccaagagaacttttctctgggccactgggtgacccacttagagaatagtaaaaggctgtcattgagagcctaccatgccctgggcactgccttagtcccttgggctgctacaacaaaatacctaaactgggtatcttataaacaaacaaacaaaaaatttacttctcatggttgtggaggctggcaagtccaagaccaaggtgccagcagattcggtgtctggtgagggcctgctctctggctcatagatggcaccttctagctatatccccacatggcagacaggacctggggcttatatcagacctcttttataaaggcactaatctcacctgtgagggcttcaaaggccccacctcccaataccatcaccttggggattaggatttcaacatgtgaatttgaggaggatgcagacattcagaccatggtagacactttgtacagatttcctcatttattctgaagagcacactttagggggtaaatattacccattttacagaggagaaaactgaattgctcaaagaattaaagtgtcatttagtaaatcctggagcagccttcatctgaacctaagtgagcctgatagcacagaccttgatctttctactgtctcatgttgccttctcggagtgaagtttctatttgcgacctaatcaccctccccacccatttcacactccttctcccagatccttccgtagagggaatgagggcagaggatatgggcttgaatcaaggtctaaccaaagggtgtgggagaagagttcttcagactaggttaaagggaggaaaggaacatgggcttaggtgcccagtaagttatgccagcctgacttttgtacttagacctctattgtctcaggataagaatatattgccctgtgaacaaaacttaacatttttgcatttgttttgcttacttacattttgcttctcaatgcctaggttaaaatgttgactcaccttagctgaattagagaagaggagagaattgtggggtagcatcagcaagaaggagatgggggagagcctgccatcagggaggctcctccctgggtgtgggagggaagcgcaggcatggcgcgcccctgagcactaacacccatgctcctttgcaggctccgtacttctggccttcgaactgctgggaacctgaaaacactgactatggtgagaactgaagccactgggaactctcaacttcaacactgtgtgtcacttctgggggtgcagaagacaaatgcttggtgtgggccatggtggtacatggggaggagggtcctttctgcttagtcctttctcatattgttgctatataacaaatctcctgttccacataacagaggaaggcccagcttactgaaagatgtagtccttggaggggaagcaggagagggaagaaaaatcttatcaagggtggtcagtatgttcatcttggggccatggagaaccaggatcccacagcaacactatcagatggtgacttttaattgttctttccagggatagggcttcagggagggctggatcaaggggctacctcctcctggccctttctgttctcatagacttgtcaaaacttactaagaaccttttggtgttcttgacagttgcaatttagaaaagagacagagaccagggaggagtatacagaagtcactctggactaggaaaatagagtgggtgaagttgagagttctgtctctctagacagggacctacaagacttctgccagatattctcagtggagattatttaatattcctatatgccaattctctgaagaagttttattatcgctatgcttaagagaaagaacctgaggcccagaggggccacaccctcacactaccacattgtctgaatgctcccttgattataagcctcttgagggcagaggctggtccagcttatgcattctcatatctccagggcatagcctatgtctgaggcagaattagtgctcagtaaatatccactgacagttctggttctttattgaaggtgaccaacagacactcactagagggagcagaacttgaactcagatctgagtggctccaaaacccatacttctttcacggtcccatgtgtgacatgcctgaaggttgtagctgcagcactgcccctttgcatgcatccttgctgctgactcagctgctgtggcagtctcatctgtggctctccttgggactgggacactcaatgagacctgcagcttctttgcagaattgtttaagacaagaaggcagatgcagctgtggtgagtgggagggagatgtgcagctgggtggtgatcaggggagcctgtctgggagacccatgggataagatacaaccttggagtcacacgtttgagcaagaggaaaccaacaacagggagccaagctgaggatggaatacaagcgagttgtacctactaaggctggagttgttccatggtcaagtgtggaggacgtcagtcatgcagaagggcaggctctggggctgtctgcttggctatccacaggcaccactgtgggccctctgacactgtgctgcaccctaaccaatgtgataagtggatccaggaagacttccgactgcaagtgagagctgcatttgaccgctcataaaactagtgcttctggggctgaaaagactgctcatgaaagcccaactcagaatttgaataattatagctcagttccatgcagcaacgtgtgcccttgtgaatgtgaaaaccagtatttttccaggcagtggagagggtgggaggatggtaagaccagatacctgggcccaagtaagattaaaatatttacttccgtaaagcttagggcatcttatgctgcatactaaagggcatcatctccctgttctacaggtgttcttcattttataattttaattgtgcatcatgaacagggagagaaataatagtttgtttcaggctctcattaaacaaaaattattttaaattcctgtgcctcaatttatggcaaatcagagggagaaatcaaggttcaggatgcacaagtgttcaccagggaccaggcatggtggtgcatacctgtaatcccagtgactcgggaggctgagatgggaggatcacttgagcccaggagttcaaagctgcagtgagctatgattgtgccactgccctccagcctgggtgatagaggaagaccctgtctctaaaacaaagaaaaaccagtactccccagggtttccaaagcagtttagttagaaaatcaggatgtatttatgaagagagaatccagcacaatgagcccccaggatcaacccgttccactagctgggtgatcttggcaaattacttaacctctctgtgcctcagagacctcatattaaaattagagtagtaatggcacttgtctcctagtgttttgttaggattaaatgaaatgcatgtaaggttctctgagttaatacggagtggtggttggtatcactactggggtggggtcggtattattgccactgggatgttggttgatattattatgactgaggtgaccgtctcaccaggaagcatgtgaaactgaagctaagaattcaatatagtatgatttggactgatgaagtaccagaaactttcattcaattgacaaacgtttactggtccctactctgtcaaattctatgtcagagatttgaataagtcacagcctttccccgcaagcattccaggctgggagaggcagcatgatgcagggaagaaaggcatggtgaggatctggcttgagtattcaaaggttttatgtgatgaatgactgagaaggctgaatagcttgggaggggcaggtttataaaaaggccttggcagtcaagtagagacatttagaatggattcagcagtttggggaagctattgtgggtccccaacaatgaacacactttcccaagttttttccctacttgggaaaaaattggttcatctataagatgggggtaataacagaacccacctagtagggttattatgaggattaagtggactgtggaagattaagtaagggctgtgacttagtcaaatagttcctgatattcagtgggctcaatggaagcagtagctgctacgatggtgatttttccagcacctaaaacggtacttggcccataggagacactcagtacatttttgaatgagtgactgaatgaataaatggatcggtgaatgtcatagaggaaactctgcactggtcctcgattctaattccatctccatcactaactagcccttgggtccatcacttcatttctctgggcctttagtttccccatctgtaaatgaggggcctgtacttgatggttgccaaggttacctccagtctaaaattctttggttctaaaaagtcatcagaaagtatgaggaaaatagagaaataagtgagttataggttccctagtttaggagattgaggtacataatgatgttgctagtaaaggcagaaagtaaagaaaggggtcagtttcttcagtacattgaaactcgataagctcaatattttttaagaaatttaattgcacatataatacatgaatgtgttccctttatacaatttttaaatatgtcccagttttgtgtggtgacacatggtgaacttgagatggcagtggatttctctgagtgagatgtgagatataggtaagggtggaatgccagatgtaaggacaaggaaatagaaatttttcggtaagaaattaaatatccaagagaaaccaatatctgagcttaagacagttcttccagatgccctcttgtagggctggctattgtcaccagtagtcactagagtcggttggaagttagagcaagccctagtgagggcactctgggatgcagacaagccccagggagttctgtgccaagaacagccacatcccaccttcctcattgtggtgaaaagattccttgtgtgactttaggcacagggacattagctagtagcatgtgaccctgtgactcatggccatcaggagtggccccagctctgcattccatgcatgataactcacttcacaaccccgctgtcccattttgaccccgcttacccatttggacatttcttgggatgactctgcctgcataaaacccacagtcaaatccaggttagccttttctgagttttacatttggccagtgcaaaatcctgtccagggcagcattgtcaaagcagctgccacctccactgacctgcactgctcaaaggtaatcatgacctggcccagtcgagctggtgacatgtcaagcttcctgcctgaggttgtccctaattctgccaggggtccaagagactgaaggaggtactttgtgatagatcggacacccctttatcagacacagtgaagcactatagctgcttggttcattggaaaagttggtaagtagaaaatcatttttaaaacgacatatgcacaccttaagcacctcatgtaaaggtaagatatacaaaggaacactcatttgacagccttgtgaagtaggaccaaagtgttctctttgattatgagctgaataattttagtttcttaaatcaaccgcactcaaaataaactaccctgttttggtatctttaaagtgcatcaagaatgtaaagacatttttgtagtcttttgtatattggcccctcctagatttttattatttttcttactttttcctgttatctcacctgtatcaaattcaccagcaattgccttagctaactctccttcattaaattgttccaaaccattcaactgagttttcatagaagcaacactctctctcttttcacattaatttcattgagacgtgtgatatttagtgaacttgtgtgattaaaataacagatgtgcctgatataagcagatttgggaacaaccacaactgactcctatgagcacacaattcgccgggtggaagcagaagtgtgggcataccagagggtaggctgctagcttccaggctccaaaatgtcataggtatcagtaaatttttcagaacaaatgaaggaagttggttgatccagcaaagagttgactagagatctcttagtaaagagatcttgttgtccaacaacaaaatgatcacaggttctctctggccctccctcttgatcattctgttgttcatttatttatgccattcatctactgttttccctggattgttccacttggctctggagaaggaggaagacattgaagaaggaaaggtagggagaagaagtgatgatgaaggccatgtttgaggaagaaacagggaaaccaggggccaagaacctttccttagcctgagttgagagacctaaattgtcttccctttccatagcctttttactgcacctgacaagacaggctatggtgctagcaacagggatgaaagctgagcaggacatagcctctgcccttaaagagacttcagcctagagcaggggacagtctagtaaatacaggatttcagtgcaatggaatttagttccatggtcaaggacatgtagatgctatctgaaacaccaacttgggtcttcaaagattagtaagaggttgccagatagagggaaggagagaagagagaaagactttcctcaaaaaggacacatatgcaaaagaatgaagctgaaaagagtttggtggcctcacagtgcctgcatgagggagaagaagttgatgagataagcagtgagcagatcataaagaaccatatttgccatcctaacgagcccaaccttacttctgaggccattgaggactccaggcagagcttttaggcactggagtaatgtggtcatgtttgtgaaatatcactctgagtgtaggatgttcagggtgaagcagagtgaggaggaagaaggggagttgtcaggattggaatatggaggagtcctcatttgatcatgactatgaaaggatttatagaggtcaggggtcatgaggtccacttagaaaacatatttttcccaggacagtgctcatgaggtccacttagaaaacatatttttcccaggacagtgctgggcacatagcaagggtgggtgggcgggctgtctggatggatggatggatggatggatggatggatggatggatggatggatggttgggtggatgggtggatgggtggatggatggatggatggatggatggatggatggatgggtgaatgggtgaatggatggacagatggatggatgggcttataattccattgtgctgctggttttgtacatgttgtcatttcctttcttccctcagccatctatctctgtaagaggacaatgcaaaataaagcaaggctggaactggcagattatgaagcagtaagtatgattattttccaggatacatataagaagagagtaaaatcatatctgcagctccgtctaagtttattttttttttcttttgtcccccttttgtccctttcagacagtggaagggaagtatcttctatttctcctcccttgttctcagctcctctgaccatcacaataagatggtgtttttacataaataactcttaaaactcaacaataaaaaaataagcagctcaacttaaaaataggctaatgacttaacagatattttaccaaagaggacacaaggatgataaataaacccatgaaaagatgtccaatattattagccatttaggaaatgcagattaaatccgtggtgagatactgttacatacctattagaatggccaaaataaaaaatactgatgataccaagtgatggtgaggaagtagaacaactggaactctccgctttgctagtggtaatgcaaaatggtacagccactctagaaaatagcttggcagtttcttataaagttaaacatacacttaccatataaccaagcaatcccacttgtatatacataccctagagaaatcagaactcatgttcacacaaacacctataaactaatgttcatacaagcttaatctgtgataaccaaaagctgaaaacaacccaaatgcactttaacagttgaatggttaaactaactgtggtacatccatacaatagaatactactatgcagtaaaaaggaatgaactgttgatacacacaaccacttgaatgagtaccaagaacattatgttgggtgaaagaaaccaatctcaggccagccattccatttataggacattcttgaaaagataaaactatcatgatgaaaagcagatcaatgattgctagtggttatggatggggtagggaattgttggaaggtgatggaactgttctgtatcctgatcgtggtggtggttgtatgaatctatacatgtgttaaaatttacagacttgtacaaaaggaaaaaagtcaaatttactacataataacatttcaaattaaaattttaaattgcacctttatacccactctcctgtgcttagtagcagaggcagaatctaagggtaaaattcaattcagaaaataagacaagatgtgtgtcacatgaggtatctacttcccagctttcttaccttccttctctatctttcttcataagatgagacttcttgcaaaaattagaggccccaccaccaaacttgggtccattcccatttgacagagcccagaaaccaaagcacttgaaaactcatagatcatttaattttttttttaacttttggttgcaaaatttttcccccaaactgaactttacatgggtcacagagaatgggagaaactggctaaactttcttataccttctacttccctctccctatatgtcttccaaaggatgtgctgctgagccatgaatgactgaagggccagcagctatggaaggaggggcaacattaaggggagcagagaatccttccctggatagtccagcattaacagcatcttcagacccacccaccgccaaagcccttcctgcttttactgcctcagtctttcaaaacaagtgtgaggccccactctgccaggccttacctctcctaggttcatgttcccaagcctaccaagcctaccaagcctaccaagccagctgggccatcgctcccctctctacagcccaagtgtgaatgcgcatgccattggggagcaggacgtgtgcatggtccttcacctctttgatcccactggcattgtggacctgtgaatggggtgcagggggccagaagaggaagaagcagtgcagcagtttgtccagagccctcaggacctggctagagtttgcattatcagatgatcatatgttggaatattatgatctccccagataaaccttggcctggttgttctgtggctctggacatcctgggagcccagtcatgcccctgtctgccccaatgcccagcaatcacagcacccctccttcaaaagactgctgttgtactctttgtgcgcccagtgcaagtagctttgacatgatgacattacctccttaacacaaccttgaggaaaggcccagacagtagaagcctggggcccctccctcctgtgtgtctcttccccatattttcaatgttttggaaaaaggtcccatacagaaatcagacagcatcaactcctgctgtatttgattcaatttctcttctcttgtcccttaatgttctgctctggtatttgtaaagaatatggcattgaggccaggtatggtggctcatgcctgtaatccccaaggtgggcagatcacgaggtcaggagatcgagaccatcctggctaacatgctgaaacccgtctctactaaaaatacaaaaaattagccaggcctagtggcacacgcctgtagatccagctactcaggaggctgaggcaggagaatcccttgaacctgggaggcggaggttgtgagccaagatcgtgccactgcactccagcctgggcaacagagcgagactccgtctcaaaaaaaaaaaaaagaatatggcattgagatgtgctctcaggttgaagttctgcacaaaaatgattcaaaaccaaaaaagcattttgcttccaaaatgcaataatttttttatgaattttctgattacatattctttttacaaaaacaaaaattcaaacagcaaagaaaggagagaatataacctgtgactccccctcacctaagttttttctatgcatacatttttttctttacaaaactatatcagaatcataacataaacattcttgtggcagctgcttctctttccccagtcattatactgtaggtatctcggggtctttaccatgtcagtaactataatctacgttattgtgtttaatggctgcctagaattctatgctatgactgtgtcacagttgattgacatttaggcattaccagttttgcttcctatgagcagtggaagagtcacaaagacagtttttagaagtactttcacaccaagcctgggtgataactgtgagctcatgtgtggtactctccaactgaagctccttttatattaataatccattaatgagggtaatcaattcgtgttggcatgagctctatgaaaatacatagcataatatgggctccggccttgcattcatcagaattaggaggatcattagggcgcctgtcaaactcccctcctcgccgcccatcctcatgttccattaggtaactctacagacttagagaaaatacttttctttttctctaacggcagccctcaatgacttttctttctgttttgggctttttctttcatgaacatcacaaacgtagacactccgtttggggcacttttttttttttttttgaaacagtttcattcttgttgcccaggctgcagtgcagtggcaggatctcggctcactgcaacctccccacctcccgggttcaagcgactctcctccctcagtctcccaaatagttgggattacaggcacctgccaccatgcccagctaatttctgtaattttagtagagatggggtttcaccctgttgaccaggctggtctggaactcctgacctcaggtgatccacctgccttggccttccaaaatgctgcgattacaggtgtgagtcaccacactcagcctcggccactttgaatcctgacattagaaaaagcatgaaagccaggtccctttggttttcctttcctgtgtccttcccagctccccactggaagaggagtcctgagaaatccagcctttggttttgctcctggagataccagcaggtggcaaagactcgttaattccccaataaccacagacaattttcccgattttcagcaacctttgaaacaagtgctgtgtgagttgcattcttgtaaaacaccttcatgaagagaggaatcaggtgaaccatagagacttcagacttaatgggtgtgtaaatgaatattaatagttcagctctgtacggagggtctggcgcaaagtcaaatgggatacatgtccaggggatttaaagcaggtcttgctattttgttggaagtaaccaaaattgatggatgccttataataagcataggtgtcgatgtgctaatttacgatgattaatgccgccttgttgattttcatttctcattaggaaaacttagcaagactccagagggcctttgcgaggaagtgggaattcatctttatgcaagcagaagcacaagtaaagtaggtgaacttgatagagaccttttcagagaggaaaagactctggaatttggaaatggtgtgaaggtgggattgtcaaagtgaagtttccagatggcgttagtatttctaatagggcctgagagcaactgagtagaaattaaagtcaggatggataagttttgtcttcataatcaatgcttctctaaagcaatttcagaaatgtgtgtttcagcagacaagggagatcctcccaaaggtagaactctggttataagaaggtgtacctatttccccaagagatttccagttattttctgtgttcaaaggctgaaatcccattttacccgttggactggagattttgtcttcatgggaaaacaggttggagttttaggaagaacaacaagtagcccctgtcttcttttccctgacaggggaggagtttagaaccaacagaaaaagaaggcacagaagtcagacagttggagtccaaaatatcagattattacattaattaaaagcaagagtaaggctgggcatggtggctcatgcctgtaatcccagcactttgtgagaccgaggtgggggtggatcacctgaggtcaggagttcgagaccaacctgactaacatggtgaaaccccgtctctactaaaaatacaaaattagctgggcatagtggtacatgcctgtaatcccagctactcaggaggctgaggcaggagaattgcttgaacccgggaagtggaggttgcagtgagctgagatcgtgacattgcactccagcctgggcaacaagagcaaaactccctctcaaaaaaaaaaaaaaaaaacaagattatagggcgtgacactggatatgtggccccaggtgaaaattaaatctgcccttcctgtacagaggtgtgtatctataggcctcctctccccagcatctccaccccaccccaccagggcataggtgacccctgtaagttttctgcatgcagagagcagctatcctgagcacaggctgacccagatgggggcccagagagggagagtctgaacttcttcaatttcttctttcaagtctaccaattagttaagtcatttttcctccacaaaggacaagagatgaaaggaagaaaaaagttggaagggtttttcccagatttttttctcctggatacatagtggacatttcttcctctctaaggaaacatgaggaatgggtactctatgttccccaccccacaaacatcgttgtcaaccagatccatttaattctgggaaacagaatgattggatctggatctcccctgtccctcccagggatgatgtctaggttagccaggatggttagttaacaggagaagtgggacaggagcaggaaagggatgctaagctgggagaatgggactatgtttcctctgggtaccacctgcatgtgagcagccgctgagtcttcagagcaacattcctgggcgatgttgcagcccgtggcctggagccgggtctcaggctgtgtgggtgtagactcatcacagctatggtcacagttggaagtgacctgaggccatctggtccagtggcctgtacactgccattgctgtgaacctccccccacagtctctgcctttctcctgtccatgatgccagccacctcctgaccacccagcagccccccggggataggcgggtaccaggcactgggtgcccccgaagaggtgcaggtgggagagtaggtaggatggaggctgggattcaactggactaaggcagaattatgcctgtgtactcagaagccactggaaagcaaagaggaacgctaatttgttcttccagaatcaaacagcatcacaagttataaacagaggggaaattgttacttcataaatacatggtatttctcgattaacttttttgattaactctgtgattacattataattgtgggccacctaagtacacagtaattatcacaaaaatcgcagggtgattatgggtttatttcagtccagtaaagtaaagcgttcccgagagagccgagacctaggagttacacggcaattaatctgagttgctttttacttgaaataaaatgaagtaatacatgcttttttaagaaaaaaaaaaaaagaaagaaaaagaaaaaacctcttatctatgctgcagatcagaacaataagaatctgtctttgtcacctgcaatttccctcttgcaatttgtgcctcccccagctgaggccagtgatatttgcctcctggatcttgtctcattctagggccattattctgcctttagaaagccagatggtgtaagtgacttataaaacacataattgcagcattttaaagacatttatttctactgattctaaatctaaagcaaactttcaaatttgaacatggaacactggcaagatggtggttacattccatcttataatttgtatatgcagtatcctttttgataagggggcatatcaatggataattcagtttttaataatccaaatcttaatacttcagatgaacagctgcattcttattcttcccttaggccaccatgttcattacacatgtatggcaatctgtaatctagcctaaaacaagttctcttaccatgtgtggaattcctgaggttttcggggggggaattatacacccctatttcacagctctgcagagagcaggcaccatgcaggtaccaatggccttgtgttcacttagcccctagcaacaggagcaaacgctggagcaagtgtcagaagggaaaacagaatacagagcttcttatttccttcctctctttactctttcaggattgaccggaaaaaagacaagacagaaaggaaaattttggatagtcaagaacgagccttttgggatgtccacaggcctgtggtgagaaagcgctactcaattctctagatttttttttcttaattgttcatttttatctctataaagaaaagaccgtctttagccaccaggtgtctcattcttaagaaaatcgctcagctttgtggaactggtttcgccattcatttatataatctcagtaaattttctggaatatatgtaagttccaccttttaaaaattattcattcggccgggcatggcggctcacgcctgtaatcccagcgctttgggaggccgaggtgggtggatcacgaggtcagtcgatcaagaccatcctggctaacacggtgaaaccccgtcgctactaaaaatacaaaaaaattagccgggcgtggtggcaggcacctgtagtcccagcgactcgggaggctgaggcaggagaatggtgtgaacccgggaggcggagcttgcagtgagccgagagcgcaccactgcactccagcctcggcaacagagcgagactccatctctggggaaaaaaaaaattattcattcctgaaaatatggaattgcaaatggagaagctatgggaattccaccaaaagacctttgtgtcccgaaggtttacattccccaaattaacaatttccatttccactgctattcaactctgaatcttcaactattctctgtcgaatacggttaattcttgttatccatggcagttatgttctataaagtctttgcaaacactgaattagcgcacattgaagcatcactcccgtgggaactaccaagctaggtccccgtgagcctgtggccacaacatttttatcagctgatcgatacataaccttttaaatgtgtttctgtataaagacagcttatgtaatatatatcattgattcattaacattaaactcatggccaacagcactgttgctcatgcctgcatgtttatttcctcctaaggcacatcagagaatggtgaacagcacttcagcactgtccttggggccattttaaacagcaaaatcaccaacaaaaagtacagaaatgcagaaaagttggcactaaattagccctaaatagaagggtctgaaacaaaaaggcaggacgtcaccttgttcaatttcagtgggaaacacacatatcaggctactcaaggtacaactactgagtaaggagttataaatgaaatttagcaagcaggcaaattcacaaatgcaaaatttgtaaataatgaggtttgactgtatttctgatttcacgttattaaaacaaatcttgcattttcctcatgaaatggaactaaaaaataaattattggtcttcttaaaatttgattaaaagcaaaaaataaataaatagctactcatcctgatatcgtggagtctttttcaaacggttaagtatgtaaaaaaaaattttaaggactgtgtctgaggcaatcttgccacttaaatagctaatttgctcttagaaactgtacactataccctctacatatcatccttagattatgaggtaagcttttctagatcgtatgggaactccacagaggaatgcatattatggcaaaatggaaaaaaaaatcatgcattgtctgtaatggaaaaagataaagattggtcctgatggtgtgacatgggctaaattggaagtgtaattttcacgtagtaatttatatgatgtgttttttttttctcagccaggctgtgtgaacacaacagaaatggatatccgaaaatgtcgacgtttgaagaatccacaaaaggttaaaaaggttcgctagtttagctgagttaaaaattcctgatgtgaatagcccttccagttctagtactattcaaatagtaatttgctacttgtaattctaccaccttttgtcatttgaaaccataaccatttcacaaatattgattgagcagctgatgcatgcttggcgctgtgctcgtgctaggatacagtggcaggtcctcatggagcccacagcctggcaggagtaaaacaagccaacaggcaacagggccatgaatgctgtgttaggagaggtacaggacagttgaggagcccaggaggggcagctaagccagacctggagtgggtgggggtggggggcttcccaagggcttcctgaaagagggtcaggtgttctgaagggtaagttgcagttgtcctggggaggtggcagggaggggaggaaacaaaaggagcaagaagtggcaaagctcacaggtgaaagcaagctttatacttagaagcaaataaaagtcttttttatggtttttttttttttttttttttttggatagagctggatcacccaaactcaaaccaccatcttgtccaactgtgaatgacccagtggtcacttgtgtttcactttactcaaaggagtagtggtcacagcatacccgagggtgccatgctcagactcccccacgattcatatgtcccaccctctccacagcaccagggacaatattgcaggacagcatgaccagactccgtaatattaatttccaaagagtgggccaggtacggtggctcacacttgtaatcccaacacttgggaggccgaggtgggcggatcacctgaggtcgggagttcaagaccagcttgaccaacatggagaaaccccgtctctactaaaaatacacaattagctgggcacagtggtgcatacctgtaatcccagcttcttgggaggctgaggcaggagaatcgcttgaacccaggaggcagaggttgcagtgagcagagatcgcgccattgtactccagcctgggcaacaagagcgagactccatctcaaaaaaaaattccaaagagtggagatgtgtccccaaacattcctatttcttgtgatgaccaattagctctctctcatgtatgcattaaaaaaaaatacacgcacacacacacacacacacacactagacatggcgtatgtatataaacttctttaatctacttacatattttgttcgtcactgacttaacaatatccactgtattatattttaaaatgttagtcctaaaatgtcctcatttcatcttcaagagccccataattctaacattacagaatttcatggagtcacatccaccttatctgagcccttctgcattttgatgattttgactacacattgcatgcccttcagtgtttcatttctttcccattgcaaagattgtgtttagtctttccgtaatacgaggaacagctttaaatgtagctatagctacggacatgtggaaaaacttaggccagaaaactgtttaacttgaaagggaaaccctgaaatgctgccatcccagttttgtaccagatgggaatctgctgaccaacggaaatgtagaggggatcttttgtgcatactctttggcagtggctcttgaactttctttattcagaatcatttggggcatttgataaaagtgcagatttccaaacccacccacaaagattctgatgcagtaagtccagggggcgaggggatactcagcaacgtgtcttttccaagcacacccaggtgattctttgcaggtggtctatggaccatatttggagaaacactgagatacaaggaggctattttcagcccaataaaagataggatttgggttatagtggtaccccaaagatgagatgacatgccttaagaggcagcattctcatcattgaagaaataaaagcagagaccaatctcttattgtcatgaggggattcacgaaattggatgagtcattggactagctgacccctaagccaccctccaattctgtgggtggatgatcctctgtgcttgcttcttctcctagtccgtgtatggcgtgactgaagagtcccaggcacagagcccggtgcatgtactcagccaaccaatcaggaaaacaacaaaagaggacatccggaaacaggtgaatgaattgacagcttgcactctcaggaggagacgtggccagtttaaaaaccctttcaaatgttcaactctgaagattgagcaagctttgagttcctggaaaccacagtggaacccagctgtgggtgattgaaccttttaagtgctgtgtgtgaacaagccacggaagcttgagagaaagaattctctacccagttcctccagcagttactagaaaagggcgtaaatgagtcatcccatgccttggggtaactgctgtaatggggtttcccacagtccgctgtgggagctggaggaaggagggggctcatgtcacacagtccttataattggaatgcaccagctcaggatggtctactttattgctgtgatttgaaaggaaagtttaagaataaataaagctctactcccaatgccatttcagcattacttggttgaatgttattttctttcatgatgagcagcccaggtcaacagacaatggctaattatattacttccttctgatatttactggtaacaaagcaacctactgtttatattatgccttgctggttcctagagggcaaaacccaaaggagtaaactttgaggtgcttgcccttgacaagtttattatctgatgggtaagaggtaatggatatatgaaaaaaaaaagctatttggcggggctcggggctcggtggcccacacctgtaatcccagcactttgtgaggctgaggcaggtggatcatctgaggtaaggagtttgagaccaggctgaccaatatgatgaaaccccatctctactaaaaatagaaaaaagttagccgggcttggtggcgtgtgactataatcccagctactcgggaggctgagacagcagaatcacttgaatctgagaggtggaggttgcagtgagctgagatcatgccgctgcactccagcctaggcaacagaatgagactctgtctcaaaaaaaaaaaagaaaaaaagaaaaaaaaaccacacagaaaaaaagctatttgatgattccagtcaagcatgccaaggacatgggtgtgacgtgcctgtgaaaggtgggcagaggaggggtcactggggattgttcaaaacaggtatttatggggcacatttcacctgtccatgctgttgctaagctacgtagaaaatacattgcctttaaattttggaaagcaagacttaaatcacaccacagtataggaggagatgagacaaaggctaaattgcagaatatgaatcttgtatgatagggatgtccagaggcacaagtaatttgctggagggcagagctgagggagttggagatgtctggccagaggaggtatttggatcttggtggaaatgcaggatttgggtttgtggagcgaggggaaaaaaataattttagtttggtcttaacatctgtgttctctattttcccagataacatttttgaacgcacagatcgacagacattgtttgaaaatgtccaaagtggctgaaaggtatgttttcctttaataatattactactttcttctaatttaacagggaagaaatgttacagggttatggttaacgaatgtgttcaatgccaagagttagactgtagttattccttagactggggtgcagaaaaacccacaggctccatgtgagtataactaagataacagacctcccttgagtgatgtcaagaaatgttccgttgctaaggctttacagggggtggccacgggaccttgtcaatcaaggaagaatgtcctttaaagctacataatgcacctttgccttcagcctctggattaattcaaatggaaattgctcccctttcagctataaaatgcccagattcactttataggggaaaagaaattatgtgtgtcctttgaggtgctggctgcatagacaggaggggactggatcatcgggaagtgttccgcctccacacgccatcaaccactgaactgcatcgaatcagctgtaaagaaaatatttggcccctccagcctggcttccacagcggtgtgtgtgcttcattctgcaccagtagctagttccactccgttaactcatgggagactcaattttatcaactaaatggtctgtttttttaactcttccgtgaagatgggagaccacatggggaatctatatggaataaatctaaccaggcagctcagtagtgaacatttattcatccatatgctaccgttaaagcaatgaccaattgcttaaggaatcaagagcttaagttgggtcttggtatttattggatgtcagataaactgagtcttttaagcccagctcctacagggggctggctgtgagagccatctataagcctgtaagcctttctctgctggctcctgggttgattcacatcttttttctagataaattacaacaaatggaaggtataaaaactccaaccccaaacaaagagtctgattgaataccctaccttcaggggctaaggacatccctggacttgggctcacgtctttattccagggtttctcgattgtggcactagtgacattctgagccagataattccttgttgtgttcttaatgtcctatgaattataggatagttagcagcattcctgacctctccccattagaggccagtagtcccccaccaccacagctgtgagaaccaaaaatgtctccagacattgccaaatgtcccctgggtggggtgaaagtcactcccattgagaatgactgacactcctgctttttctatgcaaatgtgctggaaagttgccctggctggagctcagcttacactgaggtactgatcactctggagtcgctgtttcagctagctgtgtaggctgcagaatcacctcatacctcctctctcatcatgtgtggcttctggccagagtaccaggctctgaaaatgctttttaggtctcactgtggttcctttgccccagaaaggtggctgtgagtgaaacagcagcatggcctcaactctcttggtgtcatccatggcctgtgaggaaccacgagcttctttctctgtgaactagggacagaaatggctgtcctagtatactttgagggtcggtgtgctagcaatgctcatgtctggccttggaaggtggaagagctctttagggtttgcaatttagaaagagcgtatatatgggagcatctgtttctttggatctatttgctcaggtccagtggttctaagtaccgtaatccaggtgagggagggggttaaaaaatggaaattcccaagcctcagccctagggattcagattcagtggttccagggttgagccaagaaatccacattctggataatcttcaagtggactgatctggtctttcaggatccggtgaagccattgcctgctactcaggctgacctgagagctcacatccaatttgttatatctttgggatgcagagaaagagcctgaacctgtcagcatgagggaggcagactccagggcaggtgtgcagagagtccaaggaatggaggaaaccaaggtggaggcggggagcccggcccatcctattgtttgtttgtttccttgctgtcagggaggggccccacctggtaccacctaattatgcttgagaggctgctcatattgaaggattattccaactggctactcctcggtgcccagctagaagctttcatgagtctctgcccggcagaggctggattttattcccagcagcaataactggcaacttttcaatgcgacacgagggtttttcattagagccacaaggaaacccccagataaggaggaggagggaaaggagacgcgtgttagctggagataaagcagctgggagccgggcctgtcagtggctctgtgaagatggggccagggaggaggtgctggcagctggtgagaagctgccagagatgcaggctgagctctctcaggtgggcacgcacatccacatccacatccccatcctgatctggcttccctgggcctgctccaggtgataagtggcaattccatatcccccaggaaaccgcatcccccaggaaaggtcttcatcatttttcacccagttctgtgagaactaatagtgaggagaggcaggagggctggggacagcgaggctgggctctgggatgtctacagtcagggttggactaaagggtgcatccagaccagcagggagggaaaaagggaactttgcaaactaaaggggcagaacagacagtttaggggatgggtctgaaaccgaccatcgaggtttgaaacctacccctgccatttcctgttttctaactgatgaagccagtggcttcttctctcggtgcctgtttttacctctttagaggggagatagtagttgtatttaaattataggattaatgagttcatgcatggcaaaagtatggtccagtccttgggactcagtctgcacactgggaatgtgaataataattattttccagcatgacacttaacttgtgctttggaagagagcagaattcaaggccatgagacagaatgaactggatatatggtgcttaaaggagcaaacaaagggcaggccaaggagggaggctgctaatgcaattctttcctgcaccctctgtctccccccagtctcccacacagagatctctgcaggctgcccaaggctgaccttgcactgcatgtctccttccactgcctcacacgccatcactaatctggggctttgcgggagaaaagacttgctcttctgcacagaatttctcagatcatcccagttccaaatattctgtccattgtcttcctgagtgcttaagtgtccccaaaatgccagcatcgtggcaaccaaactgcatttcctaggctgccttttgcacctggaagcaacacaaaaggctttctgagctgttacccaatttttgttgcagaatgtattgtctctgcacacacacacatgagtgtctcagataaatgacacttaacaccctaagctttttattttaactttttttttttttttttttttgagacggagtcttgctttgttgcccaggctggagtgcagtggtgcaatctcggctcactgcaagctccgcctcccgggttcacaccattctcctgcctcagcctcctcagtagctgggattacaggcacctgccaccaagcctggctaatttttttgtattttttagtagagacatggtttcaccatgttagtcaggatggtctcgatctcctgacgtcgtgatccgcccgcctcggcctcccaaagtgctgggattacaggcatgagccaccgctcccggcctattttaactattttttaatggcagtgtttcttaaatatggttcatccactttacttcctaataaaaggacactacatttcagttaattttgctagatgactcaagagtcagtagtcttctattatgctttaaaactgtcagtggtcaggatcttataaggtgccctgcttccccttccctaaatggccccagataataatattctttgaattcctgtttctgccttttagttgtctgtctgtctgctttctctactaacccttccccccaacacccaacccctgctttccaatctgtagcataccatgtgtatcagttagctgtcactgagtaacaaaacaccccaaaactcagtggcttaaaaaataggcttttactattgctcacatgtctatgtgccacctggctccactggtctcagccatgtttctctatgtggctatgggttggcgaggcagctctgctgatcttggctgggctctctcacatgtttggcttctgctggtttaggatggcctcagctgggacagttgagcactccttaatatggtctctcaccctccagcagactagtttgaccttttccacatggggatagtgggattccaagagagagaacagaagcatgcaaaactcttgcagattagaactggcattctgtcgcttctgttaccttttattggctaaaacaagtcactaagctggactagattcaagggcagaagaaatagactccttttttgaaactgaactaccacaccaggaaatcaaataaccaaattgattagctttgatcctaaagcaagtgtgaaaagtcttttttgtgaggtgtgttgttcccgataacaatgaaccttgaggcatggtgtttatttcatctgtagactatgcagaggctcttatgctcacttatctcatttgtgttctctggatacttgaagttgccagataaacaaggtcctactcttctctgcaagcgtccccaagggagtccctttttttattcatctaagccttatagcacttgacaaaccaactttgagaagcaacactccatgcattttagtcccaaactgtctagtctccatgtttggctgcgattccccagagacttctcccgacccatagcgagcttacaccacaatcactgcagctatcccagtgcactgctgcacacagagggatcaaaatgtttcattccgtacctgcatctgtacttggctcatcctcaccctattactgggagccattcgtgtgtcacagctgactgctgaattgattttttttagcatcatctcacttgcctgtatctgagattgccgctgctccctgaaattggatgctggttcttcctccacctcctgaccctcagtgatcatgaaatgtaattaatgaaatgagataagacagcaagggactggatacccctaagggtctattaaaaacctgctagggtgatagaggtttgggaacttaatgtctaattatagtttcaggggaggaaaaaagagggtcacagaagtcattacaactttgcttttatgggatttcagaaaccatggggtctttgctcctcctttctcctagcctgttctaggtgacagaaaaaaaaaaagaccggaggtatcattacagccagggtgactgtatctagaccaagatatggaatctgtagcatgtggaaaagaaggggcctccatacctggcctggtgtaagctcttcttcctgcagggctgaattcaccttcatgctccttcactcatcccaagtttctctattgaatgtgttttctctgggtgacttgcaattaaggagttctctttttatattttccctacttcccaccttctccaagtgaaaaaaaaaaagctagattaattaattaattgctaggaatcaaactttcttctttcctctccgcagtgctgctctgcttctcattttcctttctaatcagatccttcctgtcctggttctctgttgtgcatcacagttcagaaactgcatgtagcagagcgaggcgtgccagcatgctctcctcttcaccccctttaatattccaattccaggtcttctcatgtagaggctctgatttcataatgaatgctttagtgcatttgtactgtatttctaaagtaggactaatggtcgtatcccataatgctttagattccaggcctcgtttttgttggattttgtttgtttgtttgtttgttttcctggatagtagtttcccatagctgcaggccatacttcactgtccctttttcctggagcctagccatgtcagtatctcttcatcttctccccacctgctccatatatgtgtccttagctctagggattcctcctaggcattgcttaactcaggatggacagcatttcttcttcctccaacttgtcatagttttgtgtggtttttttttggtggggggcggtcacatctatacaatttgtagcaaaattataagtcttttgttaagagagaaaggataaaatctacaacttttatttttgtcatattttctcaagtggttggactgtatgtttactaaattctctttcattatttccttcccctccatgtttatcaaaggtagaccctaattagcaatctaaattgggaaggttttgcattaataactgtcctcctaccaggattggttactattgttagaagctgtgactttgctgttagctcagctctaacaactctctgagatccagagagctgtttgctatttaatggcatagtaggctctgaataatggctactaaatgactgaccacagagtgtacccctggtagccatctggtagattttttttttttttttttttttgccattactaaaggttcatggggcaggagtatgtgaacaaatagccagttccacatttccactcaagacccagttcaaagcccacgacaatggtgggtagcacatttgctaaaggttcacagatcagcatcttctagtgatgtgagaatttgtcatttgaaaataacaaaagcatataccaatcaggagtcagggataaagggacaagaatgctaaaattgctcattgagaaatattgttcctaatggacttctgaatttcctatatttattttatttcttccatctcatcccaattctgcttttctgccactcacacccagcggttggaggaccattgctgctgtgtactgttatatgctggacatcctacaaagctctttacatacctctattttcttctccctttttgcttctcctctcctacctctagtctttctgtggtcattggtattgactttggactgaaatggtactgtgcgttggccattgctgcctccttcattggcctgcctggccttctcattgtcttgtgtgtcccaagcagactctgttcatcttgtaatctgtacactaccaggaagcacatgttctgaaagagacaacctctctggctagttctacaaagggctgccttgatgaacttgccttcacactcccatcaccttcattcccttttcaactgtattggtttgattccaagcaataaaaccccagcttgaacctggttctgcaaaatagaagcatgccttggctcccagaatacaagaaggggctgtggaattgaaccctgggaaaggcagcaatgctactgagctcaggaaaagctggagccagggccttcagtgcctccaagacccattcttcctctctggtcctgcccactttccatgctgaccttattctctttcatgacagacatgtgttaggaaacatgacaccaccagcccttgaactttgtgactatacaactttgatatggtttggctgtatccccacccaaatctcatcttgaattgtagttcccataatccccacacgtgatgggagggacccagtgggaggtaattgaatcatgctggtgttttcccccatgctatgctcatgatagtaagttctcatgagacctgatggctttataaagggcttccccccttcattcagttctcattctccttcctgtcaccatgtgaagaaggacatgtttgcttccccttcccccatgattgtaagtttcctaggcctccccagccatgctgaaccatgagtcaattaaacctctttcctttataaattagccagtcttgggtatttcctcatagcagcaggagaatggactaatacaagcttctactgctgaagctggggaaagaagatatgaacctcacttgcgtcaggtatctgttcctggacaaatcaaccatggccaggagcagggcttataaataaatacatggcagctcctgaagtagccttgtgtacatgtcagagtacaattctcaggagacaagcagaagtgagcagaaacccatagaggccctctatgcctgctcacccattttggagtactcaccatccagaatccctatctgcttcactcagattcccaagagacccagcataagggtcaacccttgtacattcactgtattcctaggcagcacttctatctccatttggatctcctttcatgcctaagaaatggtgctggacagcctaggcacaaacccaaaagccttttaactctctgcattaagcttagatcttatcctatgtggccaaccttcatttctttcctgtgtcccaccttggaagctctagctaccaggcataaggcacctccagcccagactaaagagacaggagagcaaggaaagggtaaggagtccttgctttcatttcttgtgctgtttctgcacagtctgatgatgttgagaagcataagggaagaggagatcgccttccctctctgcccagcgtggggtgttctttcacctcctctcagtctttggctaccccagctgtgaagttaaccctctctgctactctctctgggaaggatcaccctcccctcccaccaagaagctgggagagcagttgaggcagcagactgctaaatgcccaggtcacccatgggaaactccaagatgcactttgctgtctcctgtcttttccatgcaatgatgatggcaaataggacaaatgagggtgcatagattcatgaacactgggtttatttgcgtgggttgtgatagtggcagcaaaataaaacatggcggtgccattatgcaccttttatctactgccacactctcctccaggtgactttattttctacatagataaatatagtaagaaatacataataatacatttattttttcacataaattgcagtcaaactacacctgtggtaggcagaataatgatctctcaaagatgtccatgttctaatccccagaacctgtgaataggttatgttacatggcaaggagaattcaggttgcaggtggacttaaggttgctaatcagttcaccttaaaatagagagattatcctggattgcccagatgggcccagcataatcacaggttcccggaaatgtggaagagagaggcagaagagtcggtgtcagagtgatgcagcatgagaaaaccatagctggctttgcagatggaagggggccacgagccaaggaatgcagggagcctctagaagctggaaaaaggcaagcaaatgaattcttccctagagcctccagaaggaacatcgccctgctgacaccttgattttagctcagtgagacccatttcagacttctgactcttagaattataagacaatacatttgtattgttttcagctgctaaatatgagataatctgttccagcagcccttagaaacaaatataaaaccccagtctctccccttctcatagaatctgaaggccaaattgttcatcctctttgtctttaatataccagcatctccgagcaccccgctgactaggagtgcctcttatagccccaatacgtgtatgtctcattctgatgattcaatacttccttttcccatcaataaaatacaacattcaaaatatgtatgcccatctaattttactgtttcctttacaaagcctctgactttatttatgtaacttaacaaaatagatttccctcttctaatacaataaatttcccttccgaccagtaccactcatctctgacactggccagcagattagttgctcgtaatgactttggctttgttgcctggttcaggttgtcaggactttctgtgttccttctccacgtgttcctctatagcatgtcttgacgcctcttgcctagaccttttttagagaaggcatgacatggcacaagctcccaggaacaatttcattcatgcttaatgcctgttgcaaagtcatattttttgctcttatgttgggtggtcacaaaaatctcaccttgggctctcaaccacattctcctaaaccaacatcaccatgagctctcaccacctctcttccacccacttctctaatgatattccaggatttttcttaaagagatctggctatgagcctgtatttcattacagcttaaataatcatattatttcccatttccttagttgctctctggacttttaagattctactgccttaggctggtcagcggacagctgccttcattgccatgcatatagtaataggcagctggagcctgcaggctcctcttgggaccaggtgctggctgaactctcaccacagcctctcctgagccttccctattgtcccctcagcccagcactcactcagggctccatatggggacttgtccacaggacctgacctggctggttggaccccacttcccaggttggagatgtgaccacatcgaggatctgctagaacacatttggggaggggtctgataaaaaccccagcctgtctcattgaaatctaaggaagcaagagggaggaggggaggacatttcatttttcaatccctatgttctacttcagggaaatctatttctggtcttaaaaaaaaattccccaataacgtaattaattaaaagaggtcctaccttttgccttgagctgccaagtggatgtcttttatttgagattcaaagctaactaaggctgagattattggaatggccagggcagatgtcctgggaggacaaagggggcccccccaccggctgtttgctcatctcagattttgagaatgccatggatgctgaaatgcctcataattgggagaaccccccaatatgtcatcgtgactcagatcctctggggcacctcagtacaactcgtcaccccctgaacaggatttcggttttctgctgctggcttgtctttgtgctgatctgagcaaaggagacaggtagcccagtgttctctctgtatccccacatccagcttgctctctcacattccctgtagtgggttgaatagtggagccccaaaagataggtcctaggccttacctgtgaaacctgtgaatgtgacctcctttgggaagagtctttgcagatgtaattcagttaaggatatctacataaatcattatggattatccagagactccaaatccaatgacaagtgtcctcataagacaaaaaagagagcggatgacacaggcacagaagaaagccatgtgaagacaaagacagagatgaaagtgatgcagccacaagccaaggcatgcctggagccaccagaaactggaaggaaaagaaaggaaaggaaaggagaggcaaggcgaggtgagacgaggcgaggcgaggtgaaattatcccctagagccttcggagggaggatggccctgccaacaccttgatatcagacttctagcctccaaaaccgagtataaacttctgttgttttaaccatttgtggtcatttgttattgcagccctagaaaactaacatattcctcaacatgcaatgccatttcttttataaagaattcaatcagcccaagtagctaagaagtggcttccaggtgcagcaccaacttgtagcctggtccttcctgccatagtgctttcttacagctcccttgcccaggttcattctgcctgagatgtcgtaaagctcttgatatggtttgcctgtgtccccacccagatctcgtcttgaattcccatgtgttgtgagagggacccagtgagaggtaattgaatcatggggcaggtcattcctgtgctgttcccatgatagtgaataagtctcatgagatctgatggctttaaaaatgggagtttccctgcacaagctcgctctctttgcctgctgccatccatgtaagacatgacttgctcctccttgcctcccaccatgattgtgaggcctccccagctacatggaactgtaagtccattaaacctctttctcttataaattgcccagtctcaggtatgtctttatcagcagcatgaaaacaaactaatacagctcttattggtgaagcctggccccagggaagatgcataccttgcaggagatttataggacagaggatgtgcctctagtgtgcccgtggtttcgcttgtctattttatatttgtagaggattgtcaagattctttggagatgctttcccattttctatcacaatggtcctgagtgctcaacaagcctgttatataacatgatgaacttgacaaagatcagttaaatgactcaaccaagaattcaaactaaggcttttcaactgggaccactgctgcttctaccccaggggtcatgataaacacctgggacagcgaggaggctctgaggtgtccgaaaatttacatccatcttcaaaaccaaaattaccaggggctctttcattttgatttgatgaataaaacatcttgtgtcctgaatgtttcagaaaattgaggaatgagatatggttctctcaaacttggatgtgcatatgaatcacctgggggatcctattaaaaagcagaatctgactcaggaggcctgggctgggacctgagatcctgcattgctaacaggctcccaggtgatgccagtgcagctggtttatggatcacacttccagtagcatgagatggcacctctgactaatttctctgcctgttcagcattaagctaattggccattattgccctttgcaattcagtagtaggaattgtggctctgactttgctgttgtgggagaagatgctgacacacaagctggcaatgcttaaggaaaaattttattgtggatcgataaccataaaaatattcataccttttggtcaaataattctgcttatggatatgcattctaaataaataacccagaagatgaaaaaaaaaaatctgtgtgaacaacggtgttctaccacagcactatgtatattaaaaaagaaaaaaatctgtgtctaataaaaaggaaacgattaagtaaattgtaataaagtcactcaatgcaaccaagacaatattgtagacatatgttcatcttctccctttcctcaaatgcaacatgtcactaaaggaacaaaaatggcatgaactcacaaggttaacaaactattaataatttcaacacatttgtccaagatacaaagtttacgtaattggggaacataaccacaggcccctatgtctgtatttgttattttttatttttttaattggtcagcgagtacaaggtatcaaagtaaaatcttacaatttttatacatttctgtatgcctgaaatatttcaaaatttaataaaaaagaaagtgcatagggacagagtaaagaacattctaacctacatgttgggggcagaagtgatgtgacaaagtgagccagttttcgcaacaaagcctggccttggctcttgaaggcactagggaccatggaaagcaggaatgaggcatggggctaacagcagaggaatggtcaagtctgtcacaggagactttgcacccctagatctcctgccctactaggaaacaatccttcccacctaccaccactgcaggagatgggcagttttttcttgagagaaattgagccacatacgctcagatctcagacacatcagatctcataagaggccacctgaaaataagagaattaatggaagctctacgcactgaactgtggggcctgtagggatggaaagtgtgatacctttcctcatctaccataaggattacggccaacactgctataacaaaagaggttaacaagagaaaagcataaatgcatttatttcatcagtttcacatgacacagaagccttcagaaatgaagactcaaagacccagggaaaactgtatttgtgcttaggttccatgaagaatgggaagccttgtagaaatgtgattggacaaaagggtgtgatctactggtaacagactgaggggaggaaacccagcaaggcctgtctgttcagattcttcttagtgtctctgagtagcattcctacctcccaggtaggacctctctggaatgagggttttcaagggagaagggagcgagtgacctttctaggttttgtggcttgctttgcaggagaggcattctagtttctatgacccactttggcgaaaaagaattcttgtttctatgacttacgtcgggggagaaaaagggatgggagacgggggcaggagagaaggtgaaagccttggcttctgaggcccttccattctcctttagttcaaagtactcagcatgccaacatactatactttagggtatcatgttctgagccccaacagaccctcagcccctccccgaccctgctctcaggcctccaggagccagacatatatacccacaggcaagagactgtcaaagtacaacctgtgggccaaaccatactccattctgtttttgcaaataaagttttattagaacacagtcacacgcattcatttgcaagctgtctatggctgcttttatgccacagcagtagagctgagtagtggcaacagacaccatctggcccacaaagcctaaaatatttactatctaggccctgcagaaaaagcttgccaatgcctgccctagggaaaaatagacgccccagaggaaagactccagatccctcatttggagctcccattaaaatactggtaaacttccctatgacaatgaagcccatcagtgacaagccccatccacacgcccactgagccgccaagcaggtttcagtacctcagtcttaagtacaaatggatgtccaaagattttccagacactccaggaaggctcagcgtgaaagagtataatcaaaataaaccgacagaaaaaaggaacttggaagaaccaaaataattcaacaactggaagaaacttacaataaaagtatagaactcatattatctgagaaatgagaaggtatttcatccataaaacaagaactagacactatgataaccaaaagtgaactctgaaacttagaaagtaatggctcaaaattaaaaaataaataaatagttaaaagagagtttaacaaaaagacaaggagatgaaaaatgggagggaaaataaacaattcaggatgtccaatattgaactggaaaaaaaaatataggacaagcaaacaaaggaaacaaagggtttaaaattagtgatgaatactataaaattcctgataattattttcttatctatcacacactgtgcccagcatagtaaataacaacaaccagcaagggccatcatgaaattgcagaacactctagcaataaagagatgattctaagttgacagagagaaaagaaactgaaccaaagaacgagaatcaaaatggatccaggcttctcaatagtaacactgcataccagaaaaaaaaaaacatggagtgatgcctacaaatttctaaaggaaagagatttttcacctagtgttctatgtctagcactatcagtcaagtatggagataaaagcatttttagacttgcaaggattctcatgcatcctttattacgaaactactaaaggatgtgcttcaacacaatcagggagtaaaagcaagagatagacatggaatccaggaaacatgggcttttcaacacagaagtgaaggaagtcccaaaaagatcattttccatcaagtctatagagcaaatgatccagtttcgagcaagaagactaaagacttcaggaaagaggatctctgggaaacaagaggacagaactgctcaattatttgatgtgtttaaggtataaaaaaatgattgctagatgttttacaggtttgttaaaacacttgcttggaaaaagtagtatgatatttagctgaacagcaaacaatttttatctagtttaataatgttacactgaccattgatttaacaaaaattgtaacacaaatctatttggaggatcacgtaagaaaaggagggagttgaggactggtgaatagaaagataaattcttgtctaaaataaaaaaatcaggaatagatataaaagcgtataatttagaaatatataggtagcttttagaaaaaacataaggtggaaagtagatgcctctctgagaagggatgggaggaaaaaataattgcttttgcttttttagtatatataatcatttggtactattttattattctaactattcacatacattttgataagaataaaaattagtctaaaataaattatatcaatctataagatcaacatatctattagatcataattataactagaaaagttgcttttttggaaaaaaatgcaaatgtttactccttgtggtctgctgatatttaaaagtctttatcataagaaagtccttccgttgggaatgctgagctggcagtctggtggagctgtagtgtcttttgtgtgttccagatgcctcgagaatcagtctttgtgggagggtggaacacaaacagttttgaccagtgtattagtatcagtaaggctagcataaccagggagagatgcaccaaggttcaggtaaagaatcaagtgaggaaaagatatataaaatgcatgtatatatcatggctgcaacagtgcaaaaatggtatgttcgttataagaaggaaataaggacaaatgaaaacagtttgatgtgtcagaagtgggagcggaaataaattttttcctttaatttagaattatgtgaagactgctataatgtttgtgtaaaacagaataaaggggttttctaaggaaatcagtggcattctttgctctgcctccctcctgcagtttaattgcctacacggaacaatatgtggaatatgaccctttgataacaccagctgagccatccaacccttggatcagcgatgacgttgctttgtgggacatagagatgaggtaaaaaatgttttaaggtttgggagtgggatgaatgtagacaaaaatccatgagatcatgagattaccttatattctatcttaatttgacattttttatcgctagaacagaaacccctcaagtagcctcccagctgagttctacttacagtttctacctccttatagctttgatttgtgcatggatcctttgtggctcccctctgaccctttggataccatgataactgagacagtccctcaccattccctagttctgattgctggaagaaaagaatctgttgttccaattttttttcctgttagacagcaacaataatgataatagctggcacgtattctgcattggccacatcctgcagtaagtgtctctcactgaatcccctcgacaggtaaacattactattctcaccactcagcagttatggaaactgaggcacagaggagttaatgaacttgcccaaggtcatactgctagtacagcagagttaggactagaactcaggcagagggctccagaaccatgatttcatcactctgttcttctggagtaactgccagcaacgattccagccagtttctccttccctgtgagggaagccactgtgtttacttaagaggggaggaaccaaagcccagagggacttggaccactttcagaattacagaaggaaacacacagacaaagctagtgtggtgtgccttcacaccccctgcaccttggctggatgaatttttatttcccttttcatgtctctgtcactcacattgtctttcacttttgccccttttctggctgcttttcctgaaatggaaaaaatcttataaaaataataaaagtcgcagatgctcattctaaaaagttcaaattatccagatgtgcataaagaagaaaatgctctcttcctccaacccgatttcaccttccagaaagaacctttgtttatagtctaatgctgtggttcccagagtggatcagagcaccctgagcactgtggggaactcacagagttaccactggatagtccaaattttttatggaaacacagcgatggttgacacatggcagatactgcataaactactagcttaagatggttcagtttcaacattagagcacgttacatcccttatgatgatacgcatctttgcaaatctggcttttcggagcagtcactatgataaaaagcaagaactgcacaaaaattaacatggaataagaaatagggacggtaagttccaacctaattccaaaatttaagaaaatgcgtagtgcccaataggtgcatattgtagttatttaagaatgaaaacaaaattttcaatttatgtgtctttcaaacagctactaagttgttaggatacaaatacatattaagttgattggtcctagccataataaatgacactgttaagtatttcttttggcccaggggcactgtgaaaaacttactgagacgctaagggtaccatgagctcagcaaatttgggaacatctgatttagtgtctattactttggatttttatgcacatataacattctatccttttgtataattgggttcaatatatatacccaaatatgtacatatatatatatagtccaataatttttaaattaacaataggtcgtggcagtctttccatgtaaacacatatagatccaccttactctttttaatagctacatactatcccctggcaccggtgaagtaagatttattttaccagtacctggatcataaatatttagcttatgtcctccttttttgccaccataaacaatgattccgggaacatctttctacacaagttcaattatttcatcagtatatattttccaggagtagaattcgtagaaatggtatgcatattttaattttagttcgtaggtccagattcctcttgagcaaaactgtaacacatctttttcattcccttagcttaaaagtgcccatttccccacattcttaccatcccaagcatcatcaatcattttgtctttgcaaatccaaaaggttaaaataattctcattttactgttttgtttccttgttaatatacttgagaatcttttcacatgtttattagacagattctagcaatatgttttgctttggatatttggatataaaacagtcacatttacttgaatcatatattttatctttttcctgatatatttctgaatctcattctttgttcttgtttctttttctcttccctgacttttactttattaatgttatattaactttgtaaaaaccctagtttctattctagttgtattaacttttaaatgttttaattaaaaacatcatcgatttaaacaaacaagagtgaagtatataaaatagtgaagttacctttgcctcccttaaatcccattcttcccagaggtatgttaacttgatatattttaaaccaacatttttgaacttgtatttctatgaacatttaaagaataactagtatatagtacgtatcttctttctaatatttctgatgagccctaggtagttccttctaagtcaagaacttaactctttctttaactcaggattttttttctcttttttaaaaattattgctgctttttttccattctatcctcacttttcaggaaatccttttttaagaagtctgggcctctgggatggagttgctacatcttttatattttctctattataatttccatcttttagtctttttattctatattcaaaggatacaatttcctgaattgctcttcagaatcactgctttgattttcactggtgtccattctgtgattttatactttagagagtttttcttttcccactgagtgttgggagagtggttgataatcaagcttttcatttccaagacttcttaatacttcttggactgttcttttcttagtagcctgctctgttctattggtgtttatcatgttactccccctggagatgtgatatagatttttttcatagtttatattttttccatattttcatatctcctctctatttctgccgcttagttttattcggggttattcattagagaatcatcatttctgctcattgtttcattcattcctctggtcactgctcagagcagatcattctttttgtatgcccagctatttggaagactgctcatttttataaatgaaggtcttagctttcaatcctgccatacattagaaccacctggaagtttctaaaaaatactaatgcctggtcctcacacacagccaattaattcagaatttctcacaattgaacattgttttttaatctccccacatttttttttaaatctccctttttaaatcagggagatttaaaaagtctaatgtgcagccatggcctaggactctatcagtagctggtgagggtgctctcagtgatggtatgggccaatggttctaagccatgctgtgcatcagaatcacctgggctcctctttaaaaatacacgcatactggggtggctctgggcgtctgcatcttgagcaagcaccccaggcgttctgaggcacacgacagtttaagaagtcctggtttggttcacggagttccccggcaggctttcccctgagcagttcacacaggagcagggctgcacctgaatgtatgaatggatgggcatagatcaattgccaaggttcccctctgggtcccgggtatgtggtccaagaacagattaaaagattgggccctctcttacagtgagacaggtggcaatgggagtcttggggaggtagacccccacccttcctagtgtgacatccctgcagccaagtgttctactctgtgggtcaagccctgatggagtttctgatgtctttctatttcctcgccaaggtactccccaacaagtcgactcttctccctccactaatgggtcttaggggaacccacttggatctgcgaaagccaatgagaggtggggagaaagctaatgtgtctttaaaatctccctggttcccaagatgttttttctctgtgtgtgtgctgtgctggcaggaacacaatcctctggccttactgtccatatgagaagctggccgggaaacatcccccttaacttagcaaacccttttggccatgtggaacctgatccatgttcctgagttgcttccatatgccccttgtctgatgccacccactgcctccacttccaatcctgctgctcagagctcggggtttcccaaggcttctgttggggacactcagctattttcttctctgatgcctccactggaatcgtaggctgctgtcgatcagatatgtcacaagttcagtctatgtgcttcgtgccttcctgaaatttctcaaagctctcatctgctgataggaaatttctttgcctctacatactgtgtttagtttttttggggtttttttgttgtttgtttgttgttttttttttacttaactgagctctgggcttttgcctgttccctcctcgttggccacttgtcccccagatcctcacatggctggcttcacttctcattcaagtctcactcagcactggtgtcccttcctcagaagggctttctgtgaccaccaatctagagtggccacctcatccctccagctgttctatatcacatcctcctcctggttccctttctaaatagaatgatttcagcgcctaggcctatctggcatacagcgggcaccgtgtgggctggagggaggatggatgaacaagtcattctttatttgatcgtttcattggtatttgggaaaggaggagaggcaaatgtgtgaacctaattcacaatgataaaatgaacttcctcttttgttcttgaaagtcagcaaagaagtatgtaatcatgtaggaaaatggggtcgcatggcctattggtttattccaacctattcagcactttttccccaaggaggtgctacctgccccctactactcatgccctggttctactcctgttgttctagcttcgactctgaacttcatgcctaatctaggatagctacagtgttctgtccacttacaggcagaatcaagtgttcagatacaagtgaaaacgaagccctgtttcttctcccaacagactactcctacccacttagttgctggcagtgatgttaggaaaaaacagggtggaatcagtgtcaacatcacactccagccaagggatggtttctgtccacaaaacgaaggctgaagatgaccaataaaataattgagtcactttctctcggtttcagtttaattcaatacatttgtatagtagtcaactatgtgctgtgttctgaacaagaagggctctcaagataacaaatgtagcaaggtaaataaaacatgctatcttaccatctggcaccagaactcctccttgcttggcaaaggacattaagccacttggggcagaaggtaaggccctaagggcagaagggttggcagagactgaaacaacaaagggagagggttgtgctgtcctgctgagaaaacgagacaaatgtattctctgttcctgagaggggagaactaagggcaggggaaagcaggggagggagagaagccagaggccaacaaaaactaagtctctgtgcaaggccagggaaatgcctagcattgaggtgaccagggacttttcaaaagcaggaatgtctagtatgtgcttttttaaatagtaggctgccaggaggtgcgatatgtacccatttttcaagaccctcaaattcctgtaaggcccccaccctcccaaacgcttcatgagaggaggggtttggtgggtgtgggtgaaggtttgtgggaaaggagagacagtgagaatgcaggactcccttaggaattcctgccaatctcaggtgggctttggacttcactgggctgggtgaaggggtccaggcaggctcgttatgatttccagggcccaggatgtcaccgacaatgtctaaattctgcaaggtggagaatatactgagtctgccgtggggaggttacagacagccaaatggaggatggccatagcagctgaatagaatcacggataagatgacataggatatacaataaatagcagaaaattgtgctttaattctttctccttctcagacaagctattcgatctggaagtccaaggataagaaagttatattcagaggggaaaaaaaggcaactgttttaaaggatgggcaaactacacctcaagtttatgcaacatagtgagctgtgatcgcaccactccactcccgcctgggtgacagaacaagacccctaaagaaaaagagtaaattctgagaagtaaagtttaattaaagaaaatagtgattgccagggcttctcattgaggagaagtcagtcaaaagttgccagatgacgtaattctttatgtcatctgaaaaccaccaggagagtgtcccagggatacgtatgtaaagtatttctggtggtgccactaactagatgctggagtctaatgaaacctggtgttgtcagcagaatgtggtttgtgatttgctctctccgcatgacttcagtttagctctccctctctgctgggtatcaggcacatgagcaaagagctacaaggaacctggcttgtccagcttggccgtaggcattcactcccagccaacctgacctgctgagaggcagagatcatccctgagctgcccatgcacagcgagtttgacagaactattaatccggaatattagtcaagctcctttcttatggtggtggatctccaaatatggccccattggtgccttccctctttacatcaagtaggacaccaagaccaaggccagatgaaaagagagggagcacctttttccctctctcaaactatttgagaaccagtaatccagaacccctgtggtggcttccaccttggtcatttgaaatatttgctcttgagacattccttcttggaatccatctgccatgcttggagaagcccaagccgttggagaggccatgtgcagacagtctggtcagtagcctctgctgagctcctggtcagcaactagcatcagctgttaggtgatgagccctcctggatgcacagcccagtcaaatctccaaatgaccccacctccagctgccatccaactacaaccatgtgatccccaagtgagaaccacccagtggagcctagtcaacccataggagagtgaaagagactaataaatggcttttttaagcccctggattttaggatggtttgttacacagcgtaaataactgggccaggcgcggtgacttatgcctgtaatcccagcactttgggaggccgaggcaagcggatcacgaggtcaggagtttgagaccagcctggccaacatggtgaaaccccgtctctactaaaaatacaaaaattagctgggcatggtggcaggcagctgtaatcccaggtactcgggagcctgaggcaggagaatagtttgaacctgggaggcggaggttgcagtgagctgagatcgtgccattgcactccagcctgagcgacagggtgagactccatctcaagaaaagaaaggaaaagaaaagaaaaagaagtaactggaccactcttcattggagtattcaggaccctcaggttgttcttgaggtattaaataaaattatgattgtttctttagtagccttggctctgagatggggacattggattattttctttttaaggaattgccttatttcgtaatttttctaataacttgtcttagtctgttcaggctgctacagcaaaaatgccatatactatgtggcttaaaaacaatataaaaatttttttcacagttctggaggctgggaagttcaaggtcgagatgccacagattgggtgtctggtgagggcctccttcctggttcataaatgtctgggtcctcacatggcagaaaggcaagagagctctggggtgtccttttataaggacactaatcccactccacgtgacctaattacctcccaaaggcttcacctcccaaaaccatcacattaggggtcaggatttcaacatataaatttgaaggggaacacagacattcagtccacaacattctacctcaagatccccagaatttatgtcatcttgcatgcaaaatacattcattccatctcagtagtccccgaagtcttaacttgtcctggcatcaattctgaagtccaaagtcttatctgaatatcatctaaatcagatatgaatgagattaaagataccattcatcctgaggcaaattcttctccagctgtgaacttgtgaaaccaaacaagttatgtgcttccaaactacaatggtgggagaggtataggatagacattttcattcaaaaagagagagagagagagagagaaataggaaagaagaaatgggtaatgggttccaagtaagtccaaaatgcaacagggcagaaaacattaaaccttaaggctctaggaataattctctttggctcaatgctctgtcttttagacccactggggcagcagccccacctccatagctctcctgggctggagtcatacacccatggctttcctgggctgatgctctggtcttccaggcccatttgggtggcagcatcatccccacagcttggtgggatggccctacagcagctttctcctggggtccctattgctttcccaggctggggttcctcacctgcagctcttctgggcagcccagtccaccatggctctgctgggtgcagcccatattgcagctttctgtggggaccccatcccaagtcactgggcaggagcatcctgatctacctaaattgaagagacgagttgatcctttaaaactgttctgctctcctactacatgtcccttgaactctgggcctatggtgcaagtggcagccctgatgaactctgaattgcttttgagtaattcttccattgtcttgaagaatagttcctggattctgttaagatgactcatccatactaatatacttatcaaacagtcacttggccacactattagtggtctcattttttgcatatgaatagacaaagaatttttcagatcttcaggttctggtttctttttgtgcttaacaattctgtctttaagtcacgttttactataagtagtcaggaagagccaacctgcaccttcaacacattgcttagaaatttcctcagctaaatatttaatttcgttgcttgcaagttttacctttcacagaatactagaaccaaataaaattcagccaaattctttgccactttataacaaggatcaacttttctccagtttctggtgatatatgtctcatttatgtctaaaactcatcagaatggcctttaccatctatatttctaccagtattctgttcaggattatttaggtattatctaggaagattgaggctttctttatagctctcctctttactttctgagccctcgccagaatatcctttaaaggcctggttacagcagtttaggttcctctcccctcctctcccctcccctcctctccccttccctctcctttcctttcctttcctttcctttcaagatggagtctcactgtgtcacccaggctggagtgcagtgtcgggatctcagctcactgcaacctccgcctcctgggttcaagcaattctccttcctgagcctcctgagtagctgggaattacaggtgcccaccaccacgcccagctaattttttttttttttttttttttttttttgtatttttagtagagacggagttttgccatgttgtccaggctggtctcaaactcctgaccttgtgatccgcctgcattggcctcacaaagtgctgggattacaggcgtgagccactgcacccagccaatttaggcttttgctgacatatatctcaagacccttccagcttctattcattacactgtaagccacgttcacatttttagttgttcattacagcagcttcccactcacagtacgaacttctgtcttagtctgttaggactgctgttacaaaaatactatagactgtgtggcttataaacaacagaaatttatttctcacagttctggagctaggaagtccaagatcagagtgctggcaaattcaatatctggtaaggatctgctttctagttcatagatggctgtcttcctgctgtgtcttcacatgacagaagggaaagggagctctctctggtctcttatagagtactaatcccactcatgacctaatcacctcccaaatatcctgcctcctaatacgatcacattgtggatcaagatttcaatgtattaatttggagagggacacaaacatttagtccttaacataattcttaagtgttttgaagatagcttgtatattccccaagtcttagtttagatattgattgaggcaaatgtagtagaaggcaaggtaacagagtggaaaaaaagaataggctttggagacaggcagtcctgggatccaggtcctggctgccacctaccagctgtgtgaccttggacaatctgacctcttttgaactctggatgtttaaatacaatgtcagcctccctggcttatattaagatttaaatagggcactgtaaggaaagctccttacaccatgtgtagcactatgaagctcctgcagaaatgagcattgatatagacaattgcttcctttgaatctggctttcttgtcctcagtttggtaactttcctccatctctagctgggggatcagcagaaatgaaagacagacacccttggagagctttgctatgtgttggtttgggctgtccagtgggaggcaggaacttgataagaatgaagaggcacagaggacaaataagagttagaaaaaggcatccagctagcgattagaaaacactgtcaggataaggacacttcatccacatcactatacacatttctaaactgatttcattttagtgctgaacacttgccatgtgaaaagtcctatgctcattacaaagacacatgaaatatggtccctgacctcaaagagctaaaaaaaaatagctggaaagacaatggcataaactctcgaaaatccaaatgctgacataaaactctactagagaatatgtcccaaggaaatatcgctacacaatggatgtaaagagactgtgcttctgtggattgtttgcttgaatttggctgagggacagttattgtaccacttacctggagatggatgttgaaagatattttaatttgcagaattattttataaccataagagaccattcagtggtaacaacatgttcaagtcttttcttaaaccttgaagtggatgatattgggaatactcaagtgatacagaagagatatgtatagggaagatgtatctaggaagcttttaatagaacagactcccagtagtgaaatcgtactaggaaaataaggaagaaatgtggatcatccagttgtagtaatacaattgtgaataatggatagttgagggaagccaagtatacatggttacattgtatcgactaaaaattcatgtctttcccagaacctcagaatctgacttatttggaaatagagttgttgcagatgcagttagttaagatgaggtcgtacttgaatagggtgggcccctaatccaatatgactgatgactttataagaagagaaagcaggctgggcatagtggctcacgcctgtaatcccagcactttgggaggccgaggcaggtggatcacaaggtcaggagatcgagaccatcctggctaacacggtgaaaccctgtctctactaaaaaaaaaaaaaaaaaaaaaaaaaaaaaaaaaaattagctggccatggtggcgggtgcctgtagtcccagctactcaggaggctgaggcaggagaatggcgtgaacccaggaggcggagcctgcagtgagccgagatcaccccactgcactccagcctggacaacagagtgagactccatctcaaacaaaaagagaagagaaagcagagacacagacacttacagagcaaacaccatgtggagacacagaaacacaggaagagagagtgcagtgatgcatctgcaagctgaagaatgccaacatcagaagttaaggaaaagtcatggacctggttctcccctaaagctgtccaatagagcatggccctgtcaacaccttgattttggacttctaggctccagaactgtgagagaataaatttctgctgttttaagccacccagtttgttagtcctttgttatggcaatcctaagaagctaatacaccagggtatcctgtctctctagacccatttatttctgctgaactatgaccttgccattttccagatacccccaccttctgtcctaagcatccctctgattctacatctacagtgacaccccaagatttctggcccactccaaaaattgcccttctcccactcttgccaccaccaaggaatctggtggaatgaatgtggactcaccacttgggtaccagaaaggggtgacactggtggtgggtgtgcatccatgaggcagtcactacaaagtctgagtgaatttctacagctgctaatatgggcacagccctcattcgagtacagctgccactagtaccatccctggagagccctgaatcctcctctggtaaagagtaaatggttgggtccatccttggtcatagcatgaccttggcagaaagagacaatgtcctgcagtctctggggcttaaatttactgccagcctcaaccccaggggaattcttccacaaacagtatttttggttcccttgaaagttattgagtttgattaggtctgtggcttgcgtttgagagaatccaggatttgtcttcatgtcttgttgtgaaaggcctagcctggtactttggaagaggtgtttcatggagtctcccattgtttgacctgatggggttagtctaccaccatgaccctattggactatgctggaaatgcagagttgcaagccagaggctccctgacctccaggctcatgatctattggtcatcatcattgtaattagaagatactgctgttgctgattatgtgtgttggtgaagaagtagttgggtttggatgcggtatgtctagagctgcataccaatatagtagccactagccacatgtagctatttaaatttaaatttgaatcatttaaaattaaatgaattttaaaattcagttcatcagtcacactagccagttttcaacagcccaatagccacatggggctagtggctgccatattggagagcacggttatgggatattttcatcattgcaggaaattacactggacagcgccagtctacagttatttgctttcccaagctttccacgcacacaagctcctttttttttttttttttttttttttttttttactaagtggaattttccaagtattgagaatatgtcagctccataataagaggaaacatgatttaatctcttactgtctgttggaaataataaaatatatgcatctattttttaaaagaggaaaaatgagtattgctagaccaatgtttcccaatttgtaatgtggacataaatcacctagggttcttgttgaactgtaggttctgatttagcaggtgcaggtggggcctatggttcttcttctggttcacagaccacaccttgaatagggaagagttgtagcatgtgacttgtgagttaggaccttatcactgtttaaagggccaaggacataaatacagcaagtgaactttaaatggaaagacagaagctgaaggaaatactcttatcgcccaacaccagaagaattagaccaatgcccattctttagtctgaatgtgagacagcatagcaaagatgagctatgcagcatggcagaattaagaactggggccgggtgcagtggctcacacctgtaatcccagcactttgggaggctgaggcgggtggatcacgaggtcaggagattgagaccatcctggctaacatggtgaaaccctgtctctactaaaaatacaaaaaaattagccagacgtggtggtacgcacctgtagtccccgctattcgggaggctgaggcaggagcattgcttgaacccggcgggcagaggttgcagtgagccacaatcacgccactgcactccagcctgggcggcaaagtgagactccatctcaagaaaaaaaaaaaaaaaagacctggtgccctctggagccttgctgtctagatttgattcttgacttcattacttcctagctgtgtattcttaggcaaactaccatgagacctcaccttccctatctggaaaatgggaatcatactagtacatttttcacagagcagttgtgaggactcagtgggttaacagatgtaaaatgcttgagacggtgtctagcacacggtaagcactgtgcatggttgttaaatcaataagtgcatgtaacattctgcttctaacaagagaatatgctttactctggatgtgtcaatacatttctgaccagttgtacatcacttggcttgaaacaggaccataatttctcccctgaggattgaggaaggggtgggaggtggaggatagtgtgttttgatgaaagattgggtccatgaagcatcctgggttatagtactagtgaaaaaattagagtcaaaagttgagtccataattgataggaatggtccagggagtttaatcaatggcatggtagacagcagccatttgaagggcatgccggcaaccatcacttaacatgcctccttaaagaaactgttcatcattggttactgttggtgtaccaaagtctgcatttggaatttgtgcagcttttgtagaatctgccccttaaatatgagatgtttccctttggtgagtgactgcaaaacagacttgagtcactgaagagaatatgacacgagcttttctctggtattgatcttctttaaaccttcttccttcaccccaaagcaaagagcccagccaacagcgagtaaaaagatggggcttctctttcgatgagatattgaaggaccaggtggggcgggaccagtttctacgattcctggagtccgaattcagttcagaaaacctcaggtaaatctctcaaagtttgagctgtgtgcggaatgtgtgtgaagaaatttgcataatcggtctctccatctctctctctctcaatgaaacgttatcagggttcaaattcaaatgccagctaatctggctgaggttgaaatggagaagaacaaattaaaatatgtaactctgtcaccaccataatagcacctactaacaccagcatgtttcagttcaagtctatatgacctttgtgcgactaattggaaataagtcttcaataataattagtcaaacggatttgacaacatcattcattaagtacagccatagaaccagggagcttcagagtggagaggcatctcagaggctgtctcctcaaaacttcccagtctggggtcctgaatatctgagaagctaaacggaagagggagaagtcagtgggctcatttcagaatttcaaagagcaaagtaaatatcactcagtaactggtgatgtaactgtagcagctacgtaacagtagcagctaataaaaacatgcttttttcttttagaatgacttctgtcgactccaaatagtggttactctgatcatctgacgccagtgagaacacctgattgttcctattggtctataactaatacttgatgagggaaatgtattaataattactatttaataggagaaaaaaataagatattcaaaacctcaggtccaatatgagaggaagaaaagggggtgaattgaaaggaaaagtctccttggttatgaaaaatttgggaacttgtttatttagacttttatggtattagatgaagaatcagaaatctgcagaaaatgtgacttatctgagacttatctagtgatcttagcaaactggtgactttttaatgggtaagatggaatctctctctttcttttttctttgtaccagattttggtttatatagtagagtaacacccatcttccagtgctgttttctttaaagatgtcttaataatgtttcaatattgtattactttaaaaactcagagcatgtgctgcgggcaaaggactgcccctccaaagttaatgtgcaacatccatgcacttatttgaagttgagaccatcggtcccatacgtcaatcaagtgatatttatgctacacctgtgctgtatcaagccctgtgagagtctgctgagagatgcaagtcaagatgtgtgatctttgcctgtaacgaccttgtaggtccttgaggaaaaaacacaagaaatgattaaatcattgaatgtctataaatgagtgtaaactctaagaaccatttcgaaagcatttaaaggagaagaatcaaagctgaagtagttaaatcataagctggactttgaagaatacacaggataatagtagacgaagaagcaggagagagaatattccaagctggaggaccaaatgaggaaagaggtggccgtgggactctcccactccataaggtcctgagaggacacgtagatgccgactagctgtatggagcgtgctgttctaggcatccacgtgtctgttataaaccagacaaggttgagtatcttattttgggttattatacaagagcctttccttgtgctgaagcatgattccaaacacatctcagagcttcatttcaatgcctaatgaagcatttgtaacagaaggcttgacttctaatactcttcactagggtggtgctcagactagcctccctgtataggaaggaaggctctctgtggccagcttgatggacccaggtggcctctctgtgtagccagctcagtcccagtttccaccccctccatggtccctatgagccacccctgggagtccttctcatcttcccttcttacctgttccccttgggtctccaagatggagcggtatagaggccccctttacctaactacctctaagcccgtaagtagcctcaggaccctctgctgcctgcactcttgcagagagcttgaagaatgacccagagtttggtcattgtgagggtcccaggagcatccactggctcagctgccaccttgcctggtcagagcattcattctagaaagtcccgagtgtagccagaaccacatatcagttcagactagtttcacaaattatgcatcacacttaaagcccagagtgcaccaaggagtgtgtccctggcaggtgttcagtgcttcttcctgccatcacctcctgcgcctctgccagctcctttccccatgccaggagggctacatttaatcttgggtgaaagcatgcatgtgagcatgtgttcatgtgccagagcctaagccacacccccagaatgcagaaatccagacttcagagggtcacccctgctccatgacaggaaaggaaatagaatagcagggaggaaaaggatagccaagagcctctaaaatcctctctggatgcccaaattccatttttatgatattcagcataactggatacatggtgggtgagagagaagctcagtcgtaaatcacataactgtaggactcttcagtcacccatcacagggcagccttttccccgttccattgcgttcatcccttcagctgcagatatcatcttagcaccaaccgtggcacagggctggcggatttagagctgactgagtaaatatcagggtggccaggcatggctatacagatgcacctccactgtggctcatgccatggaggcccctgggagttgtgcaatatggcacaacttgaggatcctgccaacctgtcatgttggccgtgctggagtcgtcccttctccgcaggattggtgaggggcccaggccactggcattggagcatggcaggaaaaagcctgaccagaactcacctgggtaaattacaaagtgcttctccacttcctctgtcctcctgtgctccctctcatctctccagtgaaagggctgcttagatcataacattcttgcacaacccacggggtgccagttaagtagccaagtggctgaatttctatcagagcttcagaatgcggaatggaggagccccaaagtgtcaccctggatcctttaaggaacaatttctatgatgatgtaatagaagttgacatcccctttgatcagtgtcttctgggtgggtctgtgagatgagggtgggggcatcatctctgtggactgggtggggtatgaccagcagcgcattttgctgaagctgtgagctctctgtggcagggtctacctctttttctccttttctgacccacctgagctgggtgcaggctccctttgcaccgagtggacccacagacagctgtttgttgagtgccttgggaatgctcatggcttctgtccacaaggcaggggcctcacagctctgatgcagggagctccgctcagtttcttggcctcatccttcttcctgctttgtgcattttcccagaataatgacagtcactccttcccatctttgctccctctcccacatctcccctacacaaatctttgtcctccctggcttgacaccctctgctgcacagcagagaatgagttaaaaatcaaaacccacagcaaagagtgtcccccgtacattttttgtgagctgtaacatctcctgagagaaggtagttgttcttctaacctgcagattgatgatccgagttccacacagtgtcggctgaagggagaagcaattaaaagagaacacagtggggcaccaggttcatctcgagagctcttgtctctggcagttgccctgagtccaaggaagacctcagaaggttcactaggcccagcaggatccaccacttaccaaacccatgattaataggaacagaggtgactcccacgacaccacaaccatctgcagtgtttcagtcactgcccagtgaacagaactcagcttcagtggtgctgggggtggttactaacgtaggcaccccggaattttagccccaccgggaactaaaccaagtttaagctctgctgcctacgtctctggttgaccagcagagggcatagaaacactttcttctctcctggagtttgctttttctctgggagcgaaccaaaagctgtattttctaacccatgaaaattctagtttatgaaaagatatgtaaactggtgactgagggcctgcccagacctcctggtaggatggagaatgatcaagggccaaatggtttgtcttacccagccagccttgagaaaatcctcttccttgaaagcctctagggagaaaggaggctcccactggggcagcccctggatggtcctccagccctgttctccactgcttcgccccagtggtatctgagcccaggctgcctcgctccaaaagctagtttccccgccagcatttctaagtcatgaacacggatcaaatgcccgcacaggggctgcctccctactgcagctatgacaattggcagagaccaggggcaggtcaggacaggtggtctcccagatattagtccttgtggcctgccagtcacaacggcccttctgctgcaagccatggaggctcagtgcaggatggatggatttgatgcagctgctggcatttcactccctgccgctgcccttggggaggagcggtacctgcaggttttttataagagcagaagcttccaaagcttcaaggggcttcccatgggcagcagatgtgcagagaggagctgctgtggctctctgcagcggggaatgtggcctgggctctgagttcccagctcaggcctgtggggctcgaagatggccaacactaaccaaagcctgttctgaatttcaaattgacacaaaggttcctcaaaaccagtgatggtaaacacatacgggatgtcaggatgctgctgtgacagcagttttgctgttgcctgagagagacaaggcaggtcaactccaaggcagacagaaggccagggagagtccccagtgtgtgcagggagagaaaactgctgtctagggaatgttaccccataccttccccctctcccttcttgccctttccccctccttccctccctttctctcccctccccttcctcttcctccagcatgcctgttgttttcacttgtacttaaaaaaattcttggttttatgtgacaaagaaaacctttttatttttacataaaagtttattaaatttgattccgcggcctggtgcaatggctcacgcctgtcatcccagcactttgggaggccaaggcgggcggatcacttgaggccaggagttcaagaccagcctggccaacatggtgaaaccccatctctgctaaaaatgcaaaaattagctgagcatggtgacatgcccctgtaattccagctactcaggaggctgaggcaggagaatagcttgaacctgagaggcggaggttgcagtgagccgagatgtagccactgcactccagtttgggtgacagatcatgaccctgtctcaaaaaaattgattatgaaatttgtatttccatcagctccggtcatctctatatccagctgagtgatgtacattttcatgtggcacccaaatcatcctgcaaaaaggaccctgagccctcaggaaccgcagggagcctgcagagctcccagggtcctcagggccttcccacaggggctcagcagctcctcctcagtgctgacagaggtgacagaaagtgacctcccatgtggcattgattgagggggcaggaaatcacccaggtgtcatccatttgtgtgagaagttgcaggggcccagggggcgtgggaagacgctgacccagaaggttgcttccagccagggattcagcccagacggcctccctctgtgaacctggttctcctgtctgcctagcatggggctgaggaagcctcactgacttcgtctctggacatttgaccccttctgggccttggaaaagccaacactggcttcttcctatagagccaggttccccgcatctttcacctactggtcagacatggccttccaggcagagaaagccttgtaggtactctcaccagcagatggccattttcacttggcaagcctcccggccacttccttcttttcacagcagacctgagagagtggacagagagccctacagaacctagggcaggcctgggagatggaggagacccatgccccagctcaagagtcaagggcccacctgaacaatgaggtaggggaacagctcctttcaagcccttccttccccaccctctctggactctggataaagaaacacgactgctttcctctcacccagaagccagaaggacctgagcacccaggacttgtggctgtcagagagctgtggaagggcaggggacaccagatggcagcagcaagagctgggcggcagcatctgcccaggccacctgcggagagaaggctggaatccgagggatcacactgggccagcattgagcctgtggccaccacactgacccctcctcagctccccctcacaggacctgaaagcatttctgagttaagtctgcataggaagttttccagagccatgccacatatccctccatccactcagtgcccattttacagatgaagagagaggcacccagaaaggtacaccaaggcaagatatggcgtagacaggatgagggcagagccagcttcctgatctgatggaagtcatgaagccttctctgccttacgcttggctctgcagggtcgctgagaggttcctttaaggagatcatcagaatcctaaatggcaaaaaatggcaaatcaggggaagagttggagcccagcatttggggacacacacacacacacacagtcgtcttgccttgcagaaattgggttgcattactccagtctgccactgagtggcacctttgggccatgcacttggctccaaagacatttctctgaacagcaacagaaaaacatgtttaaccctaaaaaaaaaaaaaaaagaaacaagtacatcttactttggatgaaatttgatgacagattgaatgcactgtctgcactttccaccacgtcatgtttcagcttcgcttgtccctccctttctgttgactagactacctgtgattcccgctgctctcggaaccagcacaggacctactctcttactcactgatgggggagctggcctgtccatgcacagggcaaaggatatgacacccagacctggatcctgctgcaaggctgccttgggaaccatccttaagacccggtagctgttgtccaagctttggctctggctgctgctgctctcagcagaaaagagctcactgctcccatgcggatgctgagggattaaacagaggcaaatacggaagtgagcagatttttctctcttgctctcagcagaaggagaaccattctgcagagaagttttcaacatatgcctcttcagcattgctccagatgcgtccgtcttcactctgaaacccatatattgagcacctactatttgccaagcaccgtgctgagcactgatgtgaattggctcagtttctccatctataataggaatggctggttcattcttacacagatagtctttatgattccaggacactgcctgcttctgggatctctcctccattttgatgccatcacttgatcccaactagatttgacaaagggtctcacactgtctgcatggtggcatgtatgtagcactggggttctcaaccaggaatgagttcatctcccaggggacattgggcaatgtttggaaacatttttagttgtcataacttgggaaggggggttgctattggcatctagtgggtagaggccaaggttgctgctaaacatcctacatttcacagaatagcctcaacaacaaagaattatccagcctgaagtggcaatagtgctgaggttgagaaaccttcatgtagaaggagagaaatcccgttctgataacgagaagcacattgatcttttaatatgcaattcttttctgttctgcaccataggaacacctttgatgttttcacaatctccatggtctttgcagctcatgtagtggcatcagggcaggctgagagatgcagcagaatgggtttcatgggacatcagctctggggccatctcaggcaacatcccgatgctgagccccctggaactgactgtgtttctgctcccacttcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggtttgcttatctactcaagtggttgtcataaggtgttcatttgtccccttcattgcctgacctattaacacaagttcaaggcattgtgggtagttaaaatttcagatttggttatttttaagttcatcagtggaaaccatttcagataggcgcacagcaaaatcccaggatcgttttcctagatgggttatgtattacatagaaaccaaaatgtgcagttatatgctttatttgttccaggaaagcctcaaagtgttttacaaaatctgaaggcttgtaataagtcagtgatagaatctggaaaccagaacacagcattggggaagtgggtgtagtgagttagcagggccatgagtcaaacccacatctgtctacctctgaagcccacactgataaccacctctctacactgcttccgcagtgatctccagctctgcagtgaatattttttaagcacatctatattccaggctctgcgctatgtgataagataccacaaagaacaggcaaaacccctgttctcaccgaggttgagtgggagacagacaagtaaatgggcaacttcaacagtgtgaaaagtgccccaaatgggtgaaccctaggttaaagcaagcctgcaggagggactcccaaccctgtaggacacaattaagatgctcacagatgctagtgatgctggctaaagaaacaggaaccaccctaaccagcagactaaattttgacggctgggaggtgccatttctaaaaataagcattgggttggtttcttacttcctggcccctaatttctatttcctgtcaccatcccacacccagtgacagggcttaagattttgcttatctccttgaccccacttacttctctcacctctggggcccccagtagagaatttgggtggtttgccccttgcagacattattatctgatttaggaaactcagtgtagctgcaccaatgcaaataatggcatgagaacagtgtcccttatcatccagaattaccttgtcatttgctcagaacttcaagatggaaacacctaccaacctcaacaccataactatctacttctctccccctggtcacgagctccatcaaatgcctgtgccaatcacgaaatcatgactccttcatataccccttgcagcttcaaagcagaatgtttgagtcatgagagctctttgctgagatatttttgcttatgtgtatgtacgtatgctttcaagcaccatattgacatggccagagaggagagtgacaggggagttccgtgggggttccctgcatgaacaagctgaagctcaaactccaatatttatgaaacacaagaagagggatactggtcaaaaccttgatgcatctagcacagtattaacactccaagcatgacatcaggagggatttattttaattttttattatgaaaacttttaacacttggaaaagtggaaacagcaaaacagcaaacatttatagaccctcatccagcctcaaaaatcatcagtacacgtctgatcttgctttatctctagccccatctactttttcacctgccaccaggttactttacaacaaatccaagatgttgcatcatttcatctgtaaacttagatatgtatctctaaaaaaaagatccttttgttttaatattgccacaatatcctttatctccctcccttcctcacatccccttgcaatttatttgatgaaggatttagatcctttgtcctgtaaagagttccaagctctggatttttctgattgcagccctgtggtgctatttagcatgttcttctatcatctctctttcctataaattcgttttataagatatttaatcagatttaggtttgatttttatggacaaaaccacttcatggattgtgtggtgctctcctatcagaaggcacatgtctagccacctctctttttgacctttttgcagatattgatgtctatcgcttatatccattagttaattagaggttacaaaacaacaacgtactaattttattctttcttcacttattagctggaatactttcataaagagaaacttccctccaccactatggtattaactagcagtacaattcacataagaaaagcaggataaatatttgattctctcccttcatttgccagttttcaaaatgagtggtttgctattatcttcctatggtaaacattagggtctattttggttttactatctttgtaaactcatgagtttaaacatatatgctatgttttaatccattttgctgattacttttattgatgcttggattgggccatctctggccagttggctctttctgacacagccctaagagtgatctttgacatcatccaaatagcagggaagctaagatattccagtctttgcccttacccagaataagctgtttctccaaggatccctgattcctcttagtgagaaatggtatttagagactaaaatctaggcacttagagtgtttcattgttcctggattgtttatcatttccagcccttttcagtcgacagagctaggaaatgtgttgctgtttataataaaaatacatcctgagttcatactgatacttttaattcaaattctgacctacaggggattttatttaaccgcttgtttcttacacctgtgcctcttttctctatgctgacaatcctgactttcaagggcactggatgatagcataattactcatttgctttatactacacagagcagtctctaaaccacaatgctaaaaatacagcaacagtatgattatcgcctggttctttaattgttgcatagtattccgttgtgtggaggcaccatagtttagtcaaccagtcctctcttcttggacatttatgttgtctctacttcaagaaagttttgatggaagaagtggggaagtcagcctaacgaaggttacatattgacaagtatctcaatatccaacctacagtgctctaccattttccaagtacttctaaatacattctatctaatttctacagcaatctagactagacatgaggatgtcttaagcatccccatcttcttcattatctgctaggattagtctcccatgaattcaaataaaacactcttcctaagccaatccctattttcagaccaatttcctattgcttctgaagtgtatttccaccataaatatacaaagtgttcctttctagcagagtgaccttggacaagttgcttaaattccctgagtcttcctttcctcatctgtagaacagggatacaatggagcctacacataggggtggaatggggaccaggtgaaaggaagcatgtcaaccactaacgatgtctggcccacaataagacagagtaaatactaccatcttatttttctaatgtcactaatattctctttttaagccgtagtgtttaatgtatttggtaaaaatttttaaataatttcacataaccttagcacccagagataacccctattttggtgtattttcttccttgatttatgtgtgtagctacgtgtaaggtctgctcaggctgctaccacaaaatagcacacactgggtggcttaaactacagaaatttatcacagttctcgagactgacaaatccaaaattaaggtgtcagcagatttggttgctggtgagggctcacttcctggcttgcaggtggccgccttcttgctgtgtccttataactctggtctctcttcctcttcttataagaacactaatcccgtcataagggcctctctcatgacctcatttgaacctaattacctctcaaaagacccacctccaagtaccaccacactgaggatcagggcttcaacaatatgaaatttagggagacacaacattcattccacaacagggcgattttgcaaatagcgtgatcctgtaacctgccttttacctaaaacaggggtcagttaaaaaactatacttttcctaaaaagagccagatagtagacattgcaggctttgtgagtcatgtggtctatgtcacaactattcgattctgcatacaaaagcagctacaatgcaacaacatagcaatgtaaacaacataaatgaggacctatggctgtgtttatttatgaacagtgaaatccaatttcatataatttttcacaaaatacaattcttcttttagtttttttcagccacttaaaaacataaaaactgttcttcgctcatgggatgtaaagatctagatcacaggtctgtatctgtagatttgaatcacagactgtagtttgtgaccctgtgctaaataaaatctagcacatggtcatgaaaattattgaaatgcttcaagaaatccagaaagctacaggatagaggattgggcataaaggatcttcagtttttgggggagagtaagttagaggagacttggttttgacgcagccatggcaacacagcaatctgaattgtgaatgtttctacatgaggattgagtgttgcggagcagaggtcagcaggtgccaagagactcacactgccttaccttcctggacagcactggctgcctgccccagcaaagtaggtgcagttcagaagttcccaggtataaaaaggaggttaaaatcctcagcagcccatgaccagccaggacttgcactcagatgtcctcgcttgctggccaagattctgctcagaccacactgtccctggattgttagtgctgagggcttggtggtcgcactgagacctggagaagttctagtccctagagaaaggccaagagtctgggagttccttctagaattatccatttaagttctttaaactttctcttctcggtttgcctctctgttaaatggggatgttaacacctcagcccatggggctcaggggctctgggtggcttcctcagctggtcatgatggttctcataaaccccctgcagtggtcatatgctttaatattagtgctcagtagcctgagagaaagtacagccagatttatggattcactggaagcagggactgggggtggggtgcagcctctctccaatgggttttgtttcttatttgaccacacgcattgttagagccaagttaattgcctgtatttgcttcctgtggaaatatttcacaagacaccctgttatcgtgggcccagcatttgtacttgtgttttgctgatccgtttagcttttttgaaaattttgggccaagaccaaatcttccataaaggtctgtgggctgtgaccatagtcctcagctgtttgctgtgttgttccaatttcatagatttagccttgtgaggggagaaaaatatataggccatgattatttttttttaaggactcagttctttatgctatggatttaattctctgttcccaaccatgtggccttaaaggacctgcattgtcacctgcttgctatgtggtctgaggcaagggccttgaccttttgtgccttagtttcctcatctgggtgatgggggtgatgtcttctttacagcccgctaaggatttcagagaaatcagatgagctaatagccctgaaaaatctttgaaaaagtaaaaagtgctatatatttgtaagtgtgaactcacaaaaattaatgactttagtactctctggggtttcgtaattctaagctggatccaaaagaaattctctcaaaatatctgcccttagatgggaaaaaatgccagaaaaggatgtaagaactgaattttcaggtcctggaatgcatcctaaggaatttgagcttctcatcctgaagacagtagcaaagcattgcaggcttttacctggaagatggtgaatcccatggtgatgggcatagtaggctggagccaagagagagttctgaaccctggggcatgtcatataaagctctgctggcagttgttggtggagagaattaaaccacaggaagtattgagaaccttcagcttccttgtagggcatttgtctctttccaaagccttcacaggctctagatgagatagaaatcaaatgccagcacagtggctgcctggcttccattttaaatctcagagtaccaaggatgttccaaggactatctccctggatccattcaatcatttgtccatctgcccatacacccatgtcatgaacatccattctcccattcaagttgggaaaccttgacccgtgcggcataatattctgtgcagagggaaataacatgagaaataggaggcccagatggctttttttttgccatcaggcagagcttatctaaaagcacatcattttcaaacaaaacaaaccagacctaagaaagcacttcattgagataggattggattggaaatctgtcctttaagtggactgatagtggaataggacaagccagtccagccccattggctttgatccttgcagtttcccacctcaccttcctactcgtcccagccccactgctttcctgacctgtggtacctgctaagatgccccaccctgccctgtacctggagtgtctgggccttccagacctctggatttgaaagttatttcatgggagcagaaatttggtcttctttaccttttataagttcctgcatcacaaaggtaatgctgaatgctgaatgtcagctaaatgctgataattcattccagaattataacattttcagctgtgcctatcaaagaagcgggggacaatttgtcccttagctttcaactttggagagacaaccttggggagtacacctagtagatagtcaagaaaagcaggttaaattaaattcctacaatgtgccgattcagcaaaacttggaatacccactaagtgtcagatgttctaggcgctgtgaatatacaaatgcgtagggaggttcctttccttaagcggccctgggtctgacttaccacagctctgcttggccttgatgaactcacaaaaggatcaaagagcatgctcaaggccagaatgaggtctgcgtgataaaagagctgagaaagataccgtcaagtccacatccgccatgagcagacaagaagcctctagcaaaacgtttatattattacctaagtgtagatgtttaaatgcaacttgattaaggaatgcaaggtttctaccatttgctttgtttaaaagccaaagcccagtagagtatgattttaggtttgcccagattattcagaagtagaagtcttcccagctgttcatctttgctccagtggtggaggtggcggcattgcgtgccagtatcacaagaccacaccaagtttcctggtattaatcctctattggaaggcatttcctggtagactctcatgccagacatattttaataaggaattctgtgacactgcttgctctgggggttgctcattttatcctgtaggtggttttatttttgggagatgaacagcagagggagggatgcattttgcagagaataaatcagtcatttgtgatccagttctgtttattaccacacagactagtagttcctgacagctactgagagaagacgtcaaagagttcaattccaaaatttcttggttgctacatctaagcatagattccttataccaaaccccatgacctccttgaggaggaaatgaaaatacttttcttcttttttttttttttgagaaggaatcttgctctgtcacccaggctggtgtgtggtggcacaatctcggctcactgcaagctctgcctcctgggttcacgccattctcttgcctcagcctcctgagtagctgggactacaggtacctgccaccacgcccagctaattttttgtttttttttagtagagtcggggtttcaccatattagccaggatggtctcgatctcctgacctcatgatctgcccgccttggcctcccagagtgctgggattacaggcatgagccactgcgcctggccaggaaaacacttttctaagttaacatccctggtatttgggtaggtgaaagacaatatgcaaagctgtctttgaagctacacttttctaagagtagggattgaacagcatgaaaatactgtgccctttggccagttaaattaaatctgtttttatagatgctttgcagagtaaaggcaaaggatcatttactctcacatcctcttatgacctggaatgatgccttatgtggaaacacagggctcccatgtcctacttaggaggctaaggaaatccaaagggggcacttcccattttagatccacatgatcccaggttgttcatccaaagatacatccagaaggagcaacagcttcctatctttcacttatgtggatgtccatattgttgcggtatcttttctgttgcctcttctatgtttgttaagcagatactgatttgtgatccacttcaagtcctcaccactgtgctgtcctgcaagaaccgtgctgaagaaaagctcattttccctaggcttcagctaaccatgcctaaggtctgaggacctttggtcaaacatattcaagtctcttgaaaggtgagactcaaggatacagacttatgacttcctaagggcccatcagccctcaacgctttaccaggttgggaccttgtttccaaagatgttcatagctcccttcaagtatagatggcaagttgtgcatggactgcctgttaagtgagaaaccagagcctgggccatccctggtgtcttggccattaccattgctaacagcagtgatagtgaatagtacccaaaagggaattgtaagcagtggccacaccttctactaggatgactcagatttaggactcaagaggaggctcctaactttcctgcaaccacacatggagggattttgtctcagccaaccagtactgactccccttgggacccaagtaaaggacaatgaaaagcagcacttcaatgtgagaagagcgtgagctttggggtcacagagctctgggttcaaatcctggttccatacttaccttgggtaagccacttgacctgttagagtttcagtatcctcatttgtaaaatgggggtgtttaaacctaagcactacttcagagcaaacatcaccaacaactgaaatagtacagctagactctgctcccaaatcctctttgcttctttctccagaatctctctcatcccacaaatcatcccttgcaaggacagtcacagcatgaaattattattgccacttgacatgtataatcatttttgtagtgcttccacttctacttccacatttaattgtgtgattgacaggactagaaaggtgagcttttggctcccagtccagttccttgtccatcaccccacacagcaacaccacattctgtccacacagcctcattttccttcaagagactacatgggacccaaaagctcccaaagtctggatgtgattctaggcagcttaggtatggagggcagagatgaggcacacacacctacaaaaagaaaaataggatacttgaaaatcacaagaagagctcttggccgctgtgcaatgctccagctgggtggttctccactccaggaggacgttctgaagctgggaaatgagatctgtgctgtcttaggagcccacagcacaggggaggacataagggtcttcttgaggagttcagctgcatgcttgtggcccagggccccagtcatttgtctgattagcttccccacctcttgagagagtcactgtgttttgtctaaaaagaaaggagatttccaaatgaggactctctgagcaaaatattgattttcagcaggtgtggttttgagacagtttgtactgcatgctctctccagctctcactgtgcctcggactctattgattctagttggttttgatcctgccttagcattccaggaaagcagagctctcctagcccaagaagagaaaatgaaggtggagtggctcatcggggtaacatccctccactacagccatcaaccactccagggatatgatgcctcccactgctgaggactctggctaagacactggtgtgatttagagccctagagcattggtttatcatcatatagagaaccaccctcatcttctttggaggaggtgcctctccactgcatcccaaggtgggagtgacctctggtagttctgcttgttcatagtcagcttagtcatctctgttgtagaaagagaaagagagagagggcaagaaagggaaagacggagggagagaggaaggaagtgggaaaggagggaagaagataaggcaagacaaaataagacaaagcaagaaagagagagagcacgcgggccagcacgctttttctccatccccttaggaatttactctcagcaggggcttggcttggctggttttgccagtgactcccttgcactttgcagattctgaatatacatttcccttaagactggttgtctgcagaataggggaaacaaaccagcacccccataaatcagcagaggtcactgccaagagctttgtacacttgctgtccctggcagtgataaactcattgcatttgggaaatggccaaagaccctgagtccaatcttaattctcattcccagaaaaatctcagttttctgttcacccacccccgtttactgtctttgtgtttcctagacaaagctggcaaggaggaaagaacacagttcaataactggatcatcaaaggctgcatttcgttgcttgggggaggagttgcagggcaggaaagagtcacagatccctaggctgtggaaaagagaggcccaggccagagggaggctgaagccatggggtctgcatggggtgtgagagatccgcagaggttctcagattctggttttctcagacccgcaccttggatctgctattactgctgtggtcggttgttcccttgaagggtggttcaggctgttataatggtggtcaagggctagcagtgggattggtgtggtgagaccacctcatgggactcatgctccagtaggttgtgttcttattctcttatctttctccccacaccatcctcaccttggtatctggctttggagttggccatatgacatggagaagatgagagtggtgtccaaactgctcctctgacccacatgggcctcctgagagtggacaacctctctctgctgccctttcctccttgccccttgattgtctttctcctctgattgatcagactgtgaagctgcaagaccagacccccccctccctgcaatcccacagaattaggagacatatttctgtctctctacacagatctttccactttgatgaggatctttctggttgagagaccaccattccccacttgtagcaggataggtcatccccaggtatacacattcataccctgtgcctgtacttcatctctgcagcccttagctgaattggctaaatgcgtctctgtgcaaagtctatcttgcctagttggatctaagctttatgacattagaggccgatttgtcttattcaggctgttatctcagcgtctgacacagtgccctggcacctagtaaatgctcaataactatttgctgaatattattttgattcagtgtttagacatctgctttatcctgctctattttgattgacaagttctttctcttcatgaaccaggcttttccctcctacaatgagtctataagaattagctagatcagaggggaatttggtgctgagccagaagagctgtctaggggaggtttcctcacttcttatggggcagcagaggggtattgtgagatattgagaagtcagaacaagaagcagggaactgttgctttggagaagggtctggagaggttccaggcactatgataggcttttccagatgactcaggagccacctggctctgtcagccagaaagaagtgatgcctgacacaaggagacagtgtgtcatttttactgtggactaacatttgtacctaagctttaaatgttaaaataatttggctgggtgtggtggctcatggctgtaatcccagcactttgggaggccgaggcgggtgaatcacttgaggccaggggtttgagaccagcctggccaacatggtgaaacaccgtctctactaaaaaatatataaaaattagccaggcgtggtggtgcatgcttgtaatcccagctacttgggaggctgaggcaggaggattgcttgaacccgtgaggtggaggttgcagtgagccaagatcacaccactgcactccagcctgggcaacagagcgaagactccatctcaaaaagaaaatgttagaacaatttaaagagacaacaaatgaaaccaaagaccaatgatacccctcagcctgggctctgagaccattagggatggctgagccaagattttcatgctcctctgagctgagtgtaatcctcattctccttctgtgcagagagcaggaacttgatgcagtcataaacccaagcaagtatggagccagtaaacttgctgaacattaaattccaaccggcatttcagtgaacatgtatattcgactaatatctgagcctgtgctagacagtatgcatctgtaaaaataaacacatactgttcctcaaggcacttaaacaagagtgagctggatttttgtctgaaattttcagaaaaacacttagtgaagtgtgttcacactaagtttgttaaatcagaatacgtctggactatccaagtagtctcagaaccaggccactattggaggctgggcgcggtggctcacgcctgtaatcccagcactttgggaggctgaaacaggtggatcacttgaggccaggagttcgagaccagcctggccaacatggggaaaccccgtatccactaaaaataaaaaaatcagctgggtgtggtggtgcatgcctgtagtcccagctactcatgaggctgaggcacgagaatcacttggaacccgggaggcagaagttgcagtgaactgaggtcacaccactgcactgcagcctgagtgacagcaagactttatctcaaaaaaaaaaaaaaaaaaaaaagaaccaagtcagtatttaatttcatttgagtccttccagtgggtttattcccattagtggggtaactcccctgcttttgtaaatatgagggtatctcaggaagaataagtcccaaaacaagattctttgggttccaaccaaagatgaaaccaagagggcctcacatgtgaccaagacattttctgctttctactttcactttctttttgtttattttttaaattgagatgtaaaagttgtatgtatttatggtatatagcatgcaattttgatatatgtatacattgtggaatggataaatcaagccatttaacatatgcgtggtctcatacacttattgtttgtagtgagaacacttaaaatctactctcagcaattttcaagtatataatatattgtttttaactgcagtctgtagtcaccgtaatgttcaagagacctcttcaacttattcttcctctctaattatgtggtgtcctttgaccaatgtcttcccagtccttctcactccccacagcccctggtagaatggccattctgctctctgcttctgtgagtgtgattgtcttagattccatatacaggcacatctcgttttattgcacttccctgtattatgccttatagattctgtgttttttacaaattgaaggtttgtggcaaccctgcatcaaacaagtctatcagcaccatttttccaatagcatgtgcttactttgtgtctgtgtcacagtttggtaattcttgcaacattaagcttttttagtatgattatatgtttatggtgatctgtgattggtgatctttgatgttactattgtaattgctctgggggtgcccaactgcacccgtataagacaatgaacttaatacatgttgtgtgtgtgtgttttctgactcctctaccaaatcagccattcccccatctctttccctctccttgggcctctctactccctgaaatgacaactatattgaaattgggccaattaataactctgcagtggtctctaagtgttcaggcaaaaggaacagtcgcatgtctctaactttaaatcaaaaactggaaatgattaagcttagtgaggaaggcatgttgaaagccaagataggctgaaagctaggcctcttatgccaaacagcctaggtgtgaatacaaagaaaagtttattgaagattgaacatgctactccagtgaacacacaaaagataagaaagcaaaacaaccttattgctgatatggagacagttttagtggtctgaatagaagatcaaatcagacacaacattcccttaagccaaagcctaatccagagcaaggacctaccttgcttcaattctatgaaggctgaaagaggtgaggaagctgcagaagaaaagtttgaagctaacagaggttggttcatgtggtttacaaaaagaaaccaagtccataacataaaagggcaaagtgaaacagcaagtgctgatatagaagctgcagcaagttatccagaagatctagctaagatcattgatgaaggtggctacagtaaacaacagatttgcagtgtagattaagcagccttatattggaagaagataaatctagggttttcatagctagagaagagaagtccatgcctggcttcaaagcttcaaaggacaggctgactctcttgctagggctaatgcagctggtgactataagtcgatgccaatgctcatttactattctgaaaatcctagggccttcaagaatgatgctaaatatattctgcctgtgttctataaatggaccaacaaagtctggatggcagcacatctgtttgcggcatggtttactgaatactttaaggccactgttgagacctactgttgaggaaaaaaataatatttctttccaaatattgctgttcattgacaatgcaccaagccatccaagagctctgatggagatgtacaaggagattaatgttgttttcatgactgctaacacaacatccgttctgtagcctatggatcaagaagtaatttcaacttttcaagtcctattatttaagaaatacatttcataaagctatagctgtcacagacagtgattcctctgatggatttgggcaaagtaaatcaaaacccttctagaaaggagtcacccttctggtggatgccattaagaacatttgtgtttcgtggaaagaagtaaaaatatcaacattaatgggagtttggaagaagttgattccagccctcatggatgactttgagaagttcaagatcctagtgaagaaagtaactgcagatgtggtggaaatagcaagagaactagaattagaaatagagcttgaagatgtgactgaattgctacaacttcataataaaactttaatgaatgaggagttgcttcctatggaagagtaaagaaagtggtttcttgagatggaatctactcctaatgaagatgttgcaaacattgttgagatgacacaaagaatttagaatattacatcaacttagttgataaagcagcagcaggatttgacgggattgactgcaattttgaaagaagttctactgtaggtaaaatgctatcaaacaccatcacatgctacagagaaatctgttgcgaaaggaagagtcaattgatgcgacaaacttcattgtcttattttaagaaattgccacagtcacctcggccttcggcaatcaccaccctaatcagtcagtatccaacaatgtcaagacaagaccctcccccagcaaaaggattatgactcaccaaaggctcagatgatccttagcattttaacaataaagtattttttaattaaggtatgtaccttgttttttcagacataatgttattgcacacatcattgactacatatagtgtaaacataacttttatgtgtactgggaaacgaaatatttcttatgacttgctttattgtggtggcctggaaccaaacccacaatacctccaaggtctccttacataagtgaagacaagtggtattttgtctttctgtacctgacttatttcacttaacctaatgttctccaggtttgttcatgttatcacaaatgacaggatttccttctttgttaagaccaaatagtattccattatgcctatatactgcatttcctttacccatttatctattcattgatggactcataggttgactccatatcttggctactgtgctctccctttcttttgtgctgggtaaggagtgagtcttggtgaatccttgtcattgctctgtctttttctggccaggcatctctaaaatgtgtcccccagctgatgggaggtctgtgcctcctccttcgatcccttccctggaaagagcaccaaggaagaggtccttaatgaccagtcctgcctctcagatgagcactctcctcctccctgaccagctctccatccccctcaccactagggcctttgtctggcttcatgagaagaacaatgagcatacatgggggaagatgcttcctccaccaggacagccattaactaacaagcccgccctccccagtgaaggccaacctccctcctaacacattctctcttggaacagccaagctttcctgtgcagctgagctgaattccacttcaatggataaataatcttgcccactgacaagtcctcttttctaagggaccaggattttccaacccttgatgaggacagatctgtttggaagggaccacaagattctaggaattagctggaaatcaggggtgaaattatttgccaaggccagaatgtataacaaatgcccctgggagccgaggaaaagaggcggcaccttgctgcagcacctgcccctcctgggtgttagttacatgtcctgtgatgtggttgccaagaactccttccaggacgaggtggtggccctgaaatgcacaaactgacccaattgcattattgcctgtttttttaaattaaactttttattttgagatacgtattgattctgatgcagttataagaaatactgtgctgtttacccagtttgccccaatggcaacatcttgcaaaactatagtaccatatcacagccatgatactgacatggctacaatcccctgattttattcatatttcccagttttacttgtgccccatgtatgtatgtgtgcatttagttctatacaactttatcacgtgttaagatgtgtcaaaatacagaaccattctgtcaccacaaagatccttcctgttgccttttataaccacacctcccttgctccctctacttcctcatctctaaccccaggaaccactaatctgttctttgtctctataatttgtcatttcaagaatgttatgtaaatgaaataatatagtttataatctggagcttggcttttttactcatcctaattcccttgagattcatccaagttgttgttgggtgtaagaacagtttgttcctcctcattgccatgtctggttttaatcattaagcaccccaacatggcacccaagcccaattacaaatccctcaggacatgatcctcagggaacttttattctaagagagcccatatgttttgtttggtgctgctgagtttgggggtgtggggatggaacatgttgcaagtttttctaggtacatgcaaacatacctaggttccttcatctccttccccaaaacagtgatcaattggattgtaatattctttagcactggttgacagcccttccttgtgtctccttgtcaccttcctccccaggagcacatctacaagctgatgaagagtgacagctatgcccgcttcctccggtcaaatgcttaccaggatttgctgctggccaagaagaaggtatctttgggaagggcaggcttgctcttagcactgttgactcttgcctgctgcttgctgctggtttgaaatgagaatatcatcccttgggttttatttatttcctactttcttctttcccttctctatctgctcccattctaatggaaaacagttaggattgtcaccaccccagccccactgcaaggtccaggatggggcatcctacctccacatccctactgcctctctctgcatgttctgcccatggtgggggtgggtacgtagggtgacaaaagactaaggccacagtggctcagcataggagtgcagggctggcagtaacaccagcaaaacccttaggacactggagagagcccctcactgcaaagtccagccccttcacctcagacttctctccctgaccagcccagagaggagtatgaggccagggttggggcagctctctcactggtcagaaagccttgtcagtttcaagagcacaatcaggtacctaaagtcatcctggggtttctccctccttgacacccccttcctctcccgcacctgccccacggtgttgcctttctctcttaaccaagaagtaactgcacccagctccttcctcctcctccttagaactcagccatggttccttgcagcccatggagtcatggatttgaggtgcaggggccctcagcatgcaggtgaggggtgacagaagcaggaataaattcagctagattcctgggaagagaggaggaagagtaggcaggagaatagggtccaggaagggaatggaaggcaagagagagggctcctggtttcagtacacctgcccaccctctgtgcttttcagctctgatctgaggcccatgtgtggttaagtgtggctcaacttgcaccaaaccctatgacttctgtgccatggcacttagggagcacaggcatccctttctcctccctcctggactcccagccccaggccctaagcacgtggttgcccatcacatgctctccgctgggctgcctctcagccacgcaagccttctctctgtgtgctgtcaccctcatgtgccaggatcctgtctgcgtatctggttgggaccacacaactccagagtcctggagagcatttataacctgctctcctgcccttgtgtagccctggaaagaggccatggagtctgagaaaggaaagaggacttctggggtatcccagttgtcagcagctctctgggtttcctgcatccctccccacaggtgtggctactgtgatgggcagtgtggagcctggcctcctgtcgattcccctgctggaggatgccaatggaggggctcctttggaggaggccgacaccctcatacatggctctaatgcccattttttctaagaactagaggaaagaaaaattataggaacttttgataactccagcccagatctcatggatgaaggtcaaagtaagtttttcttattttctgtggctcaagacccctgatctgatcacagtttggtgactttctaaggctctggtagtttaaccagtctaggcctgtctacacacctagaagaagagaagctagaggccattgattctccttgtgggtttgaacacaaaggaaaaatgcaccccaaaccaggctgagacccctgtggctgcagatcctcccttccaagaagaaaacctctcagaggaggtcacttgagtgaggaaggaactggcaacctgcctgggaaaagttccttagagttatcctcccagctcccgaagtaagggatgttcttgagacagaaagcccttgcagataccaacaacgtctcaatactgaggagttgtttcccaaaacagtgacaaaacctgctttctccttctgtttcttcctgagagtctccaggtatggatctgatttgtaactcggcactttcaggtaggcctagagtattcttctgatttcagggacgggttcaccgtatccaggtcataaaaggtatgtgagattcacaacctccggcggagagagggaatatgaatcagcctcacttttctgctgagaactgacctggacggagtcttgaggcacagccttctgatccttcatccctaattcagcctcttttctaatattttccaaataaatgatagtcacactgaagaatcaggttctcagggggtaggtgagctgagtcctgagggctactctaggaaacttcagtaccagtgatgatggttttccagggcagctcaatggccagtgcaaggcagaggagccaagtgagccagaccaatggccaccctctgtgagccagaggataagaataacaggccgacaatgccagctgcagggcccaggactggcctgacttgagccaagtgtatgccacccaggctggccacagggttcaagctgagtcctgccatccccagaatagagacttggtatggtacccggggccaagcatgagtccttcagttcctagtacaagaagaaaggccagcccaactctgtggtgttatgtcgtttgtgttgtattttccttctgcaacctcatatctgtcttctggcagccagctgagctgacaaggggcctggctgccaaggaagccccccaacttcatccacacaggcggctgcctttggcctgtcccctctgctttcagcacagtccgcagacccacagacctcaggctgcctctttagctccctcatttcagttatttgctgggtgtatgtttgtgtctatgtgagtgtgtgcactctccgaacttctcagcctcgggctcaggaccctggaacgggatccaggatacactagcaggtatttgagcggtcattctactctcccggaacccctgcagctaggaaatgtggggtgaaaggaaagtcaggagcaccccacacctctcttcctcctgtagtagagggaggctaggcctggaaagacattcaagggctttgcctctcctcgctcctgttctgggaaccccagctaagagttccccacaatggtttctgagcttcctctagcctgtcgtacgtacatcttggcaggtgttatgtcaccttttggatactgagaaaacacacaatccccatgttattgtcttctgagacccaagaccctttgtccatggcaaaggctatgagtagaccctccttgctctaaggacacagaacgagggtcactaggaagtcactgaagttagcaaactttctggctgcctctgggcaggggaatctcaagagagaaaacagtcctaaggcagactcatggatgagtagataacttcgcttccccggcagccccttcctgacgtccctcccacaccctgctggctctcagagccagtctgttctgtgtcaggacttggggggcccccagggccccagggccacaaccaccagggctcctgcctgtgggcacggcaggttgaaagcagcaagcaagctgctcaaacccaccgactgtggtcctgcagcaaagtcatgatggttctgatccaagccccgcaagcaccattcatggcccccggagaagcaaagcccccctctctgctccctgctccaaggaggcggcaccatttctcgtgggcttctgtcttctgtctctcccattgactcttccaacagctctggctgcttctcttttcccatttttcgccccattttgctttggtttttgttattctttagctgcagctgctgctgtttgggaaccacgtataagctgaagattttttttttctgtatttttctccctacccttttttttttttcctaaagccagaaagtgagcaaggtcgtagaacttccctagaaaagttcactcgcagtgtggtaagttcagtcggttttcttccctcagcttttcttttggttttggttttttctttcttcttcttttttttttttttccctttggttgttgtttcctttggggtgggagggagtccagtgctttctccctcgactcagcccttttcttttgcgagtgtctgcagcttctcttctagggatgaaaatgcaaaaaagagcaagcggctccctctgcagaaggtgcacccttgatcgcccagcctcaggcctgggcatttgatcatctgttcagggctttgaggaggagggaccctgctgccctcggggctgtgcggtttgtgcatcttctgcagcagctcagggagaagccatcgaactataccgtgaaataaattggctcagaaccatagctcatcgaaaaaaaaaaaaaaagccaaaatttccctctgtgaaccctggcagtcacgccggtgtgggtcgcgagctaatgttgctgtgtaggcggcttttgctgtgtgcagaaagcggccgtgctgcatgggtcctggcgatgtggcctagctggcgtgtgtgttagtcgcctctgcatgagtcccttccagcccccatcagcctcatgtgcacagtgtgatagggagaggagggaagtagctgaatccctgcggtgtcctgggtactccccgggggcaaggtcctaccggcctcctcaggccttgattctaacaggctgggtaaagatgggcttcagattcctacaggttcatggtacgccccagctagagaggtagagctccccacagtggcacataaagacagccgtggcaacaggtgggagtggggagtccgtggctgttccctggggtgcatggctgagactctctaccatggtttgtagaacaacacaggccaatctcctctttccatgctggtcggcccaagatttgaacattgagctcagtgcacaagaaatactcaatcccgctcaatcacggggcccatcctgtaccatgaacatcaaaccagagggaaccagggagcagggtcccatgcagggagctggccacattcccttcccaaagggtggcagcccattgatattgacttgcctttgttccacctctgttgaggaggaaaatccttgtaaaacctgactactgtgtgactggtatacgtatttcatccttttaagaaaaagtctaaggctcctgggttgaaagcagcctagtcatttacgtgtcgtagctagatgcattttaagtgcatttaaacattatcttgaatttgctacatgtaaacctcaaataactctagtgggtggcaattaattaaacatcggtatccatcccttcccttcctcggtcttccctctctgtggcctttcctcatgagaaatcagaatgtgcagaacacaaggcctgcgggtgcctggtctatcttcatggctgctttgccaatggccgtgtggctccgcacaccaagaagctgccacgggctgtcagagtcaaggcttctgggacttccttcactccatgatggcctgagagaaggtagtgggatcccatctctctctgtttgtctcttttgaggactggctactgtgcgggtggaggatggttagggattttgctgacaagccaagggtgcctgtgtaagcagagccttgacagcccccggaagctcttgagggtgaccgtgcaggccacgggtgtgagaggggaagcctggtacttggacaaaacgtccagacattttcaggctgtttttcaagagaagtgagtatcaagaaaggcaagaatggtctcgcgaagctctgtgaggagcatttattgatttcctttcatcccagaagtggtgttggcttgggggttctcccaaggtctgttagcaaagcatttggaacaagaaagcaccaagacacccctaagtgtctgaagtgcacacatgggagagcttccagagggagtttcagagtgagctgaaggagaaaagtatcctaagctcctgagggtgtggataaaaggcccaaactattaaaaaaaactaaattcctaaattccctgctattttatgaacaagaaactctaacaggtgatgcattcagaatttggggttccagtggtggagatggattgccatccatccatgctcctcctgctcttggggtgacaccatagccccacaagatgtggctaagtttggggaataatatgacccatgtgttggctctcagattacttaagattggaacccaggaatctggtctcaacagcccagtggtctcatcaaacagaactaactaactgatcaaccaatatgccttgcaatttgatagccattctctgactatcatatgcctaaagtatttgatttctctaagagaagatctacgtgaatgttttatctgctatatactgcaagctataaaactaaatgaagggccagttcaatagcattcctgtgttgctgggaaagatgtgtaagaacatgacccatgtcatggggctaataatggaaacaggggagtgaagctgggcagctcacggaccaaagacgtgaggccaattaccatttaggattaattgatggcaaaaagaaataatgttgatccaggtgattggataactcattcagctggaggcttgtcaagactgaatctgaattcagaatttctccccagaacatgccaatgtcctttcttttcttggtagaagagaaacacttggaaaaaacaaattgttctttccaagtcttatgttgtgccatgacatagagggattatctgttaagaccacatatgcccccttttccatgagatcctaaggagacatttaatatggttcatggaagcttttagggccatgttagtttgggtgacgaaggggcctggtactccccagtcaatagaggaagtgctgtatgagcttctctttccaatgcaagcttcattccaggttactcaggacttggatatacaaagcaaatgtctggggacactgggccaagcatcctgtcattttgcagactgaaaccacaaaccctgcttatttgataaggcccaggttctgaactaaacatgactgaagtccacgacagggcgcaactagcctaccatgtacgttcatccaaaatggaaaacaagactccctctggtgggcccagcctcacagatgcccagctgaccaggcaaaacacaggctgggtttcagcccctattgatcctcagctgccctggtgcagtgaataacccacgccactgtacatggccacccttgtccgaggagcctgtttcagaaagagctgtaacacacagcagcttctccagggcccccaatacatggcctcaggtcatgtgatttggagcctgtctctgcctaatcctgctcatggggaagcttcctttcacagtggctgtaacatatgaaaaccacagtaggagaaatctggctagtcactgtgggttgcctttgcttcaccttccagctgttcttcagattctttggtgggaagtctcaggcattactgaccagggagaggaggtgccttctctcactgaagactctttcctgttgcttggtgatgtctagcctgccactctctgctatcttcctggttttgcagttgacagaggacaataggagcatgaaggtggccagagctgaaatgctcaccctcccactgcttcttgagacagagtctcactctccgagcctggagtgcagtggcacaatcttggctcactgcaacctctgcctcctaggttcaagcgattctcctgcctcagcctcccgagtagctgggattacaggcacacgccaccacacccggctaatttttgtacttttagtagagatggggtttcaccatattggccaggctgttctcaaactcctgacctcaagtgatccacctgcctcccaaagtgctgggattacaggcatgagccaccacaccccgccctctgctctctcttaagtgtgcttgttgcttcagcttccacagagtctaccacagtggggtggggggcctcaccaaagagggcctggctctgacatagaggaccaggagcatgcgtgggagggagagggggcaagaggaatcggggccaagccacagcagcagctcccttgttgagatagatactggctgaagccatctggtgagagctccaatctggggaggagaagctggagaaagtcctttgctcctctgtccagttccacagaaaaagccgcagagggtgatagcactgaagttaggagaaaatggcagccccgagtgaggctggtgtcagcctccctgggtacctttggaggctcagttgaaaccttacctgccctcttgagagcttcatcagctccagccttgggctccaaagatagatagatagaaaatggggttgctggtgccagagcaagcactggaggccacggaggagaagggagaggaggaccaggcgttcatccacctcctaagagagcatcgaagtttagctttgccaaggtgctccttggaattgcggcaggaagggccggaagctgcagaaggcttggcatgtgatgggtggcatctctgcgacaggctttcctgtcctgcctgcctgccaaggaatgcagcaggcaagtcagatggggagcgggaagctctgggagccagctgccactcagcctccctcgccccctccttccatccccctgttccttcccctgccaaaagccaaggaagagctaatgagagccaagaagtcaacagctcactcatccccctccaggcagctctgcagagagaaactcccagctccaggcccaggtgctgaccggaagtggagggctaaggctctccgcaggggagggggcaggcaggcaatcagggcagtcagccaaccggcagaagcagctcctgcccccaggaaggcggtgttgttttcccctcctcctcaaggtttcatggggaacagccttgcaccctggtggaatgagttcccaaatacctagactcagcagaatccccagagggctttgacctcagttgaaatgatctttctgtgcctctggcaagggccaattggctaaaaatctttccaaagggttagtttttattgcaaacagtccttggactcctttgggaccactgggtcacaaacattagtgccagcctctcccatctcagagcactgagatccagctgcagtgaaaccctggccctggctggagctggagggagacttccatcgaagtgtttgggaaggaaagcagggaaacctgcctctctggagcagcaagtgcatgtcctgggactctgagacacctcagcagccctcctgcagactggctcctgcttccagcctcagcttgctagctatgtgacctcaagcaaatcactagccctctctgagccctggttttctcctctgaaatgacttggactaggtcgtctcgatggtcccttccagctagcggtgttctgcaggtctgtgcttccctctgtcctgagatttctgagttatataactcattccttagaatgggagaggagctgtcttcttgcccagttagttacctgattcagaagtgcctgccagcctgtgaggctgggaaataaactgtggatagacttgagttgggtgtatttacaaagcctggacatgcactggcaggagaactgagtgccccaggctccccacacctacaccacaggccctgctcagttgttcagggttcactcgtccacggtgagtcgccggagggtcagggaggactcacagagaacagggtgagtgccctacacccttcagcttgccagttctgcagtccccacccttccggtctggatgcccagctgtgtgtgtgtgtgtcaggtggggtcagctgggcagaaaggtggaccccagggtcggtgttgccgcatcactgcatgcactgtggggtcccaggggccctatgggtataggaaggaatgaaatgtgagcacttgggaatctcagcacactctgctgctcacctgctaccaggctttctggttccccagggaaccctgggccagcttgttgctgtcctcttttagcgatgggaaataagagtatgagagacagtgttatcctgtttacaatcagtggtgaagtccgtggttaagaccaggttacaactcctctatgcttcgcttcttatcttgactctgtgtgaaattaggaaaagcatatttactgttatagttttgtagctggaaaatgaaaatataaaagtctattttttataaactacaaaatgtaaaacaacagactcagtatggctggtgggtacagagaagacaaagtggctcctcacggggttgacaggagtctcgagacttttatcaaaaaaggccagaagttggttgtcatttttgagacactgggccctagaccctgacgtttccgttggaaggaggagcccccagctgttcccgctgatggttcaacctgtccgccaaaagcagccaaaatgctctccccacggagtgcccacttggagaaaaaccccactggtgactcaccttctggacatgtggggcaatcagggcccggtggaggcagctgctcctggctttccctggtgggccctccctcgacccccgcccaggccctctcctgccttccccagaccccaatgtgccaagcagtcaagtgaaaatcaaatcctctgaggcagaaagacacagctgtgtgtttacagccactgattcagatccaaatcgcgtaccctgccagtctctagcaaggcaggctgggggcaaagtgtgtgtatgccaagcagggatctatttcgggaggtgacctgcaggccttcgccatgacagtgccttcctcccacccactctcaggaaaggtgctctcactttacaagcggctgatggggttgtggggtctcggcatgcttgtcacttgtgcagtcagaccccagtgccatcctcgtgcagccacatgggaactgtgtgggctcccacctgcctagtaagaaggcagagagtgaaggggagtgcagggccccccgcaggataaacagcgggaaggccgaccactcagaagacaggatgcccgcctctgcctaggacagagcctgcctcagtcctgtccggggagcagcagcaccgcagcagagggggccagagaaagagcatccaatggcaggagtctggcaaggcgacagcactgccaatgtcacggtcaaggagaggagacccaactctgcctgtggtccagactggaaagttcaaagagaagtcagagagcttcaagtctgaggacttcaaaggctaagaagtaagacccccccccgacccatggaagtccccccaaaatgagctcctggtggaaacaacaggggatgcttcccccttttaaaatagtgatgagtgtccctggtttgagttgagttaggaaagcatgacattttggaaggaggccaggatacctgtccataggtaggaatagcctgtaagatgttgccctcctgcagtgtggctaaatgggacactgccgggggtgggactcagagcagtgggatttttagttttgtcatgtttgcccaaaggtggatgagagaaagacccttgggtgtttgcttagtggcttcccaatgggtgggaaggtgagacggggttggaagcatggagccaccccagcagtggcagggccacagggcagcggttcttccatgccccctaatcatggccacattgtatcagcctgagcatgagcaacagcaccatggccacatacgggaatgggcctcattggtgtaatatttggcagattctctccacaccccccgtggcggtctggcttactgttaagaagggtaaccttaaaaaatacatttcccactccagaaaatactcatatgtggcctgttagcagcacaagaagggtgaaagcaatgcccattcctgcctccctccccctgctcacctccacgtccctgtttgcccctttgtaggtgaagtgagtatattcagcgtcttcatggcaggggagagggtgtattaatccgtctatgtccgctggaaaggcagtctctgagcgggccacaagggttcagccatggcccatccaataacctttttgatgacttggatgaagagacaaacattccaaccacattcaaagatccagacctccaaagtgtggctcatttggtagataatggaattatatttggaaagcatttcccgcagctgggatgatgggtcaaaaacagatagcattttaccagatcatatttgtgtgtgtgtgtgtgcgcgcgtgtgtgtgtgtgtgtgtgtgtgttttaaattcagtttcccaactacaggatggcatttgtagcctttcctaaaaatcaagtttaaaaaaaaaaaatttcttgggttgtaattgacgataagcttagtgtaagcaaatgcagaatgcagctgctttccaaagggcagctttaggctatataacaaaagtgggaaaggaaaagtgttccattgctttttgttgctctaagcaatattaagtcttggttctaagcccccacattatcaggaactttaacatctagagacaattgagagagaagagctagagagagaaagtgaccctggaagccacgtcggaagaggctggagtaaaaatgtctagccccccagcagacttgatggccaccgtgagctctttgcatttgtcttcaagagtggacacttccgggttgctccagagagcaaggctagaacaaatggctagaagatagataggtagatactaaaaatattctaacaataacagaatattccaacaatagactatgtcccctcaaagggcaacgagctccatgtctagccgtttagaagctgaatggccaaggatagtgcagagtaggtttctacaccagatcccatgatcttttgcaactggaattctatgctgccccaaatacttgttaaatggatccgactgcatttcattctgtggtttataaataagtcctggaaaaggagaatgaattataaggaaggagtttgctgagattggaggagagggatctgaaagactcaggactagactccgccttgagggagaaaaagccacaagatgacacactcaaagcaagggaaaccgtcaggaagtggaattactgcccttcacatgtcatccttgccttcttttctgttttttgtttttttttttggcatttgctgccgcagcagctgagctctgggcaacagggctctctctcccgaatgtctgaaaggaggtcagcaagtggaggacacaggcgcccactggcacagggcattggcaaccatcgtgcagtgagccccagcacagccagggtggccatgtgcgtggggcgtcctggcccaaggttgaagaaaactcatcctgtcatagttcccatccggaaagggtgttttgttgaaagcaaaaaggatcataaagtcatttgccttttacccaatgccagttccagattccaggtaaatgagctaacatcaaaaacacctcagccggctgggcgtggtggctcacatctgtaatccgagcactttgggaggccgagacaggcagatcacctgaggtcaggcgttcaagaccagcctggtcaacgtggtgaaaccccgtctctactaaaaatacaaaaatgagccaggtgtggtggcacatgcctataatcccagctactcgggaggctgaggcaggaggatcactagaacaagggaggcggaggttgcagtgagccaagcttgcaccacctcactccagcctgggcgacagagcaaaactccatccccatcccacaaaaaaccccccagagacctcggactgaggagaaactatgcccccaccctggcttccctcctctagggccctgccagggggacttgtcctcagcccagctcagggaaagggaagggttcccatgtcacattctttccagctgtcctaagaaccaccccgattgccgatgacactccctcctctcttgggcttcaccagggctgctttcaactcatcgtgggattgtgtaattatggtgattacagcttgtgacttttttcctctccatcttttgctttcaaattctttgaggcctctcattaaacatggcgatcccggtaaagtcagcaaagttttaataagacactttttacagctaaagaaagcccagtcagggttgattgctactatgttctctcagatactccattaaaactctatcaggtgcagttggtgcctaggtataagaggtgggggagagggaaggcagggaggcagagggcacctgtacttagtgacagggctggagaaccattccacaccatgcccctggctttttttgtttgcactaagcaccaagtacatctgagcccccgtgcctaacaggaaaagacagactgtcaagcaaggaccgaaagcctggccttaacatcatagcacattacactgggaaatggagatggagcatccaagacaacacttaacccaaccttgtaatcttctgcagcaaaagtggtgggggaattctgatacgtgctctgtcctggttaatactagaaggttctgaggcatccataattctaaataattaaaggagtcaatcaatcactagcctttgtgagtcatcacaatccggtggttttacacctgatggaggttttacacctgatggaggtttccttggtagtgattcagcttcacatctcattcttggctaatctttaatcatagcttgcttgcttgctttttgttgttgttttggtttggtttttgggggggtgttttttttgagacagagcctcgctttgttgcctaggctggagtgcagtggcgcaatctcagctcactgcaacctccacctcccaggtttaagcgattctcctgcctcagcctcctgagtagttgggattacaggcctgcaccaccacactcaactaatttttgtactcttagtagagacggagtttcaccatgtcagccaggctggtctcgaactcctggcctcaagtgatctgcacacctcggcctcccaaagtgctggagttacaagtgtgagccaccgtgcccagctcatagctttcttgaatagttatcatagctgtaggacatcatgagaaggaccatcaaggagtgtggcttgtgtgtgtgagccccgtgacccacccttcagcaggttcatccaggttcccctcatttctatattccctggggactacacagatgcccgcacagtgaagtgcatcttgctccagcaggactgtgtttctgagaggtccctgattggctgctcgtggctgaccgtcccataccaaccagactgccttttaccctgcaggtagccagttacctcactacctgtgtctcaaaagagcaaggagctggattgtgactgagcagcaccaaccacctggagttaaatgtcaaaaacgtggcagggacatttcccccaactgcattcccatccactactgaaggtggcctgctcgtgtgaccccttgagaacaacggtccctttagtacccaccagaatgcagagaagtaagctaagttcgagacaggcaaccccagctgaatccctttttctccacctgatattatgtgaccctgggcaagtcacttgcatgtctgacaggtacaacaaagcccactgcacagggtagatgttggcattcaatgaggatgtgatcacaagagctgccatttattgggagctcacactcacagtgttggactgtgtcatgctggctttgcctgggatggactttggttctacttcagctccatcacttagttgtttgaattgcacagcttctctaagcctcagtttcctcatccataaaagggagataagagtaaataagtaggaataaaatgcataacgtccttagcacactgtgtgcagtgcgtgtgcttaacaggtgtagctcttagaatcagtttcatcattatgatattatttgcagctcatacttaggctgcgcttattaccttatttaatttccaacaatattctgcaagataggcatcattatatacatcttgtggttgagggtgggtacgtgggtatctcctatatgacagtctgcacaaggtgcatgtattacagagatcagctcatggtaactactcaataaatggcagctatgattgttggcttatttttaaagtcaactcagagagttagtttttctgcatttcctggaaatgaagggactgtggtgcccagcaggccagcttctgttctatggtcgatttcctggggcccctaagcacttcccgggaagctgtgggaactggggggcttgtcagcctgtaaggtgctgggaggtggggagggccaccaggcaaatggtgcacgtgttgtggggatctggcatttggccgcctactgagttgaaggactcgaaggtgcctcctgctaccagagacagataaggaatgggtctacccaagataagaagatgaaatccactcctccaaatgtagccctccatgtgacagaaacactcacctctcagctgtctgcttgcctggagccaccctgagcaatgcaacctcaacaagtccagttgctccgtcagtccaataaacagaggtttctcttttttaaccacttattccaaagcgaggtagtggaggagtcagaagcacgtggcaggggatgctttgaaattccttgataaaccggacccctggggtgggcactcctactgcctatagtaccgacagaaacagaagtggagaagttgtttatttccaatgaggtcaataaatgcctttttcatgggggagaattccatttttatatatgtattttaaggtgaatgctttaagtttgcagtatttgtcagagtggcatcttaggagctgatagaaaactctacagccaaacaagcgattgcctgtgcaccttgcatgagatgcttctgtaagtgcctgtggtctcaacatgcacatgaacgcatgcactggtgtatgcacatgtgcacaggtgtatacacaggtgcatgtgccgcctgcctgatgttcgcctctgtgttcagtgtatggtgtgcatataaccataagctgcaaacctgcaagtatctctgttgcatggattgcatgccctctgcagctgtgtgtgtgtctgggcaggggctcctctaaagccacaggtcttcacagtttcagctggataagttattcttcacttcccttcctaaaaacacaattgcctagtgctgctggcgcagagtcagaatggccgctgcatttcacccccgaggtggcttccttccagcagtgggtgagtgatcccggcgttcgcacactctctaatctgtggaatccttctgcacagaaggtgttccaaaatccaaaagagatgatctgtttgtccatggcatcgtctctgcccaccactcctgttctcatgccctggttccagggacagtcggcagcacccatttcttggtgtctctgttttttctgcccattttttgtacccatagtttttctctcctaagaaacaaggagctgaggggtccagaaatgatgctgagatgagtcccttgtcccagaggcaatgtgcagataacatccttagatattgacccagtaactctcttctcctagtcccattccctagcagaacagggaatacccactacctttgaagatgcttctaaatccaataacagcatccttaggcttcatttcctggtgaaagcttccataactcttcctctgtgggccctgggccaaatcctgcaggaaacgtagcaatctcacatttctacacactacaccatcaggggagaaaaaagctgggaaaccgcccatcctctgtcccatggggaccaaaagcatctcagcagcacgtgaaaagagcctgtagggaaataaggttctctgtagctaagagttccaatgacctaagtttctgtccaggtatctcctgaaaacgctgcttagtctgttccctggtgtacttcctccggttaggaatccatgtctgataagtgcctgctaaattgcattcctgatagtggggaagaaagaaatgagccggccctctttgcatatgcatccaaatgggcatggacattcactgaattgttatgcttttgtggggggatgagaggtcagcaattctaggctccgccttttcagctggctaaaccaaggaccccaagaaatgtacgtgttttgggtgaacacatttgcaagagataagtgtcctcaggaggatggggtcagagtcctcataggtcctcaggagaatcacatactgccaaccaaataactttctcttgccgctttgtccacaatatcaagtaactaaattccagcttcactgtctcccgtagtcatagtcaagggttacttgaatttcctagttggaaaaaagtagcatcaacttgttgccaatagcaacacagccatgtccctgtttcctagagccttttggtctttgcctaatttggagtgaaccagagcttagatgccagagtccatttgggaaggaggaggagaagaggaacaggcgggcattaagtgggtcacaggaaggcatgccaccgagaggccttacaggcagaatgccaccctcattccactcctgaagccaccaagaatttcctgcaagctgagagaagaaagagcaacagggttgttccgtcagatgagaggagggagagaagagagagctggtgtgaaaagggggcatttccaccacacagggatgcagagtagcagggaaaatggagatgcacaacttggacgcgagaccggggagtctggacctggcattctgccactcatgtagggctcagctgctgagtccttgtctctcccaccatccctacccagctccggatttgtccctgcacagctggggggccatggagaaaggtcccccatcactcagcaaaactgacaggcagaagaaagtgatgagcatggtgaggccagggtcagagatgccaggaacaccagcagggagggcttcctccacctggctgggcaccccgaattaggcacttggcctagaatgatttaaagtggggttggttttcattagagtaaggccaccctgcctgccccaccttagaaagggaaacatcacacctgctcctgtcctccctggggcatttgccatgtgtgttcctagaggcatcagcatcagtaacacagggccacaaacagaacggtgggttcacccagcctgtccagcagctaccacctgaaatctacatgcaccaagccatggtgacctgcaccccagctcaatgcagtaaccaaaagccccttttgccaggcttgtcagccagcagatggcacctcctttctctcaggatttccaaatgggatgaggggaagccgcttcgcagcatagaacctgcctgagataagctcaagcatgctcaagaacttaagttcttttctcagggaagttgagaaaatcaccctgcattgcccagagaggttgcccagtacgggttgggcacaggggactccttcatccctgagtgtttccatctgcctccttccttgagagtgacagccatgtgcaaagtaagaggggcatgggtcgtgaaggccgaccaactcagctttgccactgactagccatgcactcccaggcaagttactcaaactccgtttgagtctgtttccttgttcgtttagtggagtttatagaaatgcctaactggcaagcatgttgtggacataagtaagtgcgggtgcttgtaaaatgcctcgcatgcttgacagacacacaatagttgctcaatggtccatcagcaggtggctgtttgttagtaactgtcctcacagctacctgtgtacctagtgggggaccattcccaccatgccactgtcaaggcctgagtgatttgaagaacaaggcacttgaggagagagggtccatgagctacccgtgccattccatcaaacaggcccatgggagatcaggggataggtgggtccttttacatttaatccagataggagaactggcaactcttcttttgtagattcaaaaactttttaaaatattttaaagcactggtagttgccaattatattagtccattttcacaatgctataaagaaatacctgagactgggtaatttctaatgaaaagaggtttaattgactcacagttccacatggctggggaagcctcaggaaacttacaatcatggtggaaagggaagcagtcttacttggcagcaggcaagagagagcgagtgtgtattaacacttaaaaaaccatcggatctcatgagaactcactccctatcacgagaatagcatgggggaaaccacccccatgatccaatcacctcccactagttcccgctctcaacacatggggattatagggattacaattcgaagtgagatttgggttcagacccagagccaaaccatatcaccaatacaggatagagtaaggtgtctgagcctactagtggtcccagtgacattctgtgggaattgctttcagaagacgtgactgctgggtacctcctccatccccagtgtttaccaggcagagcctgagtgtttacaccacacacagcctgagtctttataccactgtacatgagaaggtaggggtcgggggggcggggtggggggtgctgttgcaagaaaaaaaaatccattacgtttattttgatcaaatttattattttttaaacaggttcagttttaagtattcatgaatgtaccatttattaattctttaatcagtgaacgtctcttttttgattaattcacttttcatctatcccttgacttttttaaaaaaattggggtattgttttatgtttgtgatatagcttcctatttaaaaggggtcaaataaaaaaatattttaaaaccacataaaatgcccttaagcccctgcgagagttgaggaaggttgccaaggccctacaagtaacacagaccccaggaatgggtcagccacaggctcccgcccctcctcactgcggaagggtgagaaagacaggaatggcctctcttccttcccatgctgctctgacctacctctgttgtggaggaaccataacgggttccatagcccggtttttccatttcctatgccccaccttgtttcacagagttgagttaatagagggtgataagaaatagagaatttaaaaagtgttttgaaattattctaggttaagtgtggattttcccaccatcccctgccagcgtttctccgacatctcagactgcactctctctccccagttttagacatcattgaggaagaagatgccacggaattctttgcattcccttttaaaatcatttcttttgctttgctcagtggagaaggagcaccaggggcagcaaccttccgggagtcacccgatgaagtcaggcaggcctttggcttctcccatcctgctgaacccaagccaggatcccctacctttccacctggctcttgggctcctgacccttatcctcagcaagtctcccccaaccccaccccaggcctctaattccacacgtatacatcctttatgaacttgagcaccatctattcaaaggtgaccttcaggctccttgagagcacgactcatctctctctggggcctccacttcttgcctgctaagttgcatggtgagctgtattcaacgaaacacgatttttcatgagcagggatggaaaatgcctgtgtgtcacaccaaagggatccgtttgcatcaatggaggctagaaatagtgttccacattagttctgttgcgagttcgaattccccaacagaggaatccaggttcctcctgtactggagggggaagcattgaatttctccaaacccagggatgggcccagcaactgaagaagggtaaggagtgggaaattccaaggcatagatgtcatagctgggacttttttttgtcctaattttttttttcttttgagatataattatgcacggtaaaatgaacagacctgaagtacatggctcaatgaatttgacaagtgtatgcacccgtgtaacgtataccccatcaccctagaaggctccttcatgtccctttccaatcaatttcatccttctcccccaggggcaaccgtggttgatttctttcccccataatagcctggattttgatttggcagacttgagatctgtaacttcggtcttagttcatctgagcagatcagcaaaagaatctcatcagaagctcagatgtctttactctcttagcattgaaaaagatcctccctgagccgctagtgcttggctctgctgtcccccagtatgccccaatctgacccccagggctactctctgagccacagccctcctcccagccaaagaaagagtttagcatcagtctcccaggtaagtaagtggcaaaagctcttggtaacccagatagtgcatgctttgttgattaatatgtggaagtgcaatgcacagagccacagcatgtcaagcagcatgttgatttttctcactgcacaaaagggggctattccttttgtgtgtttcctttcagaaaacaaaggattccatgaccaccttcttccaggctcctagccatcaagatggccacagagctgaaatgattaatcagagcggagggtgggaattgaatgtgtgggtgttagtgaacccagcactgagcccatggtccatgaaattgaaggatcccaaattctactggattacactttgccaaatgtctcaaaggtgaaaagcactttgtcggtatgcaaagctttggtgtctctggaatgtaccttctgcagctcagttcttaatcactgtatattttttcacttggacaaaggctgcctgctaatagcattttcaaccatcctcagctgcttcgctcagctacgccaaggcctcgggctgagctggctgcggtttcctggcaccatgatccattcccaactgaccaacactgaggaacattacacactcacaccctgaaaaaaacctgcttcctctgtaactatgcaaatgccagacacaggcaggcagaattaccattccccttctgaagtggttccttcaggatcatccaaactggagacagagatgagagtaaagagacggggcagtgccctggagggtacaggcaggagctcccctctctctgggcacagcggattcctcgggagcttcctgcaagcctataggggcatgcactttggggcagctcatctctgaacacaggtagcctctactatcagatttcactttgatcactgaaaactacaggagtctcagctcttcagaagggaagcagctgctgagcaagtgtgattgcagtatttcttccccaaagccccgggccaggcatctacccatgcccgcatcctgcatgattaaccgccttccagtctgagcctgccctcactcacgcgggaggtcactgggtagcgagtagattgcagctgggctgagctgcctctcaagccgacctgaaccctcatgacctccatctttagcagcaagctggcatttggtaaatgcgcgaaagcaggagtggggagagggagacaaaaatgccaagcagcaccgcctgggttgctgagaggttgggaacaatcccaagggtggcccctaagctggtcagctgcaccatcctaccctgaaatcctgggaaataaaagcagtcgggggaagcgaggagcgggcagtgacaggctggccacaggtccttggagtcagagcggtgaggctgagctccaggatttagtcaggaagagaataattagcaccttcaagcccagcccagcccagcccattctgtagaaaggggaagggttgagggtatggaagcctcagggccaaattcacctaaaacaaatagacacataatcctccagaaatagaatctccaacctccctcaacccacagtcccctctccagccaaaataaccttgttaataggaatgaggctgcagtgaaggtttgggcaactggtaaacctcacctcctttgtctctgggctttgaatgtactcattggcaacagactcttattcagaagcttgagtgattttttttttcccatccaccagctaaatgagagccccaaacgctgtggatagcaaactcagaacatatatatttgggtacataatgtgtgatttgtggccctggcgaaggagggatgggaggaggaggaggacctgatattggtgtgtggtggttatcacagcaataagtggcacctaaaaggagagcaaacttcctttgtgcctttcataggacagggatggacataggtaaccgggggtaggggaggtttgtaagagctctcacacaaggaggcccctaggctcagcagccccgtgtttccccagcaaggatgccccacacccccatgtttcctgccttcaggcctgccccaggaaggcacattcccgagtgacaaatgcctcacactctatgtaagaaagggcactcaaggagagtcaccgctgggtgtgtgccacagaacccggggctggggggagcccttgaaggtcagcctctgccttctaagagctattgttgtacctaacctggtctagacaaaggagtagtcattcttagtgattttcaaagactgacaccataaccctcttggattttttaaaaatctgattaaaaactccttagccaagtataaatgtatcctgctgcaggctaagtttagtgcacttgaagattcagataaggttgctgatggggtgattttgtggacgtgtgtgtgtgtgtgtgtgtgtgtgtgtgtgtgtgtgtgtgtttaagatggggagaaaaaatgaaaagttttgtctcactagtgaaaatggggagtgaaagcaatggggaggaaaaaggtcaaggagaggtagggaaaggcagactttctgacagctcctgagggcaatttcatttttggacaaactcccatctatagcaccagaattctcaaagtcaggctggccatgcctctccatggagatctaagccagatgccacattgtcctgtatccagcaaatccacagcccgtgttgtttattagataaacccgttatccatcaattcatcaatcagcaggtttattgaggaccctaccaggcttcacaaacctgatcaattttttaaattacatctagcttacacgcagccaagcccagtaaacaagacgagccctcacaccccacttggaaatgaacatgaggaatcgctggcccttgcaatctcacggccaaacactgcagccccatgctgacgagctatcacgtgctgcccttcacagatggcggtggtgtcgctgacccactgtcaataatatgggtttggagtgctttcccagacacagtgatcaatctgcctgggtctagccatactgtcctctaaagccctgtgcaatgatgcggatttctaaagagggtgagctggagaacgggcacacactatgtaagggcaataagcaaagcgacggagcctcgctcgtgcccctcaccctcctcctggtgcccagtcgcaactcccctcctagatcaggggcttctccgccatctctccagggcacatacacaacgggactctcctggcacctctatggctgatgcaccaggcctcatgatccagttcactgttttagtttttgagaagaactgccacatgggttatagttgaagggcttgtaggctttcctggtatggggtcatcaaactctgcctctgggtgccacagatgggaagccaagaacataggagacagcaggagtgcactgccctggggcctacagtggctctgagccccagcaaatgccccccactttcatggtcccagaactggtcatcaagaggactcaaggtctttgtgtctaccctgcattccaaacaggactctgccttcttaagactagttcattcattagcttctgatcagccagatccttggccaccctctatttgagtcaagcccccgtccctgatctcagaacaccccaagtccaccttttcctcccccacgtgaacaaaatcaatttcagggcagcccgccggcattaaaaattgctctacctaaaggtttaaatacctggtttttggtaagtaaaattcccataccacaaaaagagtaccaacaacacaccctcataaggggaccctccaggactccctgaaccttccctggagccctggtttctccagctgtccaaagttaaggctcccatacacctagagatcaaatatcaagatggtcagttgggttggttggtcgtttggcctacatggctcatgcaacaattaattcacctgtctggctctctgtctctgtccctctgtgtgtgcgcctgtgcgtgcctctctgtcgctgtctctctgcagggaaagtcgctggcgggcaagcgcctcacgggcctgatgcagtcctcctgaccgttcctaccgcaggtccagggcctgggcccgcggaccccacaggcaggcggcggcgctccacatctgcggacagagtttccttacgaggagacttggtcactgtgaaggagaaagagtgagggcaatgaagggcgatggtggggagactcggtgggtgaatggggagaccagaaagaaagagtccacagagcctgggctgggcccggtggaggctcctgtttacagccctctcttctttgtacagttgtattccaacactccactcgctaagaggccctgatcccagctcattcaggggagaacacgtcgtggggttcctgtcacgactatcacttgagattatattattatcctcactccctcgctgtctggagacggtcacaccttctggcaaattcaagaggcatgagtggaccgagagcacatccagcatttgcatcacctccctggcacctcccatagttacagccactacatccccaccgccgcctgtcatccctcacgtctctgtggccacccgggtgtcactgccagcaccaggcactgctttcacgtaaaatgtccaaatcacatcttcagcaagaaagcaacctcacggattgccccgcctcaaggtctttccaccctctttgagatcagcgttcggagaggtccccgccagcccggtggctgccctcaggtcccgtcacatgtctcaagggtccagcgttcgaggaagcactgttgtagatgacagagctttttgtttcacagctgcggggattctgctgaccatcttttagaaaattatttcataatttattctggctttgcccccttgctccttggtttattccctcatgttttactcaaaataaacatggccatgaactcaggggccattgggattctcccctctggcagccccaggtgggagctgggagggtccccagcccaggaggtggctggattgcagggctggcagcccccacgtggtggcatcctgacaggcacagtgagacccttgctgggtcaggtctcctttgtgtgtgaagctggggcagagtatgctacgaagggaccaggccaggccacagggctctcctcccagtctttatctgaaggcccagccaaagcacccctctaaaccggtcacctaggggaaatgcaaaaacctgcaaaagatccacctgtattccctgtgtgtgtgtgtcaaaatgaccatttgccaacctggctgtgaggtaatgtatgtaaagcaccgagtcaggtgcctgatacgcagtaggtgcttagcaaacggtagctaatactatcatcattgtcattgttattgtgacacccatgagcccacagacagagctgtattaagtaacctgttttgaatccagacattcactcccccacttgctatgactaccctcctttgatctatttttggtcataggtaaaaaaaaaaatctctcttgggagcatataaacaaaaaacatagaagcaataaagcgatcgctggtatttcttttctcatgcagccaaattcgccagctggtgaccaaaggctcagatgcttgcttatttgcagacccggcctcctgggtgctccccagtgacccatctttccaccccaccacctccaagtcctgtctatgtctgcttccacacagccctgtccccagggcaccagccttctgtccctcacagcagtgccatcgcgggcattaggagtcttcgttatgttgtatccttgtgagttcttgactaccatgcccaagtttcccccactggcaatggttcctctcttggaggtacagtggaaaccagagagatgacagatgttgagtcctcagtgtctcagaggcagcaattcttgctggacacctgcacatgctcagcacagaggctggtactttggaggcactaaccacttgatgagtaaatcaatggcataaagccccattccaagttatggggtcttttgacaggcccctttcatcctctttctctttgtataaacctcatgtttcagaacaaaattacagtctaagttcatttgcccccagccttgcccaaggatccccgggctgtgctgacccctaggcatagggcaaagggtgttcccaagcagcaggcacctcagtgccctcagttatccagggcaaggggcctggctgccccctgctcctccccatgatgcaggggctttctaagccaggctgcagacagggcagggttggcttcttggccattccctctgtgcccccttctccttctgactggtctcaccctggagatccccagaggatctgaccagagccaggtggactgtggccctgagatggagctggctgcaggcttacaagcacctctggggacatccagaggggagggtcagtaagcacaacggagctagggagacttcagatggactcaaacccagagcaataatactctcacaccaccccacagctaaggcactcatgttccccagtagatcaagccagaagctttgcaagaagggagtggaacgaggctgcctatccaaggtccatctaccacgcagaacttggtcatgcaagtacatttggaaaatctggtcttggcccgtcccccattggcctggtctacacagccaaaaattcagactagattagatgtttgcaggcaattctgtagcaaagcaaattcccctaccccgtcccttccccctagaagctgccttagcctccctgactgggtgtggtctctgggcctaggactcctccctatgaggaaaagtgctctccagccacatcttggcagccccacaaccacagcatcagggcagctgcagcaagtgaccacccacccgtcgggttagacacacaaggcaccaggcactggcatctgactaaaataacctttccctacatgggaagaggaaagcttgtaggctggcacatataaacgtccagccgcagccagatggcctgaactaagcagcaggaactctctgggctggggaggagcctcctgcccttctagaaagtgatgcgtcagctttgttctcctgggaaggtgttgctataccccaggaacaaagcagggcccaactgccagtgcagtcagctgggcctgcgctccaggctcaccaccgctaagtggtcaggtaccgggccagcatcctgggagggacctcttgcgactctgagttgcagcttggactagctgaacacatggggacatgctccaggggcttcttccctggcaggattcctgggatttcaaactacctcaccaacaggacgctgaaccaggagcctgccacccaactggcccccttggtgattgtggaaggtgatgtttttcctaaaatgcatccctcctgttctgctccatatacatgtgcttcaaaaaccaccaccaggaaagccttcccagaagagggaaaggattaagggctctcttcctttgggccctgcagaatgtattggagggaggtgttgctgcaaggtccaggagctgggaaactctgggctcggggggagataatgcaccaccagcctcaaaaaggagctgcccaagttgaatatgtagcaaagaccatgggataagttgaatagtggccagacgaatcactaataactcaccatgggaccctctgaagagaggcctgtgctcgtgtaaccatagcaacagcagatgccagcaacctactcattagtaccacccagtgataaggcatcccctgggctagacccaggggccataaagtagcaaagtagcaaatgtagcaataaagggcccgggtctatacggggacagggtccaaatgaccaggacttggccctctccccagccccgatgagggctcagagccagctgctgtcagctgtctggggagggaaggccctgctccataccaggggtccctgttctatactctaagcccactcaccgcatgatcacggactcatcggaatggcctcctcttagtgcatgtggttctctttagtttatttttctggaatttggggattggaccccagaaccaaacatgctggtacagtctaaaaataaatgacttgaacccacttcaatcca

SEQ ID NO: 2372 - DNA, 633454 bp, Homo sapiens; identical to SEQ ID NO: 2370

SEQ ID NO: 2373 - DNA, 629678 bp, Homo sapiens; identical to SEQ ID NO: 2368

SEQ ID NO: 2374 - DNA, 633454 bp, Homo sapiens; identical to SEQ ID NO: 2370
